United States Patent 7,365,185 (GENOMIC PLANT SEQUENCES AND USES THEREOF) - sequence listing, part 103

SEQ ID NO: 92402 - DNA, 4957 bp, Oryza sativa
  unsure (1)..(4957): unsure at all n locations
tcaagcactttgtcaaggctgtggtggatgtgtttgctgatcaatacttgagagcaccaactgctgaggacactacaaggttgatggctataaacactccaagggggttcccagggatgctaggttgtattgactgtatgcattggaggtggaagaattgaccaacaggctggaaaggacaatactcagggcatgtggatgggccaaccatgattcttgaagctgttgcatctaaagatttgtggatttggcattccttctttggactaccaggttctcttaatgatatcattgtactacagagatcaccactctttcaaaggcttacattagggacagctccagagttggagtttatggtgaatggaaataaatacaccatgggttactatcttgctgttggcatatacccttcttgggccacttttgtgaagaccatttctaatccacaaggtaacaagagaatacattatgcaaaagttcaagaaggagtgagaaaggatgttgaaagagcatttggtgttctacaagcccgctttgcaatggtgaggggtcctgctagattttgagatacagagaccctatggtacataatgacagcttgtgtaatcatgcacaacatgatcattgacaatgagcgagatgaagatgtagattttgactatgatcaggaggacagtgaggtgttgaggaaggaggaataccaacgacgtaataaacctgtgttagaaaaatttctaaagatacataaagaaattgaagaccgacgggtacataagcaacttcgagatgatcttgtggaacatttgtgggcgcttcatggtgctcggtagtttgtttcattgcattttctatcatgtgtgggttatgttcattatttacttctaggatatatcatttccatgtttgaaaattttgaattcaattttgaatcgtggtgtttgaaattgcaaatttgaatatggttgaactccatgcgctagaattatttatgtttaaattactatgtgttaaactagatataaatataaattctataataaaataaaagagaaaaaaaataggggctaagatatggaggctactactagacataaagacatatttagggtctagaacattgagggcagcccccatttaacttttagggactcgaaagtaggggctactgctagagatgctctaaccctctccaaatccaaatacacaaccatttccttttccggagaaaatctagaggaaaaaaaaaagaccttttcagtatcctccctcgacatctgaaatgtcaaatcggaagagacataaacagaatttgcagacacagcaatcaaacttaatgaagaccacaagatatataattaatttataccttctccgttgagctttcctcttcgagactgaccggccgccgctgttcgccaccacacactgcccataggacggcaacaagctcgcctccggcggcggcggcggccgccgccgccgggagcgactggtcgtcgcacgccgcgcggagcatgagagacgcgagcgcctgagacagcgagtcggagatgtccgccaggatcacctccacggcgccggagctcctccctccgccgccgccgcctcccgctagcatcgccttgagctggttggtcgacttctgcgcgctgcggatgagcctctccgtcgccgccgtgccgcctccggcgccgctagccatgtcaaaatgaggggaataaagtcaagtgtttctctccttctcgtgccaatggtttttgatgctggtcgatcgatggtggcgagtgtgcgctagtacagagggtaactattaggataatcaatgtatcttgcactttattccttttcgatactgtcagactcacttttgtctttgttaattactccctattatacattgacttttcctagctaacttcttaaatttaatttaatcaagtttataaaaaaaaatagtagacgtattcaatacaaaacaagatcctttaaaactaatttggtgttataagcgtgtggttaaatttttatataaacttaattaatcttgaactaattaattagagaaaaaaatttaaaacatatatagtactaatccgagtgatacccttttaaatcagtgaagatataccgtaacatatagagatggtaatgggcgatatgaactgatacccgacagattttactctattactagtcacatattatctaatttttgtactcattggtctattagcggctaaaaatccttagctgttgagtacatgggacctgttctttagtcagtcatacctataaatctatgtgtaaaaaaatgtgtgccattaatgtattgtctaattcttatatggtttgtttatttgctttgaatgttattaatgttagaattacggtcttctgtgatgaagctggtatcaccatcaagctcagaggactaatgctacctctattttttaatttgtaggacgctgactagttaatgtttaaactaaccagtgtcatataaaaaacaggagggagtattatttttgaatgatcgattaatttttatggatgtcgatagctattgatcatagaggtgacaggaacggtgaagccaggcggcggccgcctgaccttgcccggaaggtggatccgccgcgcggaccatcttatgcaccagctgaaagctacgtggcaattttttactagtaatttaattcttacgtgtttatcaaatttcagctgagtcgacgtgtacaacggcagaccatttgtatcaattttcatgagcacacgcgtcaaatgttttctacggtcaaaaaacgcaagaggataagcgcgcgtctaagttctgacactccgaagcctggtatgttattctcttcgtccaataatatacgttctaatataaatgaattgtttatctagatttattctactaggatatactaaatccacctaaagtgccttatattatgagacagaggaagtattgtatagcatatattttataaataatgtcgaatagcaagtcaagtacataaccactcgatcttaattaggacccatttggtaaagttctaactcctaaatttagcttcaggagttaagggtctatttgacacagctccagctccacctctcctggagctagagcgtagccaaacagtttcagctccacctaaaatgggagtggagtgggtggagctctctcacaaatgaattagcgaggtgaagctgggtttgggcanntncacnactctactccagacctaactcctggagttaaatttaggagctgcagctctaccaaacgggccctaagtctggagtggagttggtggagctgcctaaccccagctacaactctctagttcattttgtgagaacgcttcacccagctccactaccatttcaagtggagctgaaactgtttggctggacctaggagaggtggagctggagctgtgctaaacagatccttactatctgtcgagcaatctttgtgtagttgctgcactgatggagaaaggaactttagtcccggttgtgcaaccgggacacatgatccgagactaaagatgtctaacagggactaaatatgcataccaagttaaaaaaatgtgtgggatgtgagatttaaactcaagatctctcacctcagccctcacgcacgttaccattccacctgctacacactaaagatcgattttttttttatcccgggactaaagatactccatctagcatcaacccggacttaaaaatcaatttttttcctggggctaaagatcatcttttagtctcggttgatatcaccaatcgggctttaaaaattgatctttagtctcgggtggtagatcgttgggggcctgacagctgttgaacctttctattcgaaccaagacaaatatgatcttttggcatccgagtaatgatcagttctccagtaatgtagtcttgcttcatggcagtaatgttttggactggaaaaatgtatgatcccaccatatcctatgtaaaaataaggtatcattgccacaatgcttaagacaagaatatatatgaagatgggttacacatctagatgtaaaattcctaatttaagattaggcccaccataccctataaccactctcaccatatctggtgttggtgtgcatgtgtggccttatgatccattttatggcacattatagatgctctcacccactgactctttaagtagtggatccactactttaaggcattagaggtcagggctaagggcaatggtgctaaccttctcgttaactcagtgtgtcacctcaaatctcatttgccatcgcggtggggtaagtggtgttgtggatagcggcggtgtggattgctataacgtgttagacctctgcgctagaatggatggtgctaaaatcagggcttattttttaaaacatttaacgggtctaatcttacaataatatgtttttataagggtaaatggtcagattttcggtagttcaatattatcgatcatgaacaggataattttagccaacatttactaatattactgtactctcgtcgtgtcataattgtaggaactcgagatgatatttggctgtaagtttcacatttacttatacgcgattcggtcaaacatttaaacttcaaatgtttcaaaattagaaccaaatttagtctaaatgccaaatgtttataactggtgctatacccgtctcaaaattataaaatataacaatttttagttcacttgtccgtattcatagctaaaaattacaactaaaattttagggtggaggtacaatagtatttatatgttctctccttctcatggaactgatttgtgatgctaatcaactgtgcacaaatgtgatttgtggtcttaggccccgttcgtttttattaggatataaattttaccagtatgttttttaaactgttaaatggtgtatttcgtaaaaaaaacttaatt

SEQ ID NO: 92403 - DNA, 8854 bp, Oryza sativa
tcaaacatttaaacttcaaatgtttcaaaattagaaccaaatttagtctaaatgccaaatgtttataactggtgctatacccgtctcaaaattataaaatataacaatttttagttcacttgtccgtattcatagctaaaaattacaactaaaattttagggtggaggtacaatagtatttatatgttctctccttctcatggaactgatttgtgatgctaatcaactgtgcacaaatgtgatttgtggtcttaggccccgttcgtttttattaggatataaattttaccagtatgttttttaaactgttaaatggtgtatttcgtaaaaaaaacttaattaatcattggtttggctttgttgttttaggtattcgtacctaggccctgtttagttccaaagtttttttttccaaactttcaattttccattacatcaaatcttttatacacacataacttttctatcacatcgtaccaatttcaaccaaatttccaaatttcagcatgaactaaacatagccctagtctttttcttcatcattatctaacggggccttattacgaagtactaggactgtcaaatatcgtgcactttattattttcaaagattttctcgatgcacccttttctgccaaaattgtttcaagtcagtcaagatggtgaccagttattacctacgtggcatcacatcgtgctcttatgtggcatctcctgttctagctagcaaacagttggatatgcatgcatgttgcaaatttcaactgagcgccgacgtgttcacggtgcaaaccagatgcacaaaacttaatatcagacgccaagaaagatatgccaaaaagcgcaagagatttcttgtctgaatctgacgtgcacttcggatttaactaattaattagattttgttcttttatttttgctagctagtacatttctcctttggctgaccacttaattgatactatttgggtaaaagtttccttgcttgaatttaatattaattgtctcgatctatcattctgacatcgactctttgagccaatgtcatacatccaatctcctttcaggaattccttcaatatttgattctctattctttaaaaaaaatgtgcatacagttaagaaatcgatatctccgggtcaaagcttcagcaagcgaacaagctaagggctctttttaaccataggaatgaaaaaaaaggagaaataggaaaaacataatattctgataggaatgtaagggtaaaacagaggattacaaaatacagaaaaaacatagaaatgatcgtttgattggaccatagggaaacacaggaatcggataagagagatagactcaaaggatttttaccaagaggttggacctcttactaagtttcctccaaaacctatacgcaaaaagtcattccatcagaattttgtaggatttggaaaactttaatcctttgaatcaaagggccgtataggaaaattttctataggatttcaatcctatgaaatcctatgaaattccttcataatttctttgattgaaagggccctaaggtagtatgccctggacaaacctgatgtgccttgttcaggtagaatcaatttctgttttctcagaagagtgtactgtaattgtaatttgcgcaagcccaaactccataacagtgtttatgctttactgcagcagtacaattagtaatttgagtgctttcacatggtctctaccgacagtactgtactactcgtaaaaacgaccttaaacattgattcatgtattctactatatgtggaataatgatacttcaagtaaatcatgttgcgagctttgcaattatttttaaactcagttttgctcgtcgcaataattgccttaagaacaaatagtgaatttagacttggacgataagtgatgcagaaatggtgttagttgtgcactgatagcaggagtgttcgcctgagtcgattaagaaccgaactttgtgtcacccactattgtttaccgtacatccacatgtgctagttatgggatagacttagttgattaagttatttagggtctaaccttatattttggtaggccggagtagtatgaattagttttagtggtgattaagaggagctaactatttgcccgctaagggtaatccaggcaactatgtttatccaatataatggtatagtccctcatggggaaacatatgtgtttgacgtcatatcgttaggtttaaggcgtgggccagccacctaatagctctaggtcattcacacttgtcgttccagtgcaaagctaggctttgagtaatgtaaaggttacgttgtaacttctagaccgcattcaacacgtagagtgttgtggtaccaatgggtaccggacaaattagagtactcacattatgtagttaacgttgtacaaactttgtaaagtgtaaaactgttaacaaccaaatttggtaattcaagtatcggagatgaagataaaaccgaagcggaatccaagacggagatcgttctggaaacagagcaagaatcagttaaagtccgaatcagctaagatcagaatcggcagagttcgagtcggacaaggttagccgattaagccgattctgacaatatgactcgatatatgacatcgggttaggttaaagtgctaaattcacatggattgccatgcatagattgagttctgaaaaggcaattgtatctattaattaggatattttatgtaatttccttagagatatgttcgggaaaaagtctgccgtaaagacttatggtatcttagagtttgttatagataagagtcgtgtccgacatggacatattttgtaatctcgggtataaatagaccccgagccccatgtaatcaatataacacacgttcaataacaatctcggcgcatcgccacccatttacttttgtttactttcgacgagttcttgcttttaggttgagctgcatcagtttcgatcttcaactagaggtaaaacttgttatggcggcttgcgttctcgggattagtgcttccatctttatgatactctaatcttgtttatgtaattcgtcgagttatcatatattctatataatctctgacaatattgttatctaaccttcaatcggctaacatctaccattagaaggcagtcgattaggttaaatagcaatgttggcttagattatatagggtatctaccatcctatgaaacatccaatggcttgattgtctagatattgttcttctcttcatacttatagttgcatcagttgagtttgaccttataagtcgtgattagaacaatgatctctagcctgcttttggttgccgattagggtagtgtcgggatttcagccgatcttacctgatttagctttatattttatgtgcttaattgatatgctagatctgccctttatgttaagatcttaatacaacaaagtatgttaggcttctgtttgatatattttacttgctttaatatcttgatatagagtagtatcagagtattagccgatacatgctaggtctatctgatcggctatgttataagcatctataatcttattgttaatatatattttgatctaagtgatttatactatctcggcatggcgaccgatctatcccaatcacttgatttaagtatatatcgacataaggattatatactgttaatatctacagccgatcgaatagatttagttcttccttacttgttcatgattgccgatcgacttaaatatgacatcggctcaaagataagtgatacgtcatcggcggctggccgattggctatcatttatggatttaactgcggtttctttgtctttatttctcgttgattgcaggatcaaatcaactggcacgctcacgaacctaaaggcaagattttttggacatgcactggagttaagcagatctcccaggccttctgtttctcgcatcaacaaaaactaatcgattagccgtgctcatgtttatgcgcgacatagtgtgggtcattggcatagattttgtgttttataaatgcttttgaaagtgatatttaaaatgatgttgatgatgatacttgtgtatgattgacttgctgctgaggagggtagcaagcatgctacttgtattatgatgatgaatatgatggtaatatgtcactaatatgatgctataccatgataactatactaagtcttgcaaatgcttatttaaaattctgttgcaaaatgtttgtgaaattatttcagcttaatgcaattatgagaccataaatagccattccttggtatttagagcttgtatgtatttaggattgtattgccttgccagtacattaaacgtgttaatgtattgacacttgtttctttgtggtatattttagttgtgttgcaggtagttgagtgcagcgcgttccgttgatctcttcaggacggttcattagtggtctacccctagttggcttgcttatgggtctttggtagataaacttccgtgtgaaccactaattataaggccggtcgaccgtatgtttcttaaacttagactctaaattatcaattttttataactccttgtttatggatgccatttgttttgatgaaagtgccttggtatgttctatgcttatagaatatctagacatgagtgtggattgttgaacaacatagatattctagaacttagcaaattaagtcaagtctcctagtatgtgtaacacatctggttgccaccttcgaatggttaacgggcatgtctcagactgaagttgaccggcacgctaagttttactacctccgtcccaaaaatgtagctatttctagcatagtgccttgttccaaaatgaaactatttcttcacctacctcctctcaaccaatcacaaccattcttcttcacctactttctattttcaaccaatcacacacttcctccaatcattctcacatgctttcttaatacccgtgccaatcttaaaaataggtatattttgggacggaggaagtagaaatatctcttttgcttactatttagcactacatagattatattgaatggtgtttaattgtgatcatagggcacattgaggcttgagtgactattatgcatgtttggatcccactcacccaaaataatgtgatggtcgcattaaacattagactatatattttttgggtgctctacataacgacgctgtagatcccttgggttataaaaggaggggtcatgccactagaaaaagagattttcaggggaaaaaaggaaaccctaggtagaacagaaaccctagttcacttcacaagcttgtattgtacacttttgcatccacatagtctcaaacacgggagtagggtgttacgcttccgagcggcctgaagctatatactcgcttgtgttcatttttacattttcgcggtaaacaaactcgaactctgttcggcccctggctaaatctccaatggggggaggagggggggtcctttctgccctgttgtaggagtaccgatatccgatatatacttttgtggtactttgaaccaccccgactgtcttctcaagcatatgaacgacagtcctgtacgctggctcctattcatcaataaactccctatgttgtagactgtttcttcaacatatgacaaattggatgtacacaaataatagagttgaggatgatccaaagtgtcacaaaggtatactaacccagtccaaagtgaaaacattggttaaatggtggttcaaagctaaacaccggtaataaaatgttgtcgaaagtgaagtttactttaacctttttatatacacattgcatttattttgtttttccattactccatattgatttcattttagtttcatattctatagaagttatacacaacttagtgcaattagttatgacatgggctttggtttatacaaatcaaacacgtttatgcaccaaaacaaacaactgacaggtaaatgtacgtacctcgtaaaggtgtactgactatgcaatttacttgttcattaattttatttagctttaaaaatcaataagtagatgggcagctaaatattttgcatgcttaagtagatgtgtgaaaaatgattataacatatcattatatcaatacacccttaaaattgaaataaacaatgaaaataactaattagtgttattagctaaaaatcaatgattagatgagcaggtaaatattgtgtatgcataagtatatgtcgggaaaatgactcttaatacacgcctaaatccctaaataatatgatatgctgtatatttttctccaatttttctagcatgggctgtgctggagtccgcacgaaacgccttctgttgcaggccactaacgggctagcagcccacttcggaagatgtaggaataaattcactttgactcccttaaaagtggcccgaatttattccatgatcctaaaccgtaaaactattgaaaccggtacaatatatttgactaacttgttggttttggaggacgatttcgctgacgtggtgatgctgacgtggcagggttgacctactctatgggttgacatggcatttagttagcaattgaattaaaaacgtatatgtgaacctatttatcattcacacgcataaaaagttgtggggcccactgacatgtgagccccactgacatgtgggcccacctatcatcctctctctctttttcttcttcctcccatcttccttcctaccctctttctctccccttttctccccttcgaccggccgccgccgctcggcggccggtgggaactgaagcggcggcggcgatgggagctgagattagcggcggaaacaatggcgtgggcagcgccgggaagcatgggggaggtgaggatgccgaggaggaaccagttgaggctgagcagcgggacggtgttggaggaggagaaggtcggcctgccgccccggagcgcggcggcggactcgcggaggaagaagaagcgcgtgacactgcacatggacacgcccatcgtggcgaacagccccaccagcagcggcaggcacggcgcgtccgccgcccacgccaccgcccccaccaccgccgccatgcccaggctgaccaggctccgccgccgcgccaccgccttgccccgccgcatctgcacggacgtctcggaatcctactcctccatggtcacctccgtcgcgacgccaccgccccctcctcctcctgagcggcggcggcggcggcaacttcctctgcttcgtcttcccggtccttcctcttcctcgtgttcgacgggcgcgtggacgccggtaagctctcgccgccgtgtgccgtcgacggcggcttcttgtcccacatggacttgcccctttactcgttgagccgcatgttctccagcttgagaggcttcagctatggcgccgcaccacgcaacaagtagctcatcagttccccaccattgatgaacatctcaatgcttgacagttgacactactttacttacctgggtctcgaggagagtgatcctggcaaaggcgtcgtcgtgcttctcctccatctcgtcaagaatctcctccatggccttgctctccttgagcgccatgctcagtttctcctccagctccctattctcccacaccaacctctctatctacatctgcatctcccccaacagcccgtgcggtggcggctagccgaaggggagagaaagagagaagggaagaagaggggaggaagaagagagaggatgacaggtggggctcatatgttagtgggccccatattttttttttttgtgtgaatgacaaacgagtcccatcccacatatacgtttttaattcaaatgccaactaagcggcacgtcaactccacagtgtaggtcaatccgccacgtcagcgaaaccactctctaaaaccataaagggagtcaaattacacctgtttcaatagtttgggggtggagatatccggttttgcggtttaagatcatggattaggttcgggtcacatttaaggagtcaacgtggatttattccgaagatgtagcgcgtagcctcgataggccgaattcctgttccagcctaacaactatgggccccgcgcgggtcggccgcaatttcgtcctggcccatgtgaatttggccctgaaaatatctataatagaactgaggcccattgttgcgcgtgctgggctgaaaagaagaaatggagaaagttggaaaacatatcacgtatggaaaaagtccagtttgactcccttaattgtacaccgaatctaattcgtacccctcaaccagaaaaccggatagaacgactccccgaactattgaaaccggtacaatttgactccctcagcggtattggaggacggttttgctgacgtggcgctgacatgacggtgttgacccggttttcgtcccacgtggcgcttaagtggcattagaattaaaaaaaaattgtgggacccatctgtcattcatatcgtgggacccattgacatgtggggggcccacatgtcatcctttctctccaacccttcttcctcctccctctctctctaccttctctatcttttctctccttttttctcttccccatcggatggtagtgccggtgaaggacagggggcggcggtgccggcgtcggggacatggggacgcggtggggcgaggaggccgcggcggcgaggaaggcacgagggagcgactggggggaggcggcagcgaccggcgcgggcggggatgtcgcgcgccgggagggggggaagggggggcgcggtcgtagctgccggccgcatcagcggtggggacgacatgtcggggatacggggtcgcggtggggcgaggaggccgcggcaacgaggaaggcacgagggagcggctggggggaggtggcggtg

SEQ ID NO: 92404 - DNA, 2592 bp, Oryza sativa
cggacggaggaggtgcggggagggtttaaatagagcccggtcgagagagggtggccggggaagggaggaaaacggcgcgggaggtccggccgccatcaatggcgccggcgagatttgcgggggcaaatccgcaggtcttgaacgcgagagagagagggaaaaatggggggaaagggagaggggatcacggggagtgatttccccctctttattgcacgcggagacggcgggaggcggcgggattcacggcggcgacggcgctagggcgcgggcgaggcagcgggagcggcgggaggaaggggatgacgggtgggccccacccgtcagcgatggtggcgggcgggcccgcccgtaagcggcgcgcgcgcggggagaggccggatgggccgcagggagaggagagggagggggagggagatgagccgagccggcccaagagggagagggagggaaaggggactttttagagtttttctctttataaaatcattttaactttgtttatttcttaataattattatttgtgctctgaaaattccactaaaatttatttacgcattttaggcttttaggaaatatacaaaaatcccccaagccttatttgacttttaactttgcaccttttaattgttggaggctttcacacggattttaattattctaagcataatttagaggatgtattttagagtcgttttgggacgtgacaatctcgaccccgagattcggaagaactggcgaagagatcgggatgggctgtcttcaactcgtcctcacgttcccaagtagcttcttcctcggcgtggttgctccattgaaccttgcaaaaacggattacccagttcctggtcctgcgctccatgctgtccagaatcttcaccggcttctctacataggtcaagtcttcgcgaacttcaatttgctctgaatcggcctgctcggacggcactcgaagacatttcttgagttgcgacacatggaacacatcatgcacattgcccatggatgcgggcagcttcaactggtaagctacttctccacgtcgagcaatgatgcggaaaggacccacgaaccaaggtgcgagcttcccttttgtctgaaacctgtgtactcctcgcaatggcgtgacccgaaggtacacaaaatcgtccactacgaattccaggttacggcgtcagttatctgcataactcttctgccgggactgtgccacctttagattatcccgaatggttctgactttagcttcagcttctctcaggatatcggtccagaacacttggctttccccgacttggtcccacaacagtggtgtccggcatttgcggccatacaacgcttcatagggtgccatttgtatgctggcttggtagctgttattgtaggagaactcggcataggggagactcttatcccaggtcttcccaaaatctaggacacatgcgcgaagcatatcttcgaggatctggttcagacgctcggtctgtccaccggtttgcgggtgatacgcggtgctgaaatttaatcgggtatccaactcttcttggagtttcttccagaaatgagaggtgaattgacttcccctatcagatacaattttcttgggaacgccatgaagacttacgatcctagcgaagtagagttcagctagtttgttccctccataggtggtcttcacaggaataaaccgagctaccttggttagtcgatccacgactacccatatagaatcatatcctccctgggtttttggaagtccggtgataaaatccatcccaatttcatcccatttccattctggtacttgtagaggttggagaagtccggccggtcgttggtgctctgccttgacacgctggcacacatcacaaagggccacgaactctgcaatttcccgcttcatactaacccaccagtatttctctttcaagtccaagtacatcttcgtgctgccaggatggatggaatagggactttcgtgagcttcctgaagtatcagctgtttaagttccttgtcgtccggaacacatacacgatttccattccatagggtttcatgttcatcttctgtgaaaccagcggctttaccctgtttcatattcttgaggatcccatgcatatctggatcattcttcttagcctcgcggatttgatcgagcaaggtaggcttggcttcaagtgtagccaagaatccatggctaacgatgctttggttcagggcttccaactgttgattaagctccggtggaatgccacggacgccaagagtgttgcaacggctttttcgactcagcgcgtctgcgaccacattggccttaccagggtgatagtggattcccacatcataatccttgatgagctctaaccatcttctccgccgaagattcatcgagaacttctccaaaatcgcctaaaacgacccaaaacgaccctaaaatatatcctttaaattatgcctagaataattaaaatccgtgtgaaagcctccaaaaatgtgcaaataaattttagtggaattttcagagcacaaataataattgttaagaaataaacaaagttaaaaaggttttataaaaagaaaaaaccctaaa

SEQ ID NO: 92405 - DNA, 661 bp, Oryza sativa
tgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatgtaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctaaactgtaccgtgcgaaaccggtgctgtaggtcgcactgctccgaagctaggggcgctcgaaggcaaacgaggtcctgcgaggatggaacatcaagttacgacggggtgatgttttcgcacaaaaacagaaacaaaacttaagaaacctctgggctgagcagtaccgtgcgaaacaggtgccgtaggtcgaggtcctgctccgacggtagg

SEQ ID NO: 92406 - DNA, 693 bp, Oryza sativa
ctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccccctcaacaagcctacaaagtggtagaaggcctgccgcacgcaaccagtatagagcaaacttcaaacataagtacaacacaaagcaaagttgagttgaaatgtgaacatacgcgtaccaaggaacgtgacgggggtcgacacgcaaccactcgcgcgacgtgcgtggatggaaggtgccgagctgtgcaccctcgactgctgacaggaacgagcggtggttcctgtcaatcccacggttcaacagcgccggtgtgtcgtacgccatacctgcatcaaatagattgatcagaaacatataaataattgggctgcaggaat

SEQ ID NO: 92407 - DNA, 2222 bp, Oryza sativa
ccttggaagatttattttgatggttcttcttgcaaagagggtcaaggcataggggtagttttgatttcacctaatggcatgtgttatgaggcatcggttcgtttggaatattattgcacaaataatcaagccgaatacaatgctttattgttcggcttacaagtgatggagatggttggagctaaatatgtggaggcctttggtgattcggaattggtggtgcaacaagttgccgggatctacaagtgcttggatggatcactaaataggtacctcgattcatgtttagatattattgccaattttgataattttgctattagacatattgctaggtgtgataattctagagcaaatgacttggcacaacaagcatctggctataatgtgaaaaatggattatttctaatattagaagaaccggtgcttgattttaaatttttgtgcgaaattggcaaaactggagaccagaggcggtctgaccggcgttgcacggccggtctgaccggtgaccaagggcggtctgaccggccgaatgccgccggtctgaccggcgaccacgagcggtctgaccggccctgtgtggccggtctgactggttctgggcagaatgctggggggtacacttcaatcgatttagaggccgagttaattgaaaattcggacatttgtgcccaggatacagaagaggattggagaattcctttgattcaatatctaaaagatcccacacttaaggttgatcaaaaaattcggcggcaagcattcaaatatacattgcttgatggagatttgtatcgccgaaacatagatggtgtcttgttgaagtgcttagatgaagatcaatctaaagtggctatgggggaggtgcatgaaggaatttgtgaaactcatcaatcggcccacaagatgaattggttacttagaagagcggggttctattggccgaagatgattgatgattgcttcaaatattatagaggatgcgaggcttgtcaacggttcggcaatgttcaattggcgcccgccgccgtgttgaaccctataatcaaaccatggccgttccgaggatgggctttggatttcattggtcaaatttatccttcatcatcaaaggggcatagattcgtgctagttgctatggataacttcaccaagtgggccgaagccgtgcctttgaagaatatgactcatacggaggtaattgactttattttgaagcatattattcatagattcggtattccgcaaacattgactacagaccaaggtgcttcttttatgtctaaggaagtgaagagttttaccgaatcttatggtattaaattgttgagttcttctccttactacgctcaggctaatggtcaagccgagtcgagtaataagacattgctaaagctagtgaagaagaagattgaggaacacccgaagaggtggcatgaggtgctttccgaagcattgtgggcgcatagaatatctaaacatggtgccactaaagtcactccttgtgagttggtttatggtcaagaagccgttttaccggtggaggtaaatcttggttctcttcgttatatcaagcaagatgatttgtcaactgaagattacaagacgttgatgggagacaatcttgatgaagtcatcgacaagcgcttaaaggcattggaagagatagagaaagagaataagagggtggccaaggcgtacaacaagagggtgaaagcaaaattgtttcaagttggagacttggtttggaagacaattttacctttgggtactcgatccaaggagttcggtaagtgatctcctagttgggaaggtccttatcgaatatgcggcattgttcgagggaacgcatattttttggagacacttcaaggggagcgttttcagcgagcaatcaacgggaaataattgaagaaatacttcccgagcgtttggcaagatgcttaggaggtactatggccggtaattggattatcgtcctaagatcaaaaacatgctctatgcttttagattcacgttgttcatcaaaaaggcaggggggcatgtgtttgcacccaaatttggtatctaggattagaataggaaagattgccaaaatttggaaatctaccggtttcctccgagtgggccggtctgaccgccatgtgtggggaggtcagacccgccgttgtaagccggtcagacccgtggtgtgtggccggtctgaacggcgggtccga

SEQ ID NO: 92408 - DNA, 2414 bp, Oryza sativa
cttacaacaacttgagcggtccacttccaccgaacattggatccttgagtaaccttgaaagcctgtaagcacaaaattaaatgtttatgttagctcattgttggttgattaattcataacaaagtctgaagctggattattcaaaagtcataaactgatcatttgattagaacaaagattccatatcatgattttaatataatatcaattttaatttcattaatgaatcgcttctctcactttctcttgtgcatgacaggagcgttgttggctgccaattttctggtgacataccaaaagaactcagccaactcccaaagctgcggttcctgtaaagatctcaatgacttggaaaatattgttaatgatctcatatacctgcgtcattttttttatgttaataagaagttgtgacggtaaaaagttgtgacggtaaatgaagacagtagtttagacttagttgaaatttcaatttgaaaacccttcttttttcacattgacttatttgttagctcgaaaccatttccatttcattccaggtaaaacagaaaatagtttttatctgttttgggggatataacaaacaaaaggaaatgctaactgagtatcaactttgtattatttcttatagtatcatggtataagagttgatggattgtattgctgcaggtccttgaacaacaacaggtttactggaagtatacctccatcaattggcaacctttcaaatatgtactggcttgacttgggtgaaaatcgtctgactggatcacttccagtatctgatggaaccaatactggattggacaatttgacaaacgctctgcatttgtgagtacctttcttaaaatatctaccaggctttcagttcactggcttccattctaaggaaaatgttcggactgctctttattcagtcattttggggtcaaccagctatcaggcaccataccaagccagctattcaaatcaaatatgaagctcatacatctgtaaggcaaagataaccttagataatatttgcaaactgtttcattacttttaatctgttatgtcatgctcaagattacccattgttcttgtcattcaggttgcttgataacaacaatttcactggcggcattcctcccacattgacccttttaactaaacttgaagtcctgtaagtgcatactttttctgagcaggcttataaccagctttcttctaactgagtgaccattcagtatataatccatacaactcaatatgcacaggcgtctcgacagaaattaccaactgactggacctgttcctgccagcatcaatagcctcacaaaactacaagaattgtaattttctggttactctgaatctctgatcagtatttgaatgtgctagccttcaattctaacaaataaccaaccttattctttgtcaggcatctagaaaacaataaattgacaggccctctgccagacttgacaggaatggattcactatatgttgtgtaagtgccgaacacactgtggtacactctactgaaattttatcataggaaacccttgtatctggcatattgaacttttggttcatttggccagtaagtacaactaatctgacaacacatttgcagctccatgggcaacaacaacttcagttcatccaatgttccaacctggttcacagctttgtcagccttgacttcactgtaattcttctctgcacactttttgtagaacacaaggatgcaattttttttacactcgctttcaaatctcggtaaatgcacaggaaccttgagaacctacacatcactggggagcttccgcagcctcttttcaaactcccggctatccagacactgtgagtggaattagtgttatctttgctcataatatgtggttacaagaactatgcactcaatgaacaaaaaaaaaagagtaaaggaaattgaacatgtcagtgctaactagcaaggtaaactggtggtggcaggggtcttaagggcaataatttcaacggcacactaaccatcggatcagactacagcagcacgctctcactgattgatttgcaggacaaccagatcaccactctcgccgtgagcggggctcagtacaacaagaaactcatgtaagatccatcaaatataccaagagaaattttacggtcctttaaaaagaacttcgaggtacctaaatttacactaaagattttggaacctcgagttacctagtacctggaggtatcaagttttacaccagaaaatgtgatacctcctggtaccttctcaaggatgataaaattacccaatataccaattcttcagtatgtaggcgctcttatatatgctttcattcacactcccatgtttctcttctcatcacagacttgttgggaacccaatctgtgttcaggggggctgcaggaat

SEQ ID NO: 92409 - DNA, 624 bp, Oryza sativa
aggcgaaggcgaaggcccatggctgccggcgacgaggaaggaaagctcgggcttgaaggaaagaggccgatccgaatcgaactcgattccacgaacttccaaaacgaattagccgatgattccaaaggagaaaaggtagaggagatcccggagagtgtttcccctctattgatttggccggaaacggaaaggggcggccagattggaaggaaacagcggcggtggctcggcggcggcgcgctagggtttcggcccgaggaagacgacgggcctgacaggtgggacccacctgtcagcgtccaaacgcgcgcgcgcgcgggcggctgcggactgggccgacttgggccggggagagagagagaaggttttgggccgactttcggcccaaagccaaaagaagactttttaaaaactttttcaatttaaattatttcttaaatgcaattccatttattaaaaatactttcttagctcaaataaatcccagaaaaatctaggaattatagaattaagcaaagtatttaatgaaattttatctggccccattttatattggaatttattaattaaaattagattttcttttcaagacttttaaaataaattctagaaattccatttaaa

SEQ ID NO: 92410 - DNA, 2183 bp, Oryza sativa
ccgaatcgaactcgttttgttttatctctaaaaaacgagtccgagttcttcccgattcgattcctctcgtttgcgacttgatctcttcgattcgagctcatataaaccttccccgtgatctcctctttcgtttgccccctttcctgagtcctcccgtgcctcctagcgccgtcgcgacgagctccaagtccgccgccgccgccggccatcttcggcatcgtcgcgccgccgtctccgtcgtcgctgtcggtcgccgtcaccaccgttaggtgcgccgtgaggagaagaagctcggccgcccctccgtttttgccgttgaccaccggagcgccgccgtcgccgctaacccgagccgccgccgccttcttcttcgtcgccggccgccgtcgtgcatcattttgggtcggggtgagtaccaatgggttcgcctcgttgccctctacgcgtaggtggtctccgtttccgccgccgatgtccctagcgccggcgagctcgtcgtcccgaaagctcggaacagctcctgcggtcggtggagtcgaaagcgtcctcctgctcgtcaccaggtccctctgagcgactcctggagcctggcagatacgtctcgccgctgcctgactgcgagccactggagctgctgctgctgagatcgctgctgccactgggagtagcagacaaccaacccccggtgccactggctggacctctggcggctgacgctggagcgaaggagagagcggacgcgggagctggagctggagctggagctggagctgcaggaactgcgggcagaactggaggtgctgcgggagctgctgctggaggtgggtttctgggcgcaagctggatgcgcacgggtgccgtcgtcgtcttgcggggcgtggtgcggatccggactcctcctggcgctggaagaccctttagctgagcgttctccttcttcaggcgcgctatctcgtccttcaaagcgacgatcctcatgagcttcccatcgttcaaggccttggtcgccttgtgcaggtccgagtgcatcctgtccaatcccctcatcacagcacacatgtgaccgaaggtggtgtcgttctcgccagctgtcggacggaaggagctgacgccatcaccgttggctcgactggggtggtagcggtacgccgtgtcgtggaagatgtagttgtggcgctcccgtagtctggccatcatcaagtaggctgcctcctgacaggcgtgatctgctgtgcctccagatgcctcgaccgccatgttggcgaggcaagtccccacgtaaccatggacctccaagcggacacggtgaggaagctcgccactgagcggtggaatggtcgtgtactccggcgcgtcggggtagcccaccaccagtgtcatgcgtgccaactctgccacgaaatcgatcatgccttctccgcggtggttgggtgggtgaccggccatctagagaagacaaaggagtaggatcaatgcatgctcaaatccaaatttaaataaagcaataaaagactcaaataagggaatcaaataagagcagaattttatgcatagatcattttacatgagagcgaataaataagacagactcacataacgataaaataatgagaaattagatacataataataataacgaacaaagcataaataccttgcaacccatgttacagagctaggacctaatgcattgcacccatcaaaccccaactaactgacgaataaatcccaataattttactaaaaccctagactgactcgttttgaaaaatctcacttaaacgagcgaccaagatttttcccttgaaccacaagaacagatccccattttcccggaacaaaaccaattgcaaagaacatatgcaatgacaaggattcagagggctcttaggtttttccatttggcttgtcctacggtcaaggtcggctctgataccaacttgtcacgcccagaaattcccgaatagaattccaagcagaatgtgcaataaaatccccgtccaggaccagccggggtacacaaacgacaatgttgacatacagatccacgtcttacaaacatcataaagttttacataaatgcagcggaaggaaagaaagacaacaggagctaagccttgactaaactgcagcgggaacaccactccacaggcatcctcgacggcaaggacgaagcctactcc

SEQ ID NO: 92411 - DNA, 2361 bp, Oryza sativa
gatgttcatgttcatgtctccttctgtatgtactgttttttgcgatctgccgtttcgatcctcccgaattgactagtgggtaggcctggcggccgcctggccgtcgacatttaggtgacactatagaaggatccgcggaattcagtattattcgggtttaccttcaaattattctactccttctttgttaatttaagaggggtaagggttggtggatggatatacttcaagcctggatcatcaaatattctatgcatttatagccatcacattaccatcagcgatgtagtcatagatccgtgcctcttgttctactgtatctgatcctacggctatcaggtactgatagacgaagagtgttggagccaggaatatcatggtttgttcgccatcgcctctaggtcgcctcactagatgatctagcccacctatgggatctgtggctgtagtttcagtcggaatacctgttcaatgaacattggaaagtggcaattacaggcattactataccaatgaatcatgcaacatttacaccttcgtacaataggtgccgatagcctcaacaaaatgtcatacaatgaaactcctagatcctttttatttcattttaaaatggggctatatgtacataagtaaaattggtccatgccatttccaatggcaaatacatgtatcccaagtttattatgagtagttccaaaagcacacagagtgtaagagcacctcaacacacgattacacacatacatgtatacgtaaataggtacgtaattaactttccgtatacactgttctttgtggggctaattcatactacatgtacattatttcaggtcctgtaaaaagaacagaccatcccgatacatacatttatgaaaaaattaaatgttagtccttttgcgtattggaaacaaatgggaaagttgtccgccactaaatcacatagacactatcaattttgtctatataaagagcccacacctatagttatcgcaactttcacaaatagtaactttcttctttttttgtccggttttattcgaactttctgtatttgtatgcttctctgattgttctggtttattctagaaaagtttgttattaaggttggattttcattatgcagatctgcaatcgaccaacaagcgccctttacatgtacgtacacaactcacgttttctgcataaatcaggagtttcttgacaccactttttttagaggagaatgcctaaccaaataattggctaggtataggaatatatactctggcttgcgtgcccttcctaacaggggcggcgatttcttttcatgaccgcctaccggtcaaaagttgtttaaaaatgcattttggcgagatccccattggttgacgtgtttgtttgttagtttgatttaatttctgcgttcaaaaagataaaaattcaaactaaaagtacaaacattcgaacaataacaaatacaatgaataaaatgtttacaaaagtaattaaacagaaaatcatgtacaattgtatcatacaataaacatgtacgaagcatacaaataagataagaaatttatagttaatatttttcaataaattagagaggcaatttagaacgcaggagactaccatcgtgagcggttaggctggaggtggatggcggcctcataaaaaagagaaagaattggcgacataattctcttgggaaaactgagtgatcaagtgggtgcagtgcaagtgcaggtgcagaaagcagtttcttgataaagaataaaataagtaacggttttattataccaatttgaagagggggagcatatgattgtattgtttgtcgtttaagtaaagcttatagggagtagattgttaaagaagactttatgttgtcaggaaaattattccaaatgtccaggtcagaatgtttaacagatttgcgtgttattgataatttgggatttgtaagatggaagtttccagatgagcgagtagggtacgaatgaacagaactattaaacctaaacatgttatcaaaggatggtggaagttaattattgatgtacttaaacataatgacttctacttgaatagtgttcaaatcgaaaatgtttggtgttttaagtttatagaataaatgatcagtgtgagctaagaaatgcgaacctgtacaaatacgtatggctttcttttgcagtttaaaaatagaattaatttttgtcgaaccacaatttgcccatacaatattacaatatgttatataagggagaactagcgtattatatagtaggactaaggttgcatgtggtagaagaaactttagcttggagattattccaatacttttggaaatgcacattttaacgtggtgtaaatgatcat

SEQ ID NO: 92412 - DNA, 2984 bp, Oryza sativa
attttgctccctccccctttcaattactagtattactgcactattaacgatgtagtccaatttttttggcatagttggtaaatgttacagttttgtatttgttatatttctttcccggtgtacatgtatctagttggtttaataagaaaaaaaactgataatcttttttttttctatttcagaaataaaatctttacaaaactgttctggttagcattctttaaatatttattgtacaaatcacaaaaacatgtttcgctctttatgtaaggggttccatgtccctatactgtattcaaaatatgagcttcaaaatgcggcacttctacaaaatagatatcaaggtaaatatataaccagcaaatatatagtaaaatgacttgttgagtacactagtcgattaatgcttacaagcttacatagaacagggtgcaccaagcggaaccaaagtcggaattttgttccatatgcgccattttatgttatcctttgttttcttcatacaccttaaaggtactatgtcccatttgcaggccccaaaaatgaaaaggttaaattccaacgtcatttgaaagataatactaatttagaacttccctttaaaaaaaaggggggcgggcttgaacattctttaagtgggaaaataacgacgattagttgtcgaatcgacttaagtactgcaaagtcagtaagtaatagtctgattgttcagaccattgtaccgaatggtcgtacgttttgtgctgcgcaaagattcaatcagtttaattcgggccattacaagaagtgggttattgatgtagacaaatgctcatgtacccattacagatcattgtatgtatgctattagcgaagaagaaaagccagtcagtcactcaatagtgtctgacagtgaagtctagcaagtaatcggatttccttgcataacttatattaggactggtaaagtagtttaggtcgatcttatacattctagctatacccaacaaattgttgtaggtgattggtacacttttctccttcggaaaataggtccagaaacaattaatctatgagatatttatacagctaacaaaatatgttgtaagacatgatatttatttgcaaaaatgatgacttgaagcgattcaaaattaaacctgtgatttcttacaaatgtactttaccttgggcaaagctgttattaggggacggtgttgtgacatcatcactgaacatcactctcccaggattcaggatcacagatctacctttcctcttcataaccccttgaggctattcacaaagaacaacgaaaaaattgtaaccgcaaactcagccagaagattaccaactgtgcggagctaccacccatggtgatctgccaaatatcacaatgactgtgtacgtttataaatcatcaaaaacatatttatacatggaatagtaccggtacatgaagtcgtagtgctcatcctccctcccctcaaacaaaaaggaaaaagaagagagaaaatgtaatatttatgataataaaaactccaaaggtttggattgggtttataaactttaaatttaaagtcctcataaagagcctgtggaaaaagagcaagattatctgcaaaccctgagccaatagtgatggcacccctacaaagtacatttatatcattcaatgccagaaagttttaagacaggaatatacatctaagcatcaacatccttaaattaacaacatattgaacgattcattatcactgtttccgcatctcttacaagacattatccagtaacaaattaatcaacaagtcaacttccaatattagtgaaaacccaaacttcaatcaggaaccaaactctattaaagctagaggatatgtaaccttaaccctaaccctatagtttgcaaaacccaatggcaactccatctctaagaacccttttattttttttccctatttcagaccaccataatttatcgtatagctatacgacaaatacttaaatttgtcctagtcttgacatcttaaagggatagctgagttttgatatagagggcgctacacacaattattttgttgtgagataatgaaaacttgagtgtaaaagcatacaatcgaaataacaaaaccctctatgtttgatcacaaacggttcaaagacggctgaaatatccgtaaatataaccatttgtggggcgccacaaatattcgataattttgaaccagccgttcaaaaaacgaaatggcatcttttacgtttgattccagccgatgcctattttggcgttttgttggctttttcgtgttggttataataaccagctggcccgtgttttgttattattaactaattaattaattaacggtcatctaatttttttaaagtaaagctgaatgggtatgatcagatttaatctaaatttcacgtattttggggtctaaaattaccttcaaagccatttcaggtcctaaaagggctctagaaatgtccgaaataagaataagagcaataaccatgcactttgaaggcatttgcggtctgaagcaaaaactcaactatcactttaaaagaaatgtcgtataaccaaacgttgtatggtgatatgcctgttcgagtatcgtttcggacgaaaacccaataaagaatcaggatcctaccttggtctaaatggtcggccttctcttagaattgtcacacaatatttctctgtgatattatgatgttattttcttgtctgtatggtcttgccgctctacgatgatactgtaccattttacgagtttcgtttcaatttcatatatagtttgaacaatgttatttgacaaaatgaacctggggcaattgtgacaggatgaaacacatttttcaatcaatatcatacatgtaaatatttctaaaagtataaattggtaccacgacgagaagagttttcctgacgatgtcccgcttattcacaaaatgaacctggggcaattgtgacaggatgaaacacatttttcaat

SEQ ID NO: 92413 - DNA, 2083 bp, Oryza sativa
acataatcatatcactagcaagtacaagcttaagatatgccaaaatgcatgaagttgcaaatgacaatatgcacactgagatgtgcattaaacagtttgcctacgcttttatatcatgatatgtcattcaatgcaaatgacggccccatgactgtgtgattcttggcatgttgattgggttcgtttcttacatgttttttatcaactttatattcacattgtcgacctgttttataaaacaaataaatgtacatctttttaagctcatgtattagcaatatgtacggcactcggttgaatcacaatgaaccagacaatgaactcgacaagtcttggtcaatatctaattgtaacttgacctgcgtgcataattctcaaaaatgaattatttgtgtactaatgtatcatgtaaacgataagggaatgaacattaagtgctaaacaatgcacaaacctcaaaacccctgataccatagttgaaaatagtggcgatgacttgcgtctgttcgagcctgacaactgagtagggaaggtggagctggatgaagaaatcctggaacacactcaccgtggtttcagaaatacacattccttgagtaggtgaaaaactgacagctgtcaaatgccaatccgtgatactacttgaggtggagatcgggtataagtacggactaccatcttcactggaaatgagaatttaaaataaaaatgagaaaactagatggatgttcaactgcacgcaatcgaaaatgatgcctccgccataaagcgattttacaaaccaaaacagaagcaatcttaaaattcaagtttgattgtaatccattaacaggttctcagaatatcgtgattaaaagctatttttcacatacacgtatgaccctttgaactttgacctcatgaccctaaaatctaatcagttcattggctctgatagatgcatacatgtcccgagtttgatagtaatccattcatctgtattaacaatgcgttcacaagctatttttgcatacataatgagccccatgacaattgaccgttgacctcatgaccccaaactctaatcagttcattggctctgcaagatacatacacgacccacgtttgacgctaatccatcaatcggttcttgagataacgcaatcccgagctatttttgcatacataataagccctgtggcctttagaccttgtgacccaaaaatgtatcagttcattggctctgcaagatacatacatgatccaagtttggcggtaatccatcaatcggttcttgagataacgcgatcacgagaacgggacgacatacgtacgtacgtacggacggacggacaaccagaaaacataatgcctccggctgctttgtagcggaggcataaaaaagccataggcttcactgagaacaatgaacttccaggttgcatgctcgatatctggaaggagacactaggggaagacacatgagcatctggttccatccaggcagatgctgaagaacgtaagcagagatgccaaccttcatcataaaacaaaaaccagtattttgggacaaaaaaaacagtatttttgaaaaaaatatctcaccttaacatattgcccaatcgagaagctttaaaaaattaacggcagtaccacgtaccgcaaatctccgcgtataagacgcacctctgttttgggggccacgagaaaaaaaaatcagtttttttttcgccgactttgtcggcagcaagccaagtccaaggactttcatttaactacgaggtgcagttgaaggcgcccatttttgcttgtgaactcgttacaaataatattaacaatgtcgtttttaaaagaatgtgtattaaagatcattaatgtaaattatatacagtagagtacctaggatagaaccttgtggtacgccgtgtgtaatagaaaaaaaggggaggaattattattataaactacatattgagatccgtctattagaaagattactttcaaaccaagataacagacaaatttgagtgttgttctagtttccgactggtgagtcaacaaaccgattactgagctgggagacattgccaggtgaaagggcata

SEQ ID NO: 92414 - DNA, 683 bp, Oryza sativa
tcgtcaccgattggaagcaacccaagacagttactcaagtccgcagtttcttaggtttggcaggatactaccggagattcatcgagaacttctccaaaatcgctcgacccatgacacagttgttgaagaaagaagagaaatttgtgtggagcccgcaatgcgagaaggcgttccagactctcaaagaaaagctggtttcctcgccggtgttaatcttgccggatactcgcaaggatttcatggtgtactgtgatgcttcgcgccaaggattcgggtgcgtgctcatgcaggatggtcatgtggtggcctatgcctcacgccagctacggcctcatgaaggcaactatcctacccatgatttggagttagccgcggtggtgcatgctctaaaaatctggcggcactatctcattgggaatcgctgtgaaatatatactgatcataagagtttgaaatacatcttcactcagtcggacctgaatcttcggcaaaggagatggttagaactcatcaaggattatgatgtgggaattcactatcatcctggtaaggccaacgtggttgccgacgctctaagtcggaaaagccattgcaacactcttaacgtccgtgacatcccacccgaacttaatcaacagatggaagccctgaacctaagcatagttggtcgtggattcttggct

SEQ ID NO: 92415 - DNA, 15503 bp, Oryza sativa
taggtaattatcagtatgttttatatgtcatgtatttcagcaatataattatgtgcaatattaactgccatgatgattggcaaagcgggtttttccattcattcgtattttgatattgcatgtacttttatcttcctctcactccctcattccttttttctattcgaacttgcttcttttcaaatttccttttctcttcttcagttctggtctttcctctttattctttatttcactcccattccctctctctcagctctatgtctgtctctctctctctctctgcctcttcctcttactcccttcatctcttcttcctcctctctgtttctctctctcactttctgtctctccctcctcttctccacctcattctcttctgatgatgttttacagtacaacattctttaattatctgctattcttactgtaaccaataatacctaaggaattccattgttctcatgtgcaatatgtttatacattatactgtactcatatcacgcttgtgattagcacactgccaagactccgattgtaatactatttaatactttttaatactttttaatactcaatattcaatattcaatactcaatacttaattacaatttttccaatgttacagttaattgaattcaagtatctgtatacattttatttgtttatatgtcaacatttattcatttttgccagcaatatttcatatcttgtatttttgttttaaatttttttttgttgttttgtttttttgttactactttaatgtttttaacttaaaaatgtattcattgttatatatttgtcctcatttactatgttatctttatgtttttgaatgttttttatattgatgtaaacttgcatttttagtcttcggacttgttgacaagtaatgaataaaaccttatttgaacttgaacttgaacttgaacttgaaccctatttgtctgaattcagtttcccctctctcgcgcgaatcgcggaagctttgacgtttctttaaactattagaggaagcagacgattcgttgtactgttcacgacttttaatccttatctgaattcagttttcctccgcccgcgcgaagcgcggaagcttagacgtttccttaaattattagagaaagaagacaattcgtcgtactgtattcgactcgtctaaatgaagttttccccacctgcgcggagcgcggaatttttggtgtttcatcaaaatattgagaaaggacgatgattcgtcgtataccgttattgactgttactttgattaaatttagtttccacgaaaatgttaaacctctgatttcttcagctgatattataggaaagtgaaacttcgaaaaaatacaagttgtagctgtagtcactctcgaagttgtcacagcggataaaaagtcacagttcgtagggaaaaaaaacttgtcggccgaccgacaatatacatctcaccgacttcaaacttctgcattgatattgtacacgaggatcgagcaagaataccgacacatgacccgacacagcaacatatttagccgtgtctttctactccctcgacgagacgactccacccaacaaccccctatctcaggctcttacctcccctctctcttctctcttttatcccctgtttctttgttttcccttttctcttttttgtttttgttcctttcctttcttttccttccttccctctcctccctcttttttttctctttctttcttctcttttctttcctttcctttcctttctttccttttcccccctttttttttcttccttttctttttttcttttctttccctttccctctctttgttcccctcccccttttcttttttttcccgacggcagcgcaattttaccgacaatatcctgacaggtgggggtgtcacatccccaacccccccccccttatggagatacccctgctgctacaactacacaaactcaacacaccttgacagtttttttcgtaatacaatatttcagaggtgtttttattttttatttgtagcccaccttttgacgaaaaagaatatttcgttaataatatttttaaaaaatcttgaaataccataattttggtgtcatacgaatgaaaactaaattatctacattttgatattaatttcaacgaaattgggattagttaacatcaacatttatatcaaaaatatgatttttttttttttttgtaatttttttcgaaatatttaattttatcaaaaaccgttattttccatatatcaaaatcgatgaggtgccttttttgtaacttttcagatatttgcccatgtacaaggacgatattctttgcgaaggtgatgctatctcatttcagtgaaaagttatattaacccaaacttattgatttgatttcgaaaaaaatgacatctttgcctattcgtatgcatatacgtgtattagtgtatcatgattgaggacgtgttactttggtgtgttaacatcaagatacattttaagttaaacctctaatcaacatggatttgtatcaaaagatggataattagaataccttaaagttaatatcaaattaatttggtttaatgtagtgtgcgaaatatacattttgagtaaaaaaggtgcttttttgtaggatatttttccccctaattttagccagtatctcggtatattaacgtactggacagtagtgattgtacattccgtagtacagaaagttcaaaggattcagagtgctgagggcaagtgataagtactttttttgaactttgtgctgttttaggaaatgtgggtattggcatttgccccccccccccccccaccctccccttccagccgcttgtcataaactaatacatgaccaagacacgttagtgcattaacatgaataaagtaatgcagacggtcaaaaccgggcgaaattcggggagcttctccgcccggcgtcccggcaaagaccgactgatctcccagcggggggtagtgagctctatatctttttctttggccctcgaaaatatgaacatttgcacccccccccctccttgagcgcaaggggagggaggggggggggcatctcccaaaaaaggtaaaattaacgcgtttttacacgttttttttcagggggggggggcctggatccgccactgtcctaaagcaactaaaaactatatttctatgtttgtcttcataagtgggagatatgaattgctatcaaattccgtgatatgtttctcaaagtcacatgatatattccagaataaaagaatacattattaataaattcggatatgagcagtgttaatatgcagaatgatgggtagtggataaatattattctactgtgagaaagtggatgaaaatatacaaaagagtttcaacattaaaaatgtggagtctttcattttttgtaatgattctagttacctgtatatttgcagatttgacattcatgaatgcgtaatttgtgtattcataatatatgaaaatgaacctatgcgcggcattttcaattatcttaacaataatgaaacgttatgaatttggaatgaaggaaacatttattcaatacatttcaagattcttaacaagtccaaaaacaaataggcctatgctgatttttctgtaaaatgcattttgcacatttgcaaattaggaaaaaacgaattatatcatcttgttccttacgtgaatatctacaaacatacaaattgcaaaaacactgcttatacagtatacagaaccaccctatccaagtttggtcaatacatgaacttatggaagaccctatttgggttttcaacacaaaattgcgctgttttaggcgggctttgaaataaagttgatgaacagtaaagtctagttgacatatgcttggtaaatggtggccgatttttgttttctcctttaaaaacaacaacaataatgcactataatcctatacatacatgcgcccactaacatgtatctgtgcatgtgttgtacgacaaacagatgtgacgagtagaacgttacgaaaaaaacacggttttgacctatactgcagtttaaaagcagtttatcaaacatgcatgtagaatgtaagtgcacttaaataaacttacaagaaagtggaggtctatgtcttcatttcctgttgttccaattctctgaaccaagaaatcagttgtcacatcaacctacatcatgaaaaaaagacaagtggaaattagctgatcctacatttgctcctaagtcttattttgtcacatgtgtagggctgcgggtagggctgcaattgggttttaggttaggttccagttagggtaagagttacaaggtatactggtagtgtttagtccttcaccatgccaaattgcttatgaattttattaccctaaactatgttgttatacccttgttacggtttcttttacacaatttgtttttatcagtgtgtatacaaatttgtaaaatatatttcatatttcatcaaagatagatatacaaacattcatgtatacagtcagggctggattcgctatgggttttctgttcagcatagggttatgaatgcaatacattttccgttaggtttagggttagcgacggggcttggttcagggccgatattcaattcaatacttatgtcaggaatgtgaatattttacacaattcttggcttggataaaatactttgacaactttggtattcagttcaagattttggctcagtattttaccctaaatttaagacagcttcctattacagacttaagctaataatttgtggaggccttgactggcagcgcaggcatatggttttcaaagcagtcttcataagctgtgagcaaatatatttgtgcagtttaatacgacgcatcaattatattgcgcatcattttggattttggatcagtaaagtattttaccctaaatttggcttactaaggtagctcagatgtgatctgaatacgagttaagacatggccaagtaaaatgctaagtaaaatactgtcttaatccacgtactaaattaaatagggcgccaggattgattttcagctcttataacttgctgatcacgctatctcttgtaatgagattttggtattggttggtctgcacctacctttctgctattgagtctcccatgaaacagacaaagtattaagcaagaagatattttggaaactcatttacgataaccacaataatattcaaagcttataagcacagagtgggtgaaacccagtaaaaaaatatattttctgacttacattcaggctacggtaatctgcatatcggggtctgatgaccaagtaatcattcccattggccgagtctgctagacttactccaaaggacatatcggcttggttgttcggatattgcggatcatgagttgatgcctaaaaaatgacacatgcataaaatatgatattacttctgtgaccacatccctttgtagaggtttctacaaatacacccccctaatatgctaaaaatgtccagaatgaaaatggaacaataaaaaagaaagagcataacatttccaaatgtttgcctatgatgttaattatgaagaacaatgtcaggcatcataaagacacaaataacaaaaaactggacatgtaaattactgactgaagttatatgtacctggttgacagtcattggactaatacacaagatgtccgtagaccttacgttcacatgagctcatgaaagaaggagccgtgcaaaaaggacctagctcccatcccctttgcaccaggaacataagatttattagacattagggcaatttaggggtgctgccccaaagtcccctacaggggacctggttggtggagacatgacagtcattggactaatcaaaaagggacctagctcccatcccattttccccaggatcatataagatttattggagcattaggacaattaatagggttgctacttcaaagtcccctgcaggggcaggtatcccattcaaacaaatataagtcttcttcacaaaaaagaatttctacattgtttagccagaatccataccaatattttggtatgaaatcatatctatattgcatgatctattatatgaaacaaattagatggatcttcgactgctcgcagtcgaaaatgatgcccccgcaatagagcgattttacaaacaagacggaagaaaaatttaaattcaagtttgattgtaatctaaaaaaggtatagaccagttttggaaacgcccccctctcaacaaatgaaacggaagctcttattgacatgacccaagtttggcaggaatccaccaatcggttcttgagataacacgatcacgggaacggaatgtacggagggatgtaccgtgccgtgacggaaggacggacggacaacccgtaaacattatgcctccggctacttggttgcggcataaaaatgaggctaaccttgggggcatatacccagtcttacagacgacggacaaaataagtcgcaatcattcacttgagccgttggctcaggtcaacttaaaagagaaagacctcagaccaaacctctcaaaaaaaatgaaaactcaagtttgatcgattatagctgtcttatcatggcattatcattgttttaaataatatcattagaaaatgtttttattcctctttaaaatgataccatatttgttatgattttgaagccatgaaataagcagtacatacgaataaaaggcagggtgaagagtgaaaagtttcaaaatgaactggtaaacactggtctagtattgtataacatacagagcactcttctttctttgacctaagagagtgttatttttgtatatgacagtggggctattatggttcccaactggtcatccatgaaagctaaattctaaagaatcaaaacttgaaattcatgccctatggtgaaatgtcaagcaagattttatactgtatagtcataaactttctgaagtatcatgcctaggttgacaactgttgaaaaaagcttgggttatggtataatttgaatgaacaagggcagtgcattttgtaacgttcacttttgaccttgcccttattttgatctactgcacattctatgacttaaagatcataaattgggttttatcttttgcatgcaagaatctttcacaaaatgtgtgaggcgctcggattcctgaaagtttcatgcgacataataattaggttgcaactggcacaatgttgaatttttgctaatcacaaagtgttgttccacaaaaatgccttttctttaaaaattgtcgttccacattttgtggtttagctcaataactttttattcaaatataaacaaatgcatgattagaaagagcaaacatttctgcacatactacgtccattttagtttcatgaccacgtagcatttgatgccaggaattttaaaaaggcaacacaaaactaaaaacttttaaggtttagaccagttttggaaacgcccccttctcaaaaaatgaagtggaaggtcttattaccaatcatgtgaaaaatgtgtttttactaatacgtaatgatacaaattttgccaggaaaccgcctacttattgatatatttggtaaattatcatatcgatttggactggatagatatcgagctcgggtatatagtcctatatacatctttctgtgtacaagtgcttgtaactttaccaagactgggctaaatttcttatcatccagaaccttgcagtacacacaaatacttatatgctagatgatcaacctcttctgatagtttccacaacgtttctttcacattgcaatcgcaccaccagaactggtctatacctttaaaattcgtaacttgacaacacattgaaggtttgaaattattttgttttaatgaaaactggccattatttttacttatcgataaagttcttacccatgtacatgaatattgtatttagccacattacataaattaatgagaaaaatgtagtgatgaaagaaaagaatcttgatgccaatttgaagaacaacatgtgaaccattaagccctctagcaaagggtcctgttctaaataagtttgttttctttgtcttcttaccacaatgttaatgctccttatacttgattggacaccaaaatccatactgactcctccttgatcatcagtgttggatctcaggtctacctgactaccatatatatcagtcctccgtagtggctcctctcgaccacctagaaatctggcagttgctatgacacttacaggaacatcggtggccacatctccatttgcaaatgttaaatccagctgcgaagaaaggagaagtaatttatggtacgaaaggtcccgggtttaattccccgacaggcctccaatattttaggttgggcgcttcaaaatttatttttaatcctctacctccctttttaacaatttaaccatgatgtctcaaacagaatgaacgtaaaaaaacagacaattgattaagtcatctactgcaattggcacatacatgtaggggcctggggtcgcttcacaaaactgtcatataagtacaagatcaactaaatctcgaccctgtcatcgacttgtctactaattgttttacaaaaccgtctttgccaagacgagcgacaacttccctaacaagagacttgttgcgactccaaacctgtcaaatcttgttagaacgccatctcatgtcaaaggggatagttgagttctgttgcagagggcgctacacaaaataatttttttgtgagataatgaaaaactgagtgtcaaatttgaaagaacataatattgaaattacaaaatcatctttgtttgatcaaaatcggttcagagatggctgaaatataccgatttctaatacttgtgtaccaccacaaatattagatattttgaaaaacttgaaaaaaccgttgaaaaaaacgaaataacgccttttacgtcgtatttcagccaatgccgatgttggctttttttgttggcatttttgtattgcttataatatccacaattagtcggctcgtgtaatgttattttcaattcaataattaattaacggtcaccatgttttttttaaaagtggagctgaattggtatgatcgtattggctgaatttcacacattttggggtctacaattacctttatagcaattttaggttctaaaagggcactataaatgtcatagataagaataagagccataaccatgcactttgaaggcatttgcggtctgaaaacagaactcaactatccctttaactttaaataagtctttgggcagcaaaaatatggagactgaaatctattttaaaacttctttctttatcttcgagctctcaatttattgaacagttcatattggtgttaatacaaaagcactaaacaagcataccgtgacaacttattcttatataaaaaaaaaagaatgactgtattcttcccatacatctttctaccatagcaaagtcgcgaaagatggaacattctgtaattatgaacccatgagaatgatgacaattgtcgtgtaggtacttctctcgatattttccctttacaagcataaccttgatacaaattcaatcgcataatttaattatttgataagaaaatgtaaaaactttgagtactaaaatgttatgttttcattattttgttaaatagatatagtaatagtggcttccaatctttaattttttttaaacagttttagtaaatctaagcctcataacaattttttgtgatatagaataaaattaatcgatcataatgaagattatattttttagccgatagtatcgaaatcatgaatttgtcggttatcatggatttgtgaaattggttgtccgcttcccgacatctctcaggtcgcagacctcctatattctaatgttctttgacaagacatttgtcactctccacccaggtgtgaaatgggtaccggtagaaaggaattccttcaatgctgtgagcactgaaattggtagccttgtagagccagagaaatattggagcgcattgagcaccttgggtggtgaatatatgtacactttaacaatattaaatattattattattattctgctgaaatttaaacaaagagggttagactgaggtgtaagttttactttgtcaaaagtgatctgagacccaggaaaaaatttaactaaattaatagaatacagaccaatgaattttaatctttattgagtttcttcttatcttacatttacttgcagattgagcccagccttgaagtactgcacagttcgctttctactgaatttgtatggtgagtcgacgaaaattgccttcgtgttgatgcttgcttcactgaactgagtcgctgattcgtgtacgattgcctttgcatggaaatggcgacctctgaaccgatcaaaccagtctggaccatcaaaatcattactgagatcatccaaagtaactacagcccttccagtatcaccaatctgatagaaagatgaataaaaagtgataatattggttatatcagatgcgacggttcaaattaaaataaagacccacgggccaaatgttacatgcgagaggacttgatgcggcctgccaaaaataccccaaaatacatgtaccacaaaaatgaatttgttgtttcgttcattttcattctacatgtataagtagatcttttttttacttgtcacaaatttgtcatagataatcctggatccaccactgcaatcacaaggctctctcccttctcccccttgtagattaatcttgtgaccttaacctagtgatagaggtaccattaaaccccccccccccgggggggggggggggtggggttggacaggggtgtgccgctcaagcctcaaaacccctacccattttcaagggtcattttggcagatttttctcgaaaaataggccattttccacaattcttttaaaaacacggacccaaaatgagacccatgtttaggggttttatggtgagaaatcgactcattagagcggcacatcactgtatgtctaaatatggcccccttccctgatgagaacactgaggagatcacatgggtgtgaggcagacccacaatgaacaagacaaatgcgactgcatctcctatatgcctccaatacaaaaaagattgataacagttttgtttaggttttgttttatacatttatgtgatacacaacaaatctaagcatttgtgacatatcacgatgaagaaaaaaatcctatattcatatgtcaactgacgattacgattaggtctatagcttgtagcccctaactgaaattggatcatcttcctatagtaattctgtcaccatgtttggagctcatacctcaagttcttgacatattatgataacaaggatactcagatattgacctctgtgacctatgaccttcgaccaatttactaaaaatccaatcagatcatcttcctagggtaataaatactaccatctagtttgagcttcatatctccagtggttcttgagatatcgaaataacaaggatgatatctagaatttcagatatttaccttgtgatctttaacctttgacctatcaagccaacgtcttgtcagatcatcttcctaaggtcatacatgttatcaccaagtaagagcctcatatctatatagtggttatatagattgtgtaataacgaggctaatttagccggaatttcagaagttgccctctctgaccttaaatctttgacctagttactccaaaatctaaccagattgttttcctatcatgatacatacaatcataaagttttaaggttatatctcaagtggttcttgagatatcgtgatagcgaaaatgcaggacggacaattgaccaaaccataatgccttcggaaccaccttcggtgggtggaggcacaacaacaacaaaattctcaataattcattgcattttgccccgacccccaacattaaaaaaaaaaatcccctatgtgggcatgacctgaaccataatgcatggccctacaaagaaatttttcctgttggggaccggggggcaatgcaatgaattattgataattaattgcatttgtcttgttggggaccgggggacaatgcaatgaattattgataattaattgcttttttttgggtgtatttgtgggggcgccgcacagtgggccagggaggaaccaaagtgcgccaaaactaagtttgggtgatttatttttttcaatttttttcttgcccagttgaaaggtaatacatagaggaatacctcagtgaaatatttaattccggtatgcacaataagggtataaatttactgcttcaaacagcaaaatcctacatattcacagttttagtgcaaaagtgacttattttataaatctttcaattaaacatgaagtttttaagttattgatatgaaattgctctcacatattcctgatagttcatttcgttgaatgaatgggttaaaattaatagaaacacaatcttcatgatatattatagggaaattcaatgaaaaatggactaattatccatgttttttaaaaatccagaagaaatgtttagatctctgcggtgtaccgcttaaattttaataccaccattttctctgatgtctaagcttcaagttgataccaaatttggctgcccaaacttgcccattgttatgttagagccgatttcccttgccacattgccccgaaaatgttggtttttggggtccgcggctgaatcatgaaggattcgtggtcataaatcacggcgcgagggggcgcgtgacacgtgatctgacaccgcggaccaaaataaacacatttttcggggcaatgttgcaaggaaaacggctctaacataataatgggcagaatcgggcagccaaatctggtatcaacttaaagacatcagagaaaatgttggtaataaaatttaagcggcaatccctggaaatctttatttataaaaaataaatccccaaacatgagttttggcgcactttggttcctccctggcccactgtgcggcgtaccctagcccccgctgcgtacattaatgattcagtggctaagcaatggcctcgctagtgtgagcccgaggatcaaaaccatgttgatgtgctatattagtgcccttttacgaggcattaatcctcattactgtcagttatgacttagctctaaggacgtaggtcccccagattagcatagtagcatacacatgctttagcagtcacgcaaaacaaacactcgcaaattatttttcagtaaaatctgagaatgtatactatcatctagaccaaaagcttcagtttctctatatcgtcggttgatccactgagactacgtctggctccactagacctccgattataatattgtattagggcatgtcaacaaatgtcagttatattattaaaataaatgacccaaatcagacggttatttctgtctaactattatctagatctattaggaataaatcattgtcaaagtcatttcataaattggggtaaaaataattattccaccattttgaccaacagtgtgtagatttatccttttgaaaaaaatcacaatccacttaccagaccttgcctctctcccagctcttgaacagtaccatcctggataacgccatacttaaaggtatagcggccaagcacaggcttgccaaatacgtacctacatagacagttcgaacaaatgatagtggtggtttaaagccatccaatggtatacaaatgatgcgcagatatgagtaggtcggaaaggaattttgagcacaagataactttgggcatggtttaaagccacccaacggtatacaaatgatgcgcaggtatgagtgggtcagtaggaattgtgtgcataagggaaaattgcgcatggtttaaacacacgagacgtagccgagtgtgttttacatcaccgcaaagttaccgttacctgcacaattctaccgaaccacaaaataaacctgcgcaatgcgcattgatatctgatttatagaatgggagtaaaaagagttatcgcccaatttagagaagaaaatataccagacgcatgaaagtgatttaccggaagcatgaaagtagttgagagtcacttctttattcaggaattgggtatttttttcatgcgtatgaaggtgaagaacggtcaaatgactaaattgccattcaactagtcaccagtattacactgtcttcatgaaatttaaaaaaaaaaatgtttactgatttgaactggtttttaaaacaaggcagcagttcatgaaactgtattaacttcaagttcgccgacaattctttgaaacacgtgtattaaattcaacgagtattccaataggatgtcggggaacatatatggcagttttctgaaatgattttctgatttccttactgagcatttattgtcgagaccactgaataagctccggctagaatgtatttaggcgtttcgatgctcactgaaaatgtcggtagaactgcagtggagaattaaaatacatatccaattacatgtgattagaatcatgaatacacattaacccatgtatgcaagagcagtagagcatataaaatgtcaacaaatcagaattataacaaaaaccataacaaaatataataataactacgaatacagtaagaaaatgaaggaagagattcaagagagcataacaagtggaagcgaaataataggtttatgacgaaaaaagttagaaaagtaactgaaatgaacagactattaaaactctatttacatcctttcgttcagtgaacaaattatatttttcttcatttgtatatatgtgttcctattgtattttttcttccctaaattgaactgcattacctgctaatgatggtggaaaacacatttccacatttgtgaacaggaattcaattcttaattattatcattctttttcacctgttaaaggaaacctcaccccaagaaataaccaaaaggcattacatcatgccaataatatcttcattcttttgaacatttcgtaaagaaaattgttcatcaataggctggaaataaatttcagcattgtacccatacttattatctgggggtgaagtttcttgtttagagccgttcgctccgcaaccagtttgtctatacattggtctatttccatatgcctaataatcatttttgtctacttatcattcggtttactgaccatttaggctaaaagtcattttgatctaatttccatttggtttaaaggtacatgtcccttttgcagccaacctcaaattctgtagaactttgcaggaattatgaatatgtcatgtatgtcctctctgtgaaatttgaacgttagcaatgtcctaatattcaaattatgcaacgaaacccgtttacttgctagacttcactgtcagacaccattgattgacttacttctttggtaataacatacataaaatgagctttaaagggtacatgagcatttgtccacatcaataaccaacttcttgtgatggccaaaattaaactgattgaatctttgcgcagcataaaacgtatg

SEQ ID NO: 92416 - DNA, 2184 bp, Oryza sativa
gggaactgctccctaccctagcccccgctgtgtacagtcatggttaagtggcaaagcaaaggcctcggaactgtgaggccccaggatcaaaaccgtgtcgatgtgctatattagtgcctttttgtggggcattaatcctcattactgtaatttatgacttaagggcgtaggttccctagttaataagcatatttagagcatgcacatgctttagcagtcacgcaaaacaaacactggcaaattattattcaataaaatctgagaatgtatactattatccagttctatgagaaataaatcattgtcaaaataattccataaattggggtaaaaaaaatattccaacgttatgagcgacagtgtacatccattttgtaagtttatcaattgtaaaattctttattaaatgcaatatccccggtgtctctttgataattaaactatttgatctataaaagaagaaataatctgttaaataagatgtagaccgttggatacttttttgtaaatctttagtcgcaaggtgtcccaaccctggttcccgtcaccttgacaacggccggatttctttctcgccgagaaacggacgaggcgccacgaatttttggcccgtaggaacgatgatgaccctcaggtgtccgtcacatctagagctgatggggtcaagtgagagggtgtgtcaacctgatggtcactggaatggtagcctgacgtcatgccacagtgaaggttattataccgatgttgttttgggtgtgaaaagcacggactgttagcacatgtgttgttgagggtttagcccttttttgtaccatttacaaaatgttcctgcttaaactagtagatattttatgcacgacaaagacatttatatttatttaaagagacgttttgagaacctctcataccaattcattgcttagtacattatgggattaaaaaatccagtttaggggggacggggggtctttgaaaatatttgaaccattggtaatgcctggattacatttgaccgtaccctgcccgtatgcccttttccgtgcggccaccgtacggaggtaggaggcggccgtgatattttcgtacggattcacgggctccgcggggcaccgcggcctctacgaatttgtttcgcagaaagttatacaaatttagaaaatcgtaagcccgtatacatgtcgtaggtgtcattgcacaatctccacacgggcatcgcgcggaggacgcgcgctgatcgtgcaacaaatacgattttacggtgaatatggaggcaaaaaacgcttaaaacgacacggttgctgcacggtcactgagccttctccgcgcaacttttgcaagctgcacgggctccgtacgatttccgtgcggaggctggggagactgcatggctactgcattgaaattgcacgatttccgtaaatctccgagcagcctctgtacggatttaccctggcctgccccggaaggtcaatacaagaaatggcacgatggtcgtagataaacaaataaacacaaacatcgtagcccgtagcctcctacgatgccccgaaaagcgcaagagaaatcgtagactaatttatcgtacggtgtcaggggcaactgttatccaggcataattgtgctgacaagcgacaagaaatcagtggcaatgttgcacattcgtgcaataggttgaaatattgattattggtgtaagaaatgtaaaagaagtacaaactgtttatggctgggttaaaaaattattcctatgttttggttggggctgattaactggttataagtcgtaggtgttctaatagaacaacacggcttggtaataagtcgcatattcaggatggtgaagtcgcaggacggtccgaaacaaaacagatctcataaatgaatgtacaatgttgtacattttcacgcacacacaaacacttttttctttttcaatattttgtaattagaaatttcattaaaaataaatcattgcatagaaatcattgtaaataattccatacaaatacacatattcatttcatttcataacatgaataaattattcacaaaacagtgagcaaagaaggagaataatggaatgaaatcactaaattttctaataataataatgaaatactgaacttaactattaccatcattcatgaaaaaaaaggaaaaaaaaacattatacatatttaaata

SEQ ID NO: 92417 - DNA, 9015 bp, Oryza sativa
cccccacacacacacagtttttaaagtctttaaagtctttatagggttaaagacttaagacctgagttttatggcacctattaactgtaccttaaatcaaattttattagagtttccttcctttagaaaagaggaaaaagcatatggacaatctgaacacgcatgcatatgttgcctccttcattactgctttctttcgcacaatgtatattaccttgaaaatttgagcagtgttttgtccccctcctggtccgcatcctgtgtcatagctcctcatccaatcatacatctgtaaaaataatttccttttaaagcttacttttagataaaatacatgatttttgacatctaaacttgattttatttttttcttacaaactgtacgagcatttggcaagtaagggtgaaaatattgtgtatacatggcacctgtattttaagcattccacactgtatatagtagcactggcatacattcaacagatctctacaagttttgtaatacatgtaataataaataataatggtggcttcttataaagcgcaccagggacccgtttcacaaagcattttttcaatgacaaattacacaaatttgtgacaaatctgctgataaccaatcagaggcaaggattccattagcttataacaaaggctgtcatttgtcactggtgacaagttttgtgaaacggggcccaggtccgtcccgtcaagtttgacgctcatatggcgcttatgacgcgtgttaattgtttgccattcttgatttacatgtacatgtatgcatttaaaatgagcaaatcgtttgttcagagttagaaaggcatttttttagctctgttttgaaatataggagttaatgcccctctggctccaaacagacaaacatgtatcctttgtggaaataaatcctgaaaatgtggcggttggtgtgtatggcgcgacttcattttcgagaacacacattgctcactcgtatgcgtcatcaattataatccacaaagggtgattcacaattactacatctgtaataaaacaggcagggcaatgtctgccactgagaccaggaataattgaaagtttaaattcaaccacgcatgactattgaagaggtagttgttcttgtcattcatggaaattatatgaaagcacaacaatgttaaaaattagagcaaaggctaaaaaaaccaagggattttagttgcaggccttcgttacaagattccttagattcagaaaaaggattttggaaaaaaaaggtctatgagcacttatcatttaattacaagttaccccctaccagaaatattagcaataacactgaagaaaaaaaagttcaacattttgatgtttttttcctaaaggcccggtcacacagaggggacgcatgggggacgcacggccggcgcatggaaaatttgcgattttggccagtgcgttgtcgttcgctaggcgtgcgtcatcactcgttactcgttcgtcgagcgcgctggacccacgctatgcattcgtcgtcattcgctgtgtgcgtcgggatttttttagcatgctcaaaagtgtgcgcggagctcgacgcatgaatgtacacgccaaaggcacgccagacgtgcgttaagcgcgctagaccagcgccagacatacgcggagcacacgccctgtatacgcacagcgcgctagctacacgctgtgcattttgtgtcagctcgctagcttttccaaaatcatgacaaatgttaggcacacggcctttccgatttccaatgcgctggccgtgcgtcgtagaacagggctttgcaacttctcacaaaatctaaggctgacataaaaacttgcatgaagcttattggatgattgcactttctctgtgtaaaaagatgacaacattttatcttttttaaacttcacctttgttacttatttgaaatgatttgtactctaatctggttcaaagtcaaaagcttaagtctggcgagtttgagtctggtttggtttccaagctacatgtactgcaccggtttctgacatgtatgtctttatacattcaagctataaatcagtttatgaaatgatattaatctagactgacctttcgtttgcccattcggtccttgtttcttagcagatagacagctttgtcaacagctagaaggccaacataggagttgttaggtgcagtaacttctacccgtatctccccattgggttcataaacggtacgttcaggtcctacatgccttggaagaatctccagggaaacctgtaaatgttcattcaaaggaaaaccaagatggcttgatttgactttcgtattaatgtttacaaccacttagttcatgattaaagtagatgtgtcgtggtctagtgattaagtcgccggactgtgaaccacagggaacggggttcgaatccctgcaacagcactggtgtcctttggcaagaaattaatctacatttgccacactcgaccaatttacctcgacccgtgtgaggtaaatgggtatcttgcaggaattaattccttgaaatgctagagcatcacagccgccatgctaaagccggggtgatattgtggagcgtcaggatcgagtgtaaagtttgacagccatgagtgaaaaaagaacccattattatcattattattataatcatgatcattatttgtgtaactgatcaacagatatgttgataaagttttggcaatggaaaacaattattttatattttatatacatatactgtgagtcaaacctgcttcaacgataacctgtatagaaagaccacattttgtatttcccttatatgggtttctcattgaaacatgtactaaaggaacctgtatatagagaccacctgcctataacgaccacttttcttgtctcccttgggtggcctttatagacaggtttcactgtcaataaactcccatgtacatgcacatgtatatattgcatatatgttcctcatattccgtacatgaagctacagtacgtacatgtacatcgtatgttcacaggtagtcattttgtatttatactacagtttacactcatggctccagaattatcaagcacagttaaaattgaaatttgtcatgacgtagttaacaaggatatggtttgcttcactttacgttttttttgtttgttaatcttttgttttgtttttatggctctctcattggtaggcctacattatattaaaaatggggttagtttgaaaaaaatgaaacggtttctgaatacttgccaaatcaaagaagagagaaaaattctcaaaattggctctagagtcattaatcacaattatactataaatttatcctgatgaattgaaacatgaaaatgtatttattttaataatttttgtgtgaggctctctcactggtaatccttgatacaaggggatggtttgaaaaactgagacaataaaatgtttgcaaaaggttgtacatacttgttcatgtaaactaaactagaatttaattcgtcactttgacgaattaggtgagacgtagttatgctcatgtgtaacataatgaagaacgcattttcacgatttcatctttcgttataaaatacaactcccattatggtctatccatgagtcaagtttcaactgtgtagggcagagggagacagagcaatataataagagggaggcaagatagagagagggggaggggtgaaagagtagagagagagagggagagagagggggagagggtgaatgagtagagagagagatatagatagatgcagagacagaccaaaaagggagaggggcagaacatgagaggagaagggaaacagagcaagagagagatgcaattgagaacaatgctttccatatttctagcataaagctcttgtgaatactgatcttgaaagtgttgccgataataaaaaaaaaaattatgttcatgaatacgatgatgacgatattagaatgaaggccatgactgcaagtggcacagcgcccccttcaggttttgatagaagattaaactgtttacctatactaaacaagctcaaaacacttttttataaatattacaaaatgtacatagtgatttatttagttctgatttaatatagaatatgagtgagatattaatattttacccatccataacccatccatttgcccaaacaatgttgcaataactaagaaacggtaatataagtgtattgtataacataacgagaacagattgaggcaaagtatggcggagtttggtgatgacaccagtatttctagaccctatcttattaatatgagatatatgtgttttccaggataagtttcgtcaataagaatagacaagaacttggtattggcaacacgattatccagtcataacgtaacaaatcctttttgaaaacattaagagatgtatcattgataatacgagtattatatacagaaattttataaatagaaaactgtttttgtgttatttgaaatattggaaaattataagatatatcattataaaacaaacaagaagaaacattcaaatcaaagttatttgtaaatatattatcaatgagggatattgatctgtcagtctttctcaaaggcttatcaattaaaggaattttaaaaaaaatgtattgcgctcaagaaataacatacagcattgccagtaaatttcacgagatcaatgttaaaatctcccattatataaacctgtttatgttcagtataagttttgtgtaaaacattttcaaagagagggatgaaatcattgatatttgattgaggtttcctatatatgacacctacaataatattcttatgtcacgacaagttgctttcaataaacagtgattcataattgtatgatgggtataatataaatatatcattgcgtatttcatattcaaaattgtcagcgaccaatagactaacacttccactctttcctatacttggcgattagaatgtataaatgaataaccagacacattgaataatagtggcgtactgttattaatccaagtttcagagaaatctatacataaagtacagatgaaattggatatagcattaaaatgtatgtttaaaatgtaaaatactaaaatgatagtcaatgttactgaattcagtcgtaaaatcctcctcagtataatatttacagttcagaaacctactgaaattaaattatcttctttttcggataaatagtttaaatcattgatatcagtatgagtatttgtagtgttactaccaaatttgaatgaagttcgtcattattcaagtcttgaaaaggaaatgaagaatgattacagagtgggttattaatggagacaaatgctcatgtttcctataacgctcattttatgtattttatgtcttgaaagtaaaagggtttccttacataatttgaaaacgagaacactgctaacgtttaacccattgcttactggaacctggtggtccctgtgttaagcctatgggacctatataattcagtagtcaacgggttaagtttcacaaataggacatacgtgacatattcatcaattcaacattcaactgaaaattgtgacatgatcttatcatctgatcaaaaaactaaaacgttttgatagcccatggtctcagctataacataccaaaatctgggagaaaagaaagcacaaatgagcaagataaacggtgctcaaagatgaatgtcatgtagattcatgatgtgaacaaaattcaccttccattgacataacacgcaaatgaagaaaattctgacatgtggccttcaattgaattttgtactatgatgacgtcattaaaatgaaatttagttatattgatcttgtagacaattgcctcgactacaatatattagaatgtagaagaaaattggtgaatattgagagaaatacactaatttttccataaatataatgacgtcataatatgcaatttggtatatttgacttccaaggccattatgatgacgtcaagatgtacttaatggccgaatgagatatgaaatcatacctccgactcatactctatctaaatatgaaaaaaaaaatggcagtccttattcatcccaatggactttttataggcttgtttttgcccatatatgctatgtattgcaaaaatcgcgcgtacggacggttatcttgaacggacgctcatttcgttattaataataataataataataaatttatatagcgcagcttttatacaaaatatattcagctgcgctggttaagagctcctttttactaaattctacaaaataagatcactcagttgaacaaataagtttttaaattggatttaaaaacattgagtatggagtgcttcttatttctattggcaagctattccatagtttgggggcagcaatagcaaaagcacggtccccaagagttactttagttttgccatggggaatctgaaacaataatttatctgtggaactgcgcaggctacgactgtgtgattggactttgagttgtagtaattctttgatgtaactaggggcttgaccgctcaatgatttatagacgattaacaatattttgaatgagattctttgacggactggcaaccaatggagttctctcagaagaggtgcggttgaagtgaatttcgaccgacgatagacaagtcttgcacatgcattttgtactctttgtaacttagctatcagagaatcaggcattccaaacagcaacccgttacaataatcaagcttacttgtgataagagcgtgtacaaccaatttcatacttccttgatcaaaatatttgcggatacgtctgagattgtacagaagatagtatgttgatttgcatatatttttaacatgtgtttccatggttaaattagtatcaaagtatactcctaaattccttgctgtaacagagggtatcacattggaggatccaactcttacaccgtcaatgcttatttttgagatctgttgtggagttcctataaccaaaaattcactcttactatcgtttagcttaagattattgttaagcatccatctatgaataaaattaacacatttttccaacattgaaacacttgcatcttgagtactagtggatggtctaaaggataaaaataattgtgtgtcgtctgcataacagtgacaggagacttcaggaaaattatcctgagtgctcttgattagattacttgtgtataacataaaaagcaaagggccgagccgagagccctgtggcacaccaaagggcacctggaaagagtcagagacaatgccatcaattttaactttttgatgtcgatcagacaagtatgactcgatccagccgagagcaacaccgtcgacaccgcagcatatcttcaagatatctagtaatctggaatgctcaatagtgtcaaaggcactactcaagtcaagtaataacaggagagtgattttctgtctgtccattgcaatcagaatatcactcttgatcctgagtagtgccgtttctgtactatgaaactgtctatatgcagactgattggatggaaggagtgaattactgttaagaaactgtaaaatctgttgtgtggctgcaccttctaccaatttagaaatgtattgtaggttacttatgggtctaagattaccaaattcaacatcaagccctggttttttcaacaatggtgaaacaagtgagactttccattctttaggaaagtggcccgtagacaaggagacattgatcatggatgtgaacacaggtagtataacatcaatatattgcagagagcagcataagcatgtacatgctcgtgcgctcaacccaatcaatattaatagtgatgaagagataaacatggtttcaaattgttcggaaaagtatgaggaatattctgtcaaaagtttttgcggaggaattgtttttcgttcggccgtgacgaacgaaaacgtgcaaaaatgcgtgttttgcgtgatattttatgaaatgcttataatggcctaaaacgtatgcaaaacaaatttaagacgattttgagcaacttaaaattgtaagcgcacgcacatttttgcgcgcatttattgatcggaaattgaccggacaaatattgaccttgatcgtgataagtatgaaggagaaatggctttcttttatgaagatatggtcatgagttgattttcacaaaatggcgcctagatgacgtcatgatgatcttgattcactgaaaagtcacgcagttctaagttagactgggatctaccatcatagcaagtttcatgacaaaccggggtttattcattcttgagatttcttgcgaacaaattcgagtaagaataataataatttttggtgaataatacaaatcttgacgaaatctatagttgatacgtatacttcgtacgtatgacctaattaaaaaagaggaatatgctcaaaattggctctagagttagcaatcacagttaaactgttattgagttctatatgcaacttttttttaatagcagtcttacctcttggttttgtctgcactgttcttccacacctaaaaggagagagtcggcaataacgctgccatccatagtgacatagtagacaatcagtcgcattcgtggaaccatgttggatctgattgttatgggcaggtttgtaccaaatgcacttatgcgttgctgaactccctgcagaacaatcttgccacctgtaatgcactgcaaacaaacatttaagtttaagttgagttttagccatgcaactgcaatgtgaaaaaaaaaactgtggacgcaattggaaaggttgatcgtgtagcacaaaaatattgtgaggtttaggaataaataaaatgataattaattggtcacatgcaacaaatactataaagtgtatatgggactacacaaatatgtggcatgaatgatgtggtgtacattcttgagatcttatgggtcatatttcaaatatgagggggggggggggggggggtaagagcacatttttttttgggggggggtccaatttttgagagaaaattttacaaccacttagccggccg

SEQ ID NO: 92418 - DNA, 741 bp, Oryza sativa
cctcccaatcttcatatagttcagcatacctctttcgcctccacactaatgctgtgactgctgctcccacaagtaggatgactgtggtgatgactatcggtaggactatcttcaaagttttagaccggacttttgggccaaatcgaggtaactttggtaacttgatgatatctattgtcggagcaggactgttcattccaaagctccagccaagaacataattcaatgcaccgacattattagcaccggaagagaagccaatatatgatacaccttcatctaaaattgttgagatgttgaggattgctgacagcgttggtctcaaaggtttggttagcttgagaggagctatggtcacattcatctgtgtggcctctccatcatagtccacccatatttgcactgccttgccgccaacaaggggcaagtcattgaaaatgccgttcttgtcatcatagaagccagcaggatgggtctctagcggtctgctgaaactactgttgatagaaatgctgatgtcgttctcgttgttctccagaaaccttttgtcttggcaacttaaaaaattaactgcaagattgctctccctctgatcattcttgaggcccttgctcggaaatatcatgaaagccatgctgtcgggacatctaatagaaggagccatgaagagcacaaagttgactgagaaggactgtaatggtaccttcagaaattgccatggagtcgggtagagggcgtagc

SEQ ID NO: 92419 - DNA, 707 bp, Oryza sativa
tggatccccccaactttttccgtttcaacttttccgtcacatcgaactttcctacacatacaaacttccaacttttccgtcacatcattccaatttcttcaaacttccaattttgacgtggaactaaacacagccgtagcttccattcctgtttcgatggaattcggactggctagcatattgtgtcctgctcggtataaaagtagttacacgcacaaataaagcgtatctttaagtctaaatgaaaccgcaaaataataaaatcacaaaatatatatatcgaggccgatcttcccgtgtgttcactgaactaaaaacctctgttcgggtctgctctggctcaaattacctaaatctcttcttaatttaatccatatcaagatttctcttctccttggtatcggctaattaaactctagttgttgacacttgacagtatcatctcccaccagagagaccggttatactcgtttgcaccgacagatactgtcttaataagggattctcatcaagctgatcaccttcaacctgcatctcactgaaactccggatgctccggtaactctccggcatcgccggtaacagcacatcgccgcacaaatattgcatcacaagcctcatgcttggccttgaagctggcgacgggtgcgagcagagaagcccaagcttgagcactagctctgcctcctccgtcacaaactctcctt

SEQ ID NO: 92420 - DNA, 754 bp, Oryza sativa
aggttcgcgcccctaaattatcaggtaatatccctacatcctgttggccgaagccgatattgctcttattcatcataatcacaccaatacaatatttgggatagcctatctaattgttgtcgatatggcggtctgaaggtctgactcatagtcgacaacagggtagtattcctcctcgagttcgtgcccggcgtgatcagagacagcgcaatgtctctcctatcagtatcttgagacaccgtaggggactagccgtgcctatctctgaagtcgatatccggcgtcttgtcttggtgtatgttggcttgtatgtcgatcttctgtcttgatctattgttccgcgtcgtctatggtgggtgttgattgaggtggtcgtcctctcctcctaggaggtctcgtatttatacccataggtgtccccttgtcaaattagaactagagaaaccaatatggatacaatccgagtagtccttgtcatttccatatagaactctagttgtctttccttatccggaactccctcaatatctgaaggttgtttccgtaaaggacatggtatgtgatgggtcctgccgagatttagtcaactactattaggtatgtggtatccataaccctgacacacatattgtagaaaccctctattaagggaattcgttttaatttttgttccacaaaaaatgtttcacctagtgtacttataatgtttcactatgtatggattaaatgttgcagtgaattgaaacattctttc

SEQ ID NO: 92421 - DNA, 733 bp, Oryza sativa
aaagcattgtattcggcttgattatttgtgcaataatattccaaacgaaccgatacctcataacacatgccattaggtgaaattaaaacgacccctatgccttgaccttctttgcaagaagaaccatcaaaataaatcttccaaggtataacttcaactaagcaaacctctccctcataagcaacatctatatgatggtccactataaaatcacatacaatttggccctttataatttttaatgattcataagtcaaatcatattctatcaaagcatatgcccacttgccaattctcccatttagaattggcctttgcaacatgtgtttaataacatcggcttgacaagtaactatgcatgtactagacaacaaataatgcctcaacttggtacaagcatagtataagcatagacaaagtctctctataaaaacataccttgtttcggcatccaaaagacggcggctcaaatatgtaatgatatattccttgccatcttcctcttgcgtcaaaacgggaccaatgactttgtcctcggaggcaatatataaccgaaaaggctttccggctttaggcgctcgcacaacaggtggagtagataaatacttcttcaactcttcaaacgcctcttgttgttttgccccccaagtgaaatcggcttcttttttcaaacgaagtatagaaaaaaaagcatcgattttacccgctaggttagaaataaacctcctcaaat

SEQ ID NO: 92422 - DNA, 1927 bp, Oryza sativa
tgccgatgtgggcagaggacgatgtgtcggctggcgcgatcgccataggcacagccacaggcgccgcagggagtgcaagcgtggtggccggcccgcccgtgtgggaatgggataagtgtggacgcattgttcgtaggcccaggctagcatgatggcgtaatccagggagcgaaaccgacagagcgcgacatctatcttgagcgggttcacaaggcctgccatgaaaagttgaacgtgttgattctccgagagcgtagcgtcgcggtacaccagcgcaaggaagctattgatgtaatcctccaccatgccaatgcgctacaacgccatgagttcgctaaggggggcatctatcattgctgggccaaaacgggtgtgcaccaattggacaaatcgccgccaggatggggcgccggagttgagctcaagcctgtaataccacaactaggcatccccgattagatacaacaacacgtatcaaaccttgcgattctctagtgtttgttggccgcggaagaacctgtcgcagcggttgagccacgggagcgaatgacccttgccgtcgtacgtcgggaattccaatttggtgtggggcaggaagttgttgtcgatagcggtgtcaccatcagcaccggtgggatgtgccaggaaggtataactgtggaagtgcgtgtcattgtccccgggcggtgggcagccatcttgcaccatgtgcgacgccgagccagaggaggcgttcgtttggggaagtggcacgcgttgggaggcctctatgtgctcgatggcgaggttgagggcacacacttgctccgaatactctaactcattatctctgtgctaccccttctgttattgccgatctaaaaatcgacaaacatactcctcctggacctcctcgatgcattctggctcatagactcatcatgctggagataaagacggtaatgttcaatcaccaacatgatagctaagctcttattttcataagtaaacacaaaccctgatgtcgtggacccagtgcacgactcagaaaggcgataagatggtcgttttgcatcagcacagccgcaatatctttatgggatgcatctgtctcaaccacaaacaactgagaaagataaggcttagggcatagctattacaggagctggaatgagttcctgttttagggcttgaaaggcctctgccactactaaaataaaatgctttttaaacaaaattattttacccctttttagatgatgaaaagattataaatattttttttgcgggaaaaaagattataaataattaaagtctataaggatgaattaagtacgatatactatgttagaaaattatagaaacaatactgataaaaaataattgtggacaaatacttttgaagtgtggtaggtgttgtctcgttaatacaccatatttataaatgtcaaaaactcatcctacaatatgatacccaaaagacccgcataaatgtatcgacgagactacgggtcgggtgcctcataaaattgaaaaagttgagcgcccttctccgtgctgcaatatctatttggtgtagccgtctctgcatgcttgcatgctgcactccttgttctctcctctcactctctctctctcctgtcttctctctcatgcgtaggtttgacgcacatccatgcaatctcttttatcaatttttaaatgatatttctcctaaattattgatctaatttacaatccgattataccattatatttattgtaattaaatccttataacaatatcccgcatgatcatattatgagtaaaaatgattatatttttaagtaaaatacttttatatactatataaaacatcgaggtgcgatggttgaaacattacgtaatatttactgaaacattcatataatacaatgtgcaacattttcaaatgaatcaataaaacat

SEQ ID NO: 92423 - DNA, 1733 bp, Oryza sativa
gctaggtgtgatacttctagagcaaatggttgggcgcaacaagcagaggttataatgtaaaaagggggttatttctgatattagaagagccggtgcttgattttaaatttttgtgcgaaattggcaaagttggggaccagaggcggtctgaccggcgttgcacggccggtctgaccggtgaccaggggcggtctgaccggccgcatgccgccggtctgaccggcgtccctgagaggtctgatcggccctgtgtggccggtctgaccggttctaggcagggtgctggagggcacgtttcaagtaattttgaggccgaattaattgtgaattcggacgtttgtgcccaagatacagaagaggattggagaattcctttgattcaatatttgaaagatcccacacataaggttgatcgaaagattcgacggcaagcattcaaatatacattgcttgatggagatttatatcgccgaaacatagatggtgtcttgttgaagtgcttagatgaagatcaatctaaagtggctaagggagaagtacatgaaggaatttgtggaactcgtcaatcggaccacaagatgaattggttgcttagaagagcggggttttattggccgaggatgattgatgattgcttcaaatattatagaggatgcgaggcttgtcaacggttcggcaatgttcaattggcgcccgccgccgtattgaaccatataatcaaaccatggccgttccgaggatgggctttggatttcattggtcaaatttatccttcgtcatcaaaagggcataggttcgtgctagtcgctacggattacttcaccaagtgggccgaagccgtgtctttgaagaatatgactcatacggaggtaattgactttattttgaagcatattattcatagattcggtattccgcaaacattaactacggaccaaggtgcttcttttatgtctaaggaagtgaagagttttaccgaatcttatgatattaaattgttgagttcttcttcttactacgctcaggctaatggacaagccgagtcgagtaataagacattgttaaagctagtaaaaaagaagattgaggaacacctgaagaggtggcatgaggtgctttccgaagcgtagtgggcgcataggatatctaaacatggtgccactaaagtcactccttttgagttggtttatggttaagaagccgttttaccggtagaggtgaatcttggttctcttcgttatatcaagcaagatgatttgtcaagtgaagattacaagacattgatgggagacaaccttgatgaagttatcgacaagcgcttgaaggcgttggaagagatagagaaagagaagaagagggtggccaaggcgtacaacaagagggtgaaagcaaaattgtttcaagttggagacttggtttggaagacaattttgcctttgggtactcgatccaaggagttcggtaagtggtctcctagttggaaaggtccttattgagttagtggcattgttcgaggaaacgcatactttttggagacactacaaggggagcgttttcaacgagcaatcaatggaaaatacttgaagaaatacttcccgagtatttggcaagacgcttaggaggtactatggccggtaattggattatcgtcctaagaccaaaaacatgttctatgcttttagattcacgttgttcatcaaaaaggcaggggggcatgtgtttacacccaaatt

SEQ ID NO: 92424 - DNA, 6528 bp, Oryza sativa
tacttaccttatcattttcctctgcagttttcattgtacttatgccaagtgaacgatgcaccatgtttcccacaaacagctaccctcttatgttctgtttgtgatgtgcttatttactcttcctaatttcaagttgctactggaaacaacatcgtcatcttttaaactacctgtatacaggcggtgtgccaatgacatgccccgacatgtagtgcagataacaacagatattctatatgaatggttggcgcacaaattcgtagtcataggaaccggcaatgtcctcgacgaggttgataaggtgacctaatttctgtaagagtagtcctccttccatcctcctctcccaatatatatgtgtatgtgtacacgaaaaataaccaatatcatctctctaattatatgggtcccctcccaatatatatgtgtacacgaaaaataaccaatatcatctctctaattatatgggcctgactcgttaacatacaaacttccaatctatccctaattatataagcttgacccgttacaacgcatgaacatgtaactagtaaaaatgaaagtaggaggtttggtgataattggcttcgtcatcctctgcagctgttttagaagatggatcagtcgacagcaaggctcccaaaccactagtaaccgcacataaagtgggggtacggtgagggttactggtgctagggtttgacaaagaaaaaaatttgaccacaaattttagaaaaaaaaatgaggaaaaaatccccccaaaaattcctagaagtagtgtatgatttgtaatgatatccggtgataaaattttgtgaaaaatactaagctaactccatgtgttggctggactataaggtggcattactttgaaatcaaggttttgatagtcgtgggcattattttggtagtattggacattatattatggtatttctattgttgtgttatgttttttttatgattttctttattttcaagtcaaagacaacggttattgtgccttaccacgagattactgtgaccttaccatgggatttaaaatttttgaattcattttgaagataaaattcatgtggttttcagtggttactacggtaactgtgttattgtggggagggggagggggtgacaacctccccacagacagtttgggaaaccctggtcgacaattgttacaaaatggtaagggaataatgagtgcaaagggagacaattgatgatccaatgttatgcaatggggaatggaaagtaggcggcgcagctacactagttgggcataaaagtggcatgtccaattcgcttagatttgcttttagaaaaaagtacgaattacctcccccacaaactatcgtggtcgaccgaattacccccccctgaaccacaaaagcggacattgttcacctccaactttgtaaaccgaacaaataacccccccccccggctcaatccgtggtggttttaatcctacgtggtagtccagtcagcaattcatttataaaaaaaaataggtgggccccacctgtcagtttctctctctgtctcttctatctctttcccaatctttcactctctctctcttctccatcaacggcggaggaggcgaggcaaggcggcagtggcaggcgcggctgggtggcgactggcggcacgaggcggcgacgtcgcccccctccccctcccgccaaccgcctcgccgccacgctcgcctccttagccaccacgcttgcctcgccgctggagaggacagagctcagggcggctagaggaggggaggcggaggacggagctcggggcggtaggagcacagggtggcggagggagctcggagggagttcatggtggtgctccacctcacctcggccaagttcttgacgacgctcgtattcttcctcatcgccttcacactactcaccctcatcccgcagctcacccacgagatccgcaagtcgctcgaccgccacaccgtgctctacaccactattgacggtcgttatcgaccaatttcgaccgtcaatactacccaatatatgaagactagctatgcttgcaatgcattattccataaataaaatattctattccactatatgcttggaaaactaaccatgcaggagaagctatcaaaatggaggagaatcgacagtacaacaatcgatcaatcaaacagacgctgtcgaaaatcagacttatggatggatgggccaagaactcagaaatgagctatcattttgacccaaaacattgtgtaccataaagtggggcccacatgacaacatcctgaagaaggttgtgggccaggggagctagccagggttcgaccgaaccccctagttcggccgaaccaccagctggcccaatccagcccatcttcggccaggcagttactaccagcatcctatgacggttggagctaattctacctgaagaaaccgtcatggacacatggcaagaggagatgaaatatgccctttggatgcttgaccatgccacttgtcatgatgagagcaaagatgctcataggatgcttggagcatctccactctcccaaggcacctcatggcctataaatacccctcctctcattcattccctcaaacacctcaagaagaagatcaagagctctctgaagtattgtttagtagttctaatattagtggagtaggaaatagaatagtcttcatagtcctcgagtcttcaggagaattcgggtatggctctagtagcttttctctcttcttttgtaagacttattgaattaatagaatattcttctttatacacttttggtaatttattccattcatattacttgagtgccgactttactttatacttgaatcaatatagtcgtgtaactagctttccagataggtgtattggtgtgggtttagtgtctgattattcggttgctctatgtcggttgcaaggatgtagagtagtatttagtaatgtaagcacggtgcttagattattagataccattaattggggttatatattgcggatgagaggtgggccgctgatggtgacagctcagtacgggtattcctccgtgctggtatataatcctaagttaattccctggggagggtattcctacgtatttagccccggttgtatggtcatgacgggctgtcgtaaggaactcggcagtgaggggtggcttctcgaaacaccaggaggacactgggtacggggtattggttgcatgactatataatagcaagtatagattaaagatgtatgtatactagaagtacaggaatgatacttttcttattctttctccacttagcttagactatattttagtgagagtagttcttagttctgtcttctgtgtgtcaccctaccctttgaactgaattaacccttgcatagactttgatgtatataagtaatatataaactattagcatagtactctcttatcatatcttcccttgggataaaataaatacgataccttgcaatactctcgggtgaaatgctgcaatggtatatccgtgcgcttgtggatcacgtctgtaaccatagtataccaggattatttctagtgctattgctcggaattatatttccagtagtgtcgctaagaaataccaacaaccaccctcatcgagctctccagggtgctcggcctcaccaactgcgccgtctggatgcccgccgccggtgaaatgtgcttgacgcacaagctccggaggggcggcaacgacgatggcgttgaggtcggcggcgtcgacaacgcgaacatcgtcgaggtgcgggggagtgatggcgtcaagctgctcgggccagactcggcgctagcctcggcgagcggcggcaaggagcagggctctggcgcggtggtagcgatccagatgccgatgctgaaggtggccgacttcaagggtggacgctagaggtgatccagacgagctacgctgtgctggtgctcgtgcccccaagcggcaagagctggggacagcacgagatggagatcatcgaggtggtcgctggccaggtcgccgtcgcactgtcgcacgcgactctgctggaggggtcgcgggcgatgcgtgtccggctggcagagcagaaccgcgagctgctgtaggcgcagcgggacgcgctcatggcgaacgaggcgaggcaggcattacagggcgtgatgagccaggggctgcgccgcccgatccactccatcctcggcctcgtgtccatggtgtaggaggagaccctggtgccagagcagaggctcgtcatcgacaccatggcacgcacggacaacgttgtctccatgctcatcaacgacatcatggagatgtcggtcgacaaccgcgagcgcttgccgctcgagatgcggccgttccacctgcacgccatgataagggacaccgcctgcgtcgccaggtgcctgattggccgcaccgagctagggcatgtcacgctccgggtgcactccgccactgacgatgtgctggagggtttggagagggagagagggaaaaaaattggggacagatagatcataactaaggataagaccttcaaagatctaatcttttactgatgtgatgttggtacattaattctgcaagttgattaagcaagcaacctatcatggttacatcacaacccatcgatgtaaaccacgcgctacacacacaagcaagaaacaaacgcctaaaagaaaacaatggaactcttggtagcgtaggttcaacttgagggttcttcgggatcttcactccttggcacttggaggggaaactttggaggcaggttccttcttcacaactagctccactgcttcctttgctttcttgccacctcgttcaactattatgtgttgaatccaagcaagggagggagatatgaacactttgcaaatagcatatgggaagaagcagaaagggattttgcaaagtcttttacaaaataagtccttagggtttgtccgtttggcttatcctacagtcgagatggcactgataccaacttgtcacgcccggaaaatacctttcccgaacactagtgtattaatccccgtcccaagagaagccggggtacaccacaacaaacttgatacagaagacacatctttattaattatcacgataatatttacattattacaaaggcacattacgcctgacaacaaaagaaaaacaactgcggactagcgggcctacggctccatcttcacaggcgctcatctagggtataagctaggactccacctaagacttcttcttcaaacaacttctctgaatggaggggggaaaattgagcaagaatataaccaccgtactcagcaaaccatgctgagaaatgaattataatgcaaaggggaacaaagagttggcataatagggttcatttttgcgtaaagccaaagttgcaatattttaatgtttttaaagcatagttttaaactcggtcctatatctaagcaatattatcacggttgtgaacccacgcataccagctttaaactcaggttaaccacctgtccaaagtgtcatgaattccatccatcgcttagaagaaaaacactaacttgggtacattgctaggcttgcccataactgagggcgcggctattcggatagttttactctgatcagaggtgtacatctttacccacaagacacaatacttgacttcatgtcagccatgaatcatgatacctcaaaggtacccgaaaagtcaagattgtgacaagactatccacctacctcaacccaaaacagaaggacctgctaaggtttcgccgcccgccggtccccgacaaggtaaaggttgccggatcccccaggatgagacaggccccttcttgcgccaggtcaaagtcggcctcccctggccccagacctatcataccaatggcctttgttttgagatgatctagacttctagtcaggccttaccaattagacttgtggttgcactgttatgtttcgcaacagaggcctgaagactggtccttgtagtgaccgaggtgcttctaacaaaaccatgcacctcgcgccccaccaaaaaaaataggtttagggagttttgaatgagattccaccatgtccaagctcaaccagtcacctaatcatcattcttacatattttagttgttacccacagtctaatttatagaaagggattctatgttagatctaagcatagataagcccaacctagagcaactagtaagtccatcatatagggaaccatactagtcattttatcattttactaaggttgacaagagcatgggtagcaattcaataacatggctatataacgaggatcacaggaatattaactattaaataaataatagtgaacgttatataatttataaaagtgatgcatatagaagtaaaacaacatagttttttttgcaaaaatgggattcaatatgttcaaggaatatggtatgacttgccttgctcgaagagaaggtcttctgacaacttgacctgcacttcgggaacttccgaaacgacgacagctacacgaaaaaaaaacagggctacaaatcta

SEQ ID NO: 92425 - DNA, 1348 bp, Oryza sativa
atggtctcgagttgtatccttagtgaatcaggtatagtggtacattatctgtctttttataccacgtatcatcctcctgtcctacatattaattgaggtacacaagttttagtttctctggtaaagtagcatttggaatagtattttgttctggtgatattcattatgtggttgtaagttcatgtgagaagggggaacacaatatattgtacccagtcttttggtttgccattaattattctgattaggtatagagaacagctctgttagtgggatgtgtgggactgtcatctctagcatataggtttcagtccttttatttagaacttgggtgcttgatcttttattcattttgatgcaaaatttatcatggaatgaaagatgattccacttttctttaattatattattttggtatgaaaatttcaggaccctgtcctattctcagtttctgtcggagaaaacatcgcttatggtcttccggatgatgttgtttccaaggatgagataataaaggccgctaaagctgccaatgctcatgaattcattgtctctcttccacaggttgaaacaatatttgtcatacattttagttgtagttcctggtgtccaaatgatatgagatatgacagtagtttgattctcataatttgtttgggatttagggctatgacacacttgttggtgaacgtggcagcctcctaagtgggggacagagacaggtaatttgctactccctccaattggacacattggtataggaacaagatctgttgtactttctaaacttggctatcaatatcttggactggaccgttgaaagtgatacatgtggattgttctgaaaatctcttttataatactgtaaatttattactctatgtagatatataacagtggaagtttgtagttttcttgggcactatgtcagtgtcccaaatatcactcactttgtgacttgaggataccttaacatgtaaacactctctttgaccatatatgttcacttggggtccatatgctcaaggtttcaaaatattgtccctgggtatatgttaaaatatataaactcacaatacaaaaacagtattgttggatttgttttagaaaatacattcattgtttgttatcattactactttacaattattttgttgttttgcagagaattgctattgctcgtgctcttctgaaaaactctcctattctaatacttgatgaggtatgtcctacaaaaagttcgcaattttgttgttagttactattcaacgtgtcttatatcatacctactttttactgtgatgtcttataccctacatagctatacaacattttatcttgataggag

SEQ ID NO: 92426 - DNA, 1584 bp, Oryza sativa
gaaaaacatgtttttggttcaattgagttgctagtttagttagggtttcaagtttagtcgagatttttgtaaggagtgctgttgttgcactttgtaaacacagagagaagtaataaagttgtcatctactttgagagttcttcgatttgtgtttcatcgggtgctgcggtccaaccggcgacccaacggcggtccgaccggcgacaagcggcgatcagactggcggcatacgggcggtcagaccggcggcggcgacagcaagtggcagctgatctcggaggtcggaccggagattgaatctcggtcagaccgacggcaactaggcggttacaccggtgcatctacttcggtcagaccgtgatccatcgatttcgagggtaacttttatttccgctaaaagttttcggtttttgggtatatcaaccattcacccccctctggttggcttagttcttgtgattcgatcctacaggtactaattcttggaaatgtttggcaaattgctattctactgatattgaggtgattaggtgaaaacatgacacttctacactgttgacggtcgttttagaccaatttcaaccatcaatataaccggaataaaggagaactatcaatgcttgcaagcatattttgtttaagaataaactatatccacttgtacttggaattttattcgtttgcagagagctctacatattcgaaggataatcgacagaaaataactgaacaatcgatcgccgtccgtcgagagatagacgtatgggtggatgggcttacaaactagtaaaataacatcaaataggcctaaccatcatcacggagaataaatcccaacaaaagacgcgcctgccaaaagtggaggccggataggccagcccaggttcggccgaaccctagccgcggccactcatcccggccttccatgtggatgctccaaatgcactctcaatgatggttggagggcgtttccaccatttccaactgccataaccgtcattgagagactatataaaggggtgctcattcactctcccatacacactcaagaagaagacaaaagaagctctctgaagtttagtttagtgtattagtgctagtggagtaggaatataatagttttcttaatcctcgagtcttcaggagattttgagtatggctccagcaactcttccttctattgtaagacttatagtattaatgaaatattcttttttatataatttcggtcttttacttaagtcatattattcgagtaccgactttagttcgtacttgtctcgatataattgtgtaactagcttatcagagatatgctttggtatgggtttaatgtttatttctatgattattgtatgtttgctgcagcgatatggagtaatatttagtaatgtgagcatggtgcttagattattacatacgattaattggggttatatgcagtgggtcagtacaggtgggccgctgatggagacagctcagtatgggtattcctccatgtagtatatacccctaaggctgtgtccggcacacccttttcctaactcctcttcctcgtttttcacgcgcacgcttttcaaactg

SEQ ID NO: 92427 - DNA, 680 bp, Oryza sativa
ataccttattaaccgcactcctagcaaggttatcaactttgcatgtcctttagaacaattgttcaaggaaaaaccaaactatacagcattgagaatattcgggtgtgctgtttggcccaaccttcggccttacaataaacacaaattagctttccgttccaagagatgtgtttttctaggctatagtaacctacataaagggttcaagtgtctagaaattgccacaggcagagtctatgtctccagggatgtaacctttgatgaaagcatttttcctttctccgaactccactcaaatgccggcgcacgccttagagcggaaatatctctccttccaccatccttggttccgcatctttcttcattagggggagaacagaataaccatgtgcttaattatccgcctaatgttactgatcagtttggtgaagaaaatgcagaaatcggtgaagaaattgtagcaaacggtgaagaaaatgcagcagcagcagcagatgaaaatgcagcagcagcagcaaatggtggtgcacaggacgacgtgcatggtgtggcatatgatgcgtcgccggagcactcttcgcctgtgacagatgatgcgacggcgtcggcagctgagcagcatggcaatccaatccaggaggagcacctggtgcaagcgtccccacaaacagcgtcgtcca

SEQ ID NO: 92428 - DNA, 710 bp, Oryza sativa
atttaccactgatgttaggttaatgacactgtcggcacattggctggtgggaggtatgcggataacagtgttgttgctgctataatattgggcactggtacaaatgcagcatatgttgagaatgctaatgcaattcctaaatggaccggtttaccgcctaggtccggaaatatggttagtgtgtgaataccttatgcttgggattatcattagttgtctatgtcttatagatgatcaatgccaacactcttgaatgttaaccctacttaaaaaaatatgtaaacgtggaattatttggtattctctaggtaatcaacacagaatgggggagctttaaatcagataagcttcctctttcagaattcgataaagcaatggattttgaaagcttgaatcctggagagcaggtattctatccccagtattttcctctccttttagttttagccttttaggtggaccgcattaacttgtatgtattttccaacagatatatgaaaagttgatttctggcatgtatcttggagagatagtgcgaagaatcttgctgaagcttgctcatgatgcagctttgtttggggatgttgttccatctaagctagagcaaccgtttgtactaaggtatatttctgtaccatctctcttttgatcttcattccttccttttgtcatggcaaaagccgttttacttagttgttaacggggtgcag

SEQ ID NO: 92429 - DNA, 3575 bp, Oryza sativa
  unsure (1)..(3575): unsure at all n locations
atggtgtgtttaattcacgtcaaaattggaagtttaattgaaattggaaacgatgtgatggaaaagttggaagtttgtgtgtgtaggaaagttttgatgtgatggaaaagttggaagcttgaagaaaaaattggtaactaaactcaggccttacggggtggtttggtgagagggactaaacctcacaaaaaaacaaaggcctgttcaccttgatgccattttcaaccttatcaaattttggtaaagttgtcaaaaagtgactacatttaatttactgccaaactttagtaaatatataagaaatcctgctaaaattttggcaataacaaaatttaataaggtttattttggctacaatctaaacagtcctaaatccctcccccttaaatgctgatgcggtatctgataccgacctgtataggttgatagctgaaatggcatggaagttaagggaaggaagaagtaaagagtacacggacgagttcctgccttcttggcactggcagatcctttgcactgaagacaaaattgtggttgtttgttgcagtgtaccacaactgcattgctttatggatggcttaaatgttgacgtgcatttgatgtgaagcatcaggcaaaaggacgctaaaatagtaccctccctacatggttgcaaacggtggttgtctgataacacgtccagagctggtttggctcggaaaaagagtggccaaattcattgcctgagcgtatttggacgccgagatgattataggtgtccaaacgggcggcacggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcacggcggcccgtgaaggcaggccgccagcctgcagtgcacagtgtttttttttaaaaaaaagcaaaggaaatgtataaggaaaaataataaaaatagaaataaaatgtttaaaaaaaagtaatgatttactaatgttaaaaaatgaaaaaatggtatttaaaaaatggaaataaaagttttttaaaaaagtaatgatttgctaatgttaaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttctaaaaacctcatataatttacgtctaacctcagtataaaaagaactataatctacacctatagtatctccaacaagtgataaaatagcagacaatccccttaatttacacctaggatctaaaacaaaagcaaaagcatacaancataggtatatttttccaatatttcaaatatttttgtttcatgtgaaagacaggttcagttagaacgtcatcattttcgtattctttaaataatgtagcaatttcaagaaggttgtgcaaaattatattagcagttggataataaacttgtgacaaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctctttcattcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctccactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaacggaggttctcgatctcttcgagccggtgtgtgtcgaaacacttccgctcgcggttccggaaaatccttccgaagctgtcgccgcctgaaccggtacctcctcacgacagccgtatgaacaggtacctcctctacagatggtggagttggagccgatccggatgtaccgtcaaaccccgac

SEQ ID NO: 92430 - DNA, 1405 bp, Oryza sativa
taacgaaaagaaatgaagttatcgaattcaatcaatagtttccacagttgtgaaagagggattaacctgtgagttagtcacagctgacaaacttctatgacaactgacaggaggaaattggggacgcagctaacttgaagtaaaggtgtttggatagctagagtgataaccaaaaaagtgggcaagttcacacgctctaacagcaggaccataggatattccatatgctgctgctgctgtattattgatgagccaccagcattctgtagctgttttcttgctctcttaatttgcaacagaaatcactattatgatctgaggattgccctgcagttcagtacaatcatggcatcgtactgtacacacttttggcacctttgtcaagaaatctataacttatagaattacaccaatctgttatatctgaaaaagagtaggtcatttacaaaatatgcagtttgtccactgcacctgcaagatgctattttcccattatcataatcatctgtacaagccaaaaacaggtcatcccccagaaaggtgatggactatggtttgcacaattgatatgtctggaccctaatatcaacgatttgctacttcacagggtcagctccaatctgtggaaggacataagaggaaaacaaattgagggcagaccttaacttgaggaagtgaatccatttgacccaagtctatagaattattttatataactaatataagtgcaatactatagcatggtgttatataacacaaaagtgcatccatttgatccaagtttaaccagagatacagtactgctatttatgaggaaaatggcgcctgttgaagttgccctatgcttaccatgtcatggggaagttctgacctcctcataaccctcaacctcttaacagtcgaaacaaataccctgcagcagtcaaaagcattagttagatagatagcagtattcacggcacatccttcgggctagtttgaatttgctaccttaccaaaactttggtagggtagcaaaccaaacatctgtattaaacactaccttcgctacaaatttggctttgctcatgaactagtctcttatgggcatagtttggcttcaatccaaataaacattttttaactttaccctaccaaagttttggtagtgccaaaacttacccaagatttggcactaccaaaattttgctggggcatcaatccaaacaggcccgaaacaaatcagtatgacaggctgacaccgtatcttgtatatggctagtgctaataaatatacagtaggagtaagcaacaacaaaagcttacttccatggtatgtccccagctaacattctgtctccatcattgtcttcatatactaaagtgtatacaccagttccatccaacaaccctgaaaatattttgt

SEQ ID NO: 92431 - DNA, 2757 bp, Oryza sativa
ccagaaatgaaatacagtgggacccacgtgtcagacgcaacaaaatccctacccctctcttccctatctccctctccttctctctctttagctcttctcctgtaggccggcgcaccatgaaggtgatactggtggcagtcccaaaggtggtatccacgaccaacagggagagggccaccatccctgccgatttcggttctccctcaccttcgctgaccccgcgcgcctccctcatcgttgtgcaccgtgctcatccacggggttgtcctggtcgttccctagcggcgtaggcgcaatgctcgcctcgtcgatatggcaagaatctgtggtgccctctacgaccctaccaacaccgagggggaggctgactacaccgtagctccgtccgtctccaccgtaccctacattctaccagcccccaccatccagttgtgttttggcactgccattagttgcgacgccccacgtcgcgtaccaccattggccacaacgtcaacgtgcctatctgtgcccccacgtcgtgtcgtggtgtccaccgcatgccaagttgtgagaggttaaacccggcccaattttgggaaaaattttcctttaaggggcccctttttggcgtccccttcgactcctaattagaagattggggtagggttttttttgtgtgaatttgacatgtgggtcctaccatgtttcatcacctaaaagagttttggaactatatatttacaccggttttaacaattgagtatgtgttgtacttggtttttcgatgggctttagtttggggtctatctataatacattcgatagtttttggaggaaaaaaacttgtactaaactatagtataattaaagtgtaactaaaatatgtaaatttattttgaaatcaaaacttgcactattactccagtgagtaggagggtgcgggttcgagtccacaaccaattcaacagcctaaaatcaaaagtttttccctaaaaaaatattgcaagttacctggcaatttctttggtttgtactgccgtgtcggcgaacaagtaagacgtgatcattaccgtgcagcaaacgcatgcgcttttcccttttttttttcatggcacagtttttttttcctgctaagtgtgtatacatcaagagtttgtatttctaagagtaaatttcacaaaatcacaaattctttattcaaaatatcacaaaactacatatttaaaacggtgtatcacaaaaccatagatttaacaacaaattcgccatgaaactacatgtttaagataaagtactataaaattatagatctagtaataacaaaattatcacaaaactatgagtctagcaccaatttaatcgcaaaagtacaacatttacatcttcaatataacattagttctaagagtttaaactctaaaatatgcaattttgtgataacatcaatattaaatatgtagttttatgatacttggtattaatttgtaattttgggataatgcctttaaatctctagttttgcgatagttttgttaaagtatatagttttataaaatttactctttctaattcctgttcggatttcaattcaaattcagatttacatgttttatatctatattataaggtttagcttataaagtttttttatataaactttctatgacaacttatcatgatgggccagacgcacgtggggtcggccgaaacatattcgtgttcctggccgcgcccgaacattcacacattagatctaccgtcttttttttttttgaaaactaaacatccattaatataaaccgacagagttcacgggaataaatcccagtacattgccaaatagataaagagagagcgtaaaaccatccgtttctaaagaatggaaacctgcactaaggctacaaacttcataatgaaaccacacagcagataaggtgcacatcgatagggagctgcggcaatgccgcgacgaatgcaaccttgggcctccttcggcgtgcagcccgcttgacaaaccggtaatccccatccggttgactccacaaagactgcacaaaacggaggtctgctgctgagccatagattttggagtaagcaacaccggactcagcaagaggtgtccacggagttcgtcgttaaatctgaggagcgtgagctcaacccaaacaacaaaccctgcatggaacaagctgataggaaacatataggaagaaggagcccaaatccagatctccaaacccactgaaaaactcgaatggtggcaaacgaactgctgtcttcttggatcgacgtatggggatggggaagagtaatcctacgaatcttgactgatggaacctaagcattgggagctctcgaactggcaccagtgaaatcgtcgccaccacgccgacgggttgtcatcaagcaccacgagcagcaagctctgggcgacgatagcaccggacgacgcaagccacgagaagtcaccgcagccatcacacgagatggggcgatgacctcccagccactgacgacgaagcagccgacgctgtggccatagatgacgaagcagccaacaccgtggccactgacgacgaaacagccgacgccgtggccactgacgacgaagtagtcgacgccgaggccgcaggcgacgaagaagccgacgccgcggccacaggcgatgaagccgacgccgccgcaagaagccagctccaaccgtcaattcatccacaggtctacggatctcacacctccaccgccaccaaccgccgccgccgcctaccacaccgg

SEQ ID NO: 92432 - DNA, 2200 bp, Oryza sativa
cattagccgagcaacatcttgctcaccaagtttccttttctcttctatttttgacttctcttcctgaatgcagaaaaaaatatataatatgttatatagttgatataacagttgccataatttctaccggtctaggcggtaacaaaattaacatcaaatatcatccttatagcaataatatatgatcaaacattatatagttaatatttcatttgtttatattattacaataatataaagatagcaaatgtactataaagatagcaaatgtaggaaatcaaatcttttcagtgtaggtctaaccttaattatctgaagccggtttatagccatctgaagaaaggaagtccacaatgtcatcagttaggggggagaacttctaaattatgtaatttattataacaatgaaaatactgaatatttacctggttttcttcatttgtcccatttactaatatttcaagtgctttgatttttgaatggtattcatcttcccttgtcttaatgatcacattttgctgcaacaagagacatctgattcatgagttgcatttattagctaaaggatatataggcttcagggaaaaaagactctcttacacttcttatgtgctctgcttgaatacaaagacgacgctcaatttcttgaactactttcctcagtaggtacactacacgctgaggtgaggtagataaatttattagatttaaaagataccaatgaaaaagagagcatgcaattcagaaacacagacatacatgtggtatttctccctttttcctttcaatgctttcgtccaaaatgccattaacgacgctaagaagggattgggttggtgcattctgtgagaaggtaattactgttaggaaaggaatagcaaacaacaagatagaacaattcaacaagcataagcaatggaaagttacatctaaactgttagaatgcatcatttctgaaatcttggcagccggaagatcagcataggatccacgttttaattggaaaatctcacgaagctttcgtcctgcagcatatatgacgagctattataaactaaaaggtagggaacagtagtgacccagatatagattatacacaatagcttgagttacaacttgcagcaagcatacacgttaacaagtttgtagtttggagcttggaagccatgttgaatttaagaaacgttaaagtaaccaccccaccatgatcaaatctagcttcatcagaaagtttgtatgtccactaagattctatgttgaacatagttgtccaatctacagcttcaaccaataaatcgttgaccccccacaacatggccaagtgcccaatcacaaatagcccatgtcattttccctttgagaatttgactatatagtacagaattctagagccaaagcgtaaacatgtagggacttcttttcaactaatatttttaaactatgcaccaaaatagtcaacaatgtgcataccattaaagatgggagttttctgctgagacttagggtctggaaggccattcctcttgtcctctccaggggatgtcttcccttgtgccacaccagggacaagaggttcaccagtttctggaactcgccattttttcctcaaaggagccttggaagtaccatcacgtaatccagaactcacactttccctcagaaccaagaggcagtccactaccccagacattgaaccctgccatggtcaagttatgagttaacataagcaatcaggaactttggaaatggtaaacattttttttaatgaaaaactgtaacatcttacatccacaaatagtgaaattggggggatttgctccaatgcttgcatgtttccgtcaattgcgagtatttaaaagcatgtcattttaactatgcggtgtcaatcctttttgcagatttgcttcctagatgacagcatccggcatagaataaatctagaactaataatctaacctccttttctagcagtcaacaatctatcacagaatttgagttattactatagtgcaattatggttaggcgatattaagaggttattcatttattcctcacagattataatgggaaaaaaaactctagaaatatagttctacttatatgtgtatgcatgactaaaacttgtcagcaacgcaataccatgagcaacaaggccaagcaccattatattgactagcacaataagggggctgcaggaat

SEQ ID NO: 92433 - DNA, 5048 bp, Oryza sativa
atcattgcccatttaaaagggcagtcggtggttacacgcatctctttgtggctatcaacaaattctccaagtggattgaggctaaaccggtcatcacgatcacagcagataaagctagagattttttcatcaatattgtgcatcggtttggggtacctaatcggatcattactgataatggcactcaattcactagcggagcatttaaagacttttgtgaagacttcggcattaaaatttgttatgcctccatggcacaccctatgagtaacggacaagttgagcgcgctaacggcatgatactgcaagggatcaaagcacgagttttcgaccgactacgcccctatgctggcaagtgggtagatcagctgccgtccgtactttggtctttacgcactactcctagtcgggctaccggccagtcgccgttctttttggtttatggcgcagaagcaatgttgccgagtgaagtggaatttgaatcactacgatttcggaacttcaacgaggagggctatgaagagggtcgagtagacgacatcaaccgactagaagaagcccgagaagcagctttaattcagtcgactcgatatttgcaagggttgtgccgttatgataatcggaatgttcgatcgcgagcctttttagtcggcgacctggttctgaggaaaattcaaacaacacaggatcggcataatatctcccttatgggaaggccgttcatattgtgaagtcactcggcaggtcttatcgactaagcgcaaacggtactctcatcaatattttggaatattgacacttcgtcgattttatgcttaggctctgcttgtatctttcctatttgactgcttatcaattcaatttgcttacttgatgtatcattgctctgtttgatttcttggcttagtcaatgaggactgaaagttttttaacaacttttgcgggttttaggctcaacaaggtttgacaaaaacttttaagaaatcaggagctaagttaagatatcaagcacagcataaattcatcagtattgtacaaattgtgcctccatcatcattaatcatcaaaatcattggtacattaatcagtatcagttttttcatcatcagacttatcagacctagtcggccgaaggtcgacatcttggaatctctcaactacatcagcagcaattttgtcagccgctttctgcgcatcactgatgaggtcaagagcacttcttcgctcgtcccgtctgcaaagccatcaatggcatcaatatcaactcttggataaagggatttggtcatcgccaacgccagacttgctcccatactcccagcttctttgatgttcttgaagtaagtatctggagcgactctcagcttgtcgaagatttcggcagcatcaagtgtactcgaaccggcgttattgaaaaacattgcttaaacaattggggtagcagcgttagcaacctcatcccgggttccttcaagttttttgatcttgccaaccaggacgtcgaattgagcttgagatttgatcttgcggtctgcatcaacagattcacattaataagtcagtatatggaggatattggcttttgaggtattgattgttgataccttcaacttcctttaaagccaggtctctttgtctcgctagttctgccttgtcattttccagaatttgaacctgcttctccaactgagatatcttggcagcttgcactacattgattacggttaatcaagattgcaaagataacattatgagtcagttgagcagagtttgtgcgtaccttttgatgagccactcagttcaaaatttgattcctggagctcagcgatccgatccctcagatcatgttcattcttcctggcaagttctttcgcttcgtgcagttgattcctggtagcttcgagggttccgagatgagggactaacctctctaaggttaccgttttggcttcgttcctaagatgaatcctctgcaagacagtttaatgagcacatgaattaaatggcaaacaagatggttgaaatcaagtaccagagggcttacatttacaatacgggttgcttgaccaagtgccttcttcagtaggcataactcttcgtcctctttttgcttatttatcacgatcccttgaggctgcatgttgtcatcccaccacttgaccagaatcggagggcgtgaatcctcagccgcttgtatccggaggatttcttcttcataaccaattattggccctagtgtatccatgaatgaagatgaagcagctaaataaagtctgttggatcaaaatgatttcagatagcgtggctacctgtgatgattcccggtcggggacgagtggactttggtgtcttcacaggagatctggtttctgattcactgtcggcatccttcccgagaggactgttcgtttgagcttcaacctcgggaaccttttggcttggccctgcatccgactggtttccagtcgggggctcctggttagcaccgacttcagcttcggccgactggttcccagtcgggggctcgttgctgggttctacattgtcggttgccggctgattgtcactcggatgatcctcaacagatggcccggtttctttggaagagcttgtgtccatgttagtcgggtcagagtctttcccagacggatctatatcagatggtttcctgcaaatttgattatcagtgttattaccgcaatgggtgcgcatcaatgcaaggaagatcgttatatgagttgcacctggaagacttcctgatctttggcacaggacgactggatgttttcttccatggagtagcctgttttggtagttttttggttgtctctcggtctccaggcctcctgatggtatcatcggcttcgtcgtcacttagaaccagcttcctctttcgagaatctggctggccgactggatgtcacgcccagaaattcccgaatagaattccaagcagaatgtgtattaaaacccccgtccaggaccagccggggtacacaaacgacaatgttgacctacagatccacgtcttacaaacaatataaaggtcttacagaaatgcagcggaaaacaaaagataactggagctaatccttgacttgaactgcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaatagaggtatgatgcagggatttaacaagggatagctaagcaggttcatttgcataaatactggcatttataaacaggaattgaatgcgaaaacagttgtaataattaagcagtattaaacatccgctgtccaacgctgacccacgttgcgacaggcccaaccatccacctaaactatccaaattcaacagattacactagggtgagactaatcacggtgaatctggttgaccgcccgtaaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctctgctgcgggagggacctcggcgactatctcgaagtacaccggagcgtcggagggatcggaatctagcgacatacaaagcaaacattgcaaacaggctataagactactgaaacagagaacaaaaccatttttaatggactctacatatttttcttgatttactgagacttgaatgggattaaacggagctcggatgaattagatatgaattttagaagattcactgtgtttattactataaaagaaatccttaaataatttattgcgcaatattaaccagggctgacgtcagcgagggggcgcggcgccgacaggcggggcccaccggtcagcgaccgggagagagagaaagggggtggcggcgcgcgggcccacgggtcagcggcacggggaaaaggaggggcggcggcgccacgtggcggccgaaccgacggccccgatctacccaagggtagatcggacggcggcgggacctcgcggccggggcacgcgggcgcggcgcgagacggcggcgaccatggcgccggcggcgcggcgctcacacggcggcggcgcgcatgcggcagcggcgcaaggcggcgaccgaaggcgaccgaccggcggcggggagcggcggctagaggaggagcggcggctacgcggctaagcggcgcgcacgcggttacacggtacggggaaaaggagaaagaggagggggaagcctcaccgacaacggtcgacgacggcggccgacggaggacgacgacgacggcgggacgagctccggaacctcctaacgaacaac

SEQ ID NO: 92434 - DNA, 677 bp, Oryza sativa
ctagctgtgcaaatgcatcccttggggttcttaaaggagtatcttcttcaatgatttggacatcaccccacacctgttgagtgagaaaaaatgaacctaacttctctccagctcctaattcagaataatatatcttcaattaaatttatacttaccaccccatcaacatccatccaatgacgcttcagacgaaatctttgctgcccacgggctacaacatttaatgaaccatcatccatcctcccaagttgtcttatctgttaaagaaataacaaaataccagcttaccttgtgaggctgttcgaaaggaattatacatcactttatacataaatcatactaaggggctaatgaccgagcttgacatgtaaacaagacatcacagtgcatatcggcctcatcttttcacttatgcttatgcttatcagccaaaatttgaattttcaaccttaaatttgaagccgattttgaggttttctcatcgaagtttatttttcagcctttgcttttagatcactaaggacacgtatataaaagttttattcacaaattacttttcgtttgcaaatacgccgtttggcttattccgcagataagccaaacgatggggctttatatgttctgttggtcttctagatcttgtgaagtatcagaaaactagatgagtacatgattct

SEQ ID NO: 92435 - DNA, 1390 bp, Oryza sativa
atgtggcagtggaggcggggaaggagtctgtttggtggcggcgggcgacggcgcagctgttttgcggaggcggaggctggcgtcggtggcagcggtgacgtcggctgtagccgtgaaggtggtggcaacgtcggaggatgcgggtcgctggcaacagcaagtggaggcggggaaggagtcgggtgcgaggtgaggatggcgtcggcgaggtggctgggtgttcggcaacagcggctgcggtggtggtgaccgtgtctgcggccaccgaaggcatggcggcctcggacggctagccgagggcgtgggagacgactacatctagctggtgcagcatcgtttgggtggaggggtcggagaccagcttggcgcagagaagcgcagccgatggcagcggaggctggctcggcgcgagaggcgcgggcggcggagatggaggccggcttggcacggaaggcatggccgatggagggaggctggattggcgcgagaggcgcttccggtggaggaggccggcttgacgcagagtggcgtggccggcggtggaggaggcgacctaggtgtgaggaggagctgtcggtgggtgtggcgcggtcttcggcgcacgaaggctggccggcaggggacgccggtgcagaggtcccacatgtcggcaaagcttgtgtggtggtggagcatcagtgcgtcagccgtggattcacaggtggtgaacggtgggtgaaaacccagtccagccttggtcggactgacaacgatgtcctgagggagttgttgcgctgtctcacccctcaaggatgattgccgagcgaaagcccagtcttggctcttttaagtcttgacagacgacggcagcagtttttccgtcgcttctcttcttgaagacgttgttttggcatcctataggggcaatctcgcatgtgtccctttgttggtctagtggcggtcggtcacgcttagcagcggccggtccggtgttagccttctcctgggcttgttgttggcgatgtcgccgtgtgggtggtggtatatttggttgtaatcttgtaattttttcctgctctatcaatagaacttcgcaccgtctcgtgcgagtcgttcaaaaaaaaaaaactttctagcaaaggaaagagatctaagatagtagagagtccagcattggaagagtggagctagtatggagaggacaggctacctgcagtgatgaacggcgtcgatcaccaccggtcgccagacaaagtggggagcgagaggataaattagctagaggcatttcggtatgggcatatgtgaggaaaattgggttaccattttaatttggaagaaatttcgaaatgtcattctggcatcggcccctaagttggaaatagcattccacgaaatcaaattgaagggc

SEQ ID NO: 92436 - DNA, 1271 bp, Oryza sativa
  unsure (1)..(1271): unsure at all n locations
gccgggatcgttcaagaacttgacgagcctgaagacggtctggctggcgcagtgcaacctcaccggcgatttccccagctacgtcacagagattgggaaaaaatgggggggaaaaggaaaattggggggnnaaagtatttctcgacccctgtcccagaattcattcaccggaagcatacctcctgggatttggaacattccaaagctgcagtacttgttcctgtacaccaaccagctcaccggcgacgtcgtcgtcaatggcaagattggagcagcgagcttaatttatctcgacatatctgagaaccagctgactggaacgatcccagagagctttggaagtttgatgaacctaactaacttagccttgatgacgaacaacttctccggcgagataccggcgagccttgctcagcttccatcgctggtgataatgaagctgttcgagaacaatctcaccggtcagattccggcggagctcgggaagcactcgccatttctgagagacatcgaggtcgacaacaacgacctcaccgggccaataccggagggggtctgcgacaaccgccggttgtggatcatctccgccgccggcaaccggttgaacggctcaattccggcgagtcttgccacttgcccggcgctgctgagtctccagctccaggacaacgagctttccggcgaggtgccggcggcgctgtggacggagacgaggctgatcaccgtgctcctgcagaacaatggacacctcaccggaagcctgccggagaagctgtattggaatctgacgaggctttacatccacaacaaccgtttcagtggccggcttccggcgacggccaccaagctccagaagttcaacgccgagaacaacttgttctccggcgagatacctgacgggttcgccgccgggatgccattgctgcaggagctggacctgtcaaggaatcagctctccggggccatcccggtgagcatcgcgtcgctcagtggcttgtcgcagatgaacttcagcaggaaccagttcaccggcgatattccggcgggattgggctccatgccggtgctcaccctgctcgacctttcgtcgaacaagctctccggcggtattccgacgtcgctgggatcgctgaagattaaccagcttaacctgtcgtcaaatcagctcaccggcgagatcccggccgcgctcgccatctccgcctacgaccagagcttcctcggcaaccccggtctctgcgtatcggcggcgccggcgggtaacttcgcgg

SEQ ID NO: 92437 - DNA, 2134 bp, Oryza sativa
caaggtcgccgacttcgggctcgcccggatgctggtccaggccgggacgccggacaccatgaccgccgtcgccggatcgttcggctacatggctcccggtaattcccctcaaccaacctcgctgctcgtctcacgattctcccttgatttcttctcttagccgagcgacttaccttgtgctgaccacgatcgtctcgtgcagagtgcgcgtacacgaggaaggtgaacgagaaggtcgacgtgtacagcttcggggtggtgctcctcgagctgatcaccggcagggaagcccacgacggcggcgagcacggttgcctggcggagtgggcgtggcggcacctgcaatcgggcaggagcatcgccgacgcggtggacaggtgcatcaccgactccgggtacggcgacgacgccgaggtcgtgttcaagctcggcatcatctgcaccggcgcgcagccggcgacgaggccgacaatgagggacgttctgcagattctggtgaggtgcgagcaggcgctccagaacaccgtggacgggaaggtggcggagtacgacggcgacggcgcgccgtttctgccgatcaggggtggcagccgccggaagcagctttcggacaccaaaggcatcgacgacggcaacggcagcttggacagcatagtatgagaacaatggtcaataagaagtataacctgatccaatggttaccatctaggagagatggcacgctagttaggagagcaggtagataccagacaaatacattcgccatccttcagttatttgcatgtaatgagtattgtaactttgtaaatgcatctataaaattttgggacagtgagagtgcagtcacatacatatatgagatcaaacaagagcaattagattatgtccccttctttattacgaagagaaaatacagagcaaaaaaatcttggttctcaacatcaattaagggggaaaagaatctgacagaacaggaatggaaattgcctgtgcctccatttccctgttagtctgctactgccatccaacgttttatgccattagaaaacctccaaactcattggcgctatactagctatatcccgctgcagaggcacttatgtttgccctcagaatagccaaaaaaagatggtaagatttcaaggggggagccaggagtattatgtggattttgaagggggaaatgagaacctacaaacggagtttgattcatcattcatcaagatcatccttaaagctagtcgatctcggcatactgggagtgcgaggctgcgagaagagcagctccaatgccagaaccatcgttggccagcttggtaaccaccgaagacgagacatcatccccaagaaggtctgttagagttgattctaagcaactgctgaacttcttgtaatgttcatagagcccaccatccaaggcaatgacagtcctaggcatcttactgccgtcttttggcatcttgtcccgacctagcttctttaggaccccatatatgccagcagcagccaagcgtgcagcacgctctgcaactatgtcacaaatgtgactggtaatgtatcttacttccagggaagtatctgggacctgaataaaagatcaaatcataaataagcaaccagtactcattgaacagtgttggatgttgcgtatccactttgggtcaagaaatttcataccccgacgatatcctttagcttagctccaacagttttaaggtcatgtgacgagtcatgatgcatggctgacatatccggtgtcctgtgatacaacaattgagatacttataaaaaattctaccagagttgcataagattgaggggttagaagcataaagaaaaactggtgagcaaaaaccaaaccaccctaattatccaagctagataacttctagttgcacacaattatgagaatcaaccagaaccagaagaaagtagtaatggataaaacaacaaagtgtatgtttgtcaccttccatggatttgctaactgatttagcatgataatttcaagatatacaaacaacttccccttccataatctatctgggtatattatcaacagtgcgaatattataatggaaacgatgccaacgtctttatatcatgtgcactcttatccagggctgcaggaatt

SEQ ID NO: 92438 - DNA, 1393 bp, Oryza sativa
taatccctgcctctccatggccttgcccaactcagatacaacatcttcgccaacctaattcaggagataatatagcaaaatcaaattattcttattggatgcttgacagttcacacagatatgatcaaccaggcaaacataatactgagtactattaaagatcctcaaattaaatatgcttcctgatcaaggtcgatatttcttttcactaacctagttaagttgattacaatgtacacaaagggagattgtagcaaatagctaattgaaatactccattgccatattcaatcaagctttatcaaggaaccttgtgacataattcatgtgtttaaagaaggatcaggattgtgttctagtcagggtatgtccaaaagttatttttgacttttaccgcgtcattgatggagaaaccctttgtccacttgatgagcgttcctgacgatattgatgtctggctcactgggaaggaaaaggtgaagcccagctctctctgtctcccttctgggaggtggaaatcatcaccttcagtatcaacaaattttgacaatgcagaagcaataaaatcaaacagttcctgcattaatagtcagaaaatacataagacaagcatggaatgtacagctccaagaaatttaaaatcaagcagcaaatgcttaccatggaagttccaaccatcagatgtggtggaattgagacttcctcgtactgttgttggacgacacgtttctccttgccaccgagttggactcgcaggacgcggaagttggttcctccaagatccaatgcataaaacaacccctgttcatttctgcaaagggaaatcattatgatcaaagaatgaaattactacttttggaagaaggcagcaggaaacattgtatgcttatgggtgagtgagttctaacagactggtagaaggatccgatagaataagaatgaatcattatatttaagaaacttccttcaggatgtgcctgccacatttagcttaacgatgtggaggttacagagaaacttattaccagaccaactataccatgagataagctcgactgatggatctaattggtcagattgctaacaaggaaaccacaatgcaaagaaactctctgccatacattagttaattacctgtcactgaagccttaacaaatcaaaccaacaagaaattaattaatcacatatcataatcagaaatcctaaagagccaaagtaggaacaaatggacgatcaaattaattaatcacatatcataatcagaaatcctaaagagccaaattaggaacaaatggacgatctactatagatcacaaaaccgaagatcatctgagaacgataggatatgttgacgggagacctatctttcctagcttagataggccaatttatc

SEQ ID NO: 92439 - DNA, 1484 bp, Oryza sativa
tcatgatccatgtattgatgttggtgtggtgttcccagatgtgaatcaatgcaagtcagcagttacacatcattgtatcttgaatgatcatgcttttgacattatcaagaaagacaagaaaagatttagagccaaatgcaagagtgcggatcaaggttgcaagtggctgtttttgcatctactagtcccaagtacattggatgtaaggtaagttcagatttgtatttttttagttcttttctgcattaagtaatttcagccttgtccttacttaacatgaattttgtctatgcactctatggctgcaggttaagataagtggaccaaagcacacttgtggttcttttaataattgcggtgaaacaatggcttcaaataaatgggtagctgaccgagtagttgagttgctgcgggatgacccctcattaggacctaagaaactgaaggaagagctgaagaagaaatactcagtgaatataccttatttaagggttttcggaggcaaggagagagcacttgacatgataaatgtgaggtgggatgacagctataacttgttgcctacttatcaagatgagcttctgagatcagtgccaggcagtgtagttaagttggacactgaagagaataatggtgatgtgtgctttaggaggttcttagtagctctcaaactatgcattgatgggttcttgcaaggatgcaggccatacattgccatggactccactcacttgacaggaaggtctagagggcagttggcatccgctgttgcaatagatggtaataacaggctatttcctgtcgcttacggagtgattgagacagagtctaaggaaagttggacttggtttgtccaaaatttgaaggaagctattggtacccctacaggttcgtattttttcttacatctttcatctttcatccttcatgttgcatttgcatattattccagttgctaactacaattttgtaccattgtaggtttggttattagtacagatgcaggcaaagaatagagggggctgtagatgatgtatatccaggagtggaacatagggaatgtatgagacacttgtggaagaacatgaagaagaagtaccatggtcctctgtttgcccaaaatatgtgggcagctgctaagagcttcacaaatgtgaagttcacctaccacatggacaagataaaggagaggtgccctgaagccctaacctggttagatgacaatcatccatacatttggagcagaagcaagttttatgaggagtgcaaggtagattacatcaataacaacctctctgaatgtttcaatagttgggtctcaaaaatcaaggatcgtcagattgttgacttgcatgacaccataagaaagatgatcattagcaagtttgtgtcaagagccaagcttgcttgtaaaatggatgaaaggataatcccatctattactaacactctgaatgcaaaaagcaagaccctcaaaaaccatg

SEQ ID NO: 92440 - DNA, 2347 bp, Oryza sativa
  unsure (1)..(2347): unsure at all n locations
atgatttgaactatggcagtctctcatagcaaagcgtagcgacatggtagtgatgtctactgatggtcctcttggtgcgtatgtcaatcctcacggttttgtccatgaaacaatcacagttagcagggcaactgggcttgctcttgatggcaatccttcaacggttcacagctggtttccagggtaaatctacagtttctccttgttctttgtaatcttcatgtccatcatacaccctttaactgtaaaaaactaagttcatgcatgattttcttcttgtaaccaactttgtttctgctgctatgcagatactcgtggacgattgcatcatgtacggactgtgagtccaacataggctggttgttcaaagcaaccaagaagaatctgcgaccgagatccttctgggggatccgtagctcccaaattgcagatgatgcacaagaactagatcaggacgaatgatgctccgtgtacagtagtaaactttgtgtgcccctccctttttcttatgaagttatggaaaacactttattctctggtccataggcctagttctccgtacctgagtagtggtcgttgtgacgatcgctatagaataaccacttcctcctgtgtgtattacacaaccattgccttatgctaaagttccgtcacagaattttctgaaatgtagtgttactagaaatccatagtacaagatgaatgatgatatgatcagatgtttcaagcaatggtttgacatgtcttatgagcacatagaagttgggcttgataccttcacttgaggcaaatactcgtgctgtagtggtaattggtaaactggtactggtagtgagctagcactggcagtgccatgtttttgctatctgtactgaaattggggccaattgcacctgacgagcagcaactcaatatgggcatatggcatcctttttttccctgcgtattgtccttttgtttcagccacagtagcaattggccggtattccattgccacctttgatgagagggagggagagagagacctcacgggtggcagcaaaggcaaaggagcagcaagaagccgacagagaaagtaaggccatggtagaatgacaggtgaggaatcgatcagacgggaggaaaacaacaccgaaaaggaatgcacttctctgcttttgtatatgcatgcacctctacctacccattcgcgatgcaccaatgaaatacgttgccaaataccttaaaatacctagtctattgncaggtgatagtaatattgacactagtagttctctaatctctagttgctagtcttgtttatgtctattttttcttgtagcatagtagcacatgatcgtagtaatgctgtatgattgatgattggatggcatggaactatgaacggatcaaacttatctcgataatatggtaataacaaggagatgtagacatgtactccagcattgtagtcagacagccgaatcacgaagctagtgtggaaccatgacagaagaaggcactactcagaataaatccagtcacgggtttaaaaaaaaaacagagagagaggagaatcatcatcacaaagctaatgcaacaacagcacaagcgtacttccgcatgagaccaagcaaggaaaaaagaaattccaaactgtccccaagaaaattcctgccccaggagagcacagcgccggcctgtacaggtcatcgttcccaataagacagggggaagctgagaggcaaagagcaccaccaacaacgcgtgcactgaattgcattgcacatgggacatggcaaacaccggcgcgtcgccacccgcgcatgcacgcacgggcgcgggcgcggccacgggcacatcctctcctgcgactcgtgagccgtgtcattccatcgcggcttcctgctcgatccgctccctgccatgcccgtgaccgtgatctccataaattcccccaccctgtgcgcgatgcgtctatcccccacgataattagtaggcctgccacctcttgccgcgagcaagacgaccacaccaccaaccaccatccatggcggtgtccgtgtcgtggtcgtgggcgccgcggttcttggcctgcgtcgcggtggcggtgttgcttgttacgtcgggtttgggcggtgcggccgccggcggcggcgggcgacgccatgggcacacgaaggggttgcggccggggaaggcggcggcgaagccgtactatccggtgaacgcgacggcggtgaggcgatcgagcggcagttcacgcggtgggtgcggtccatggtcgggcgacgccacagcacgttccagcgcgcgctctaccgcgggctgctgcccacgcgcaccctcgtcgtcgacaagaacccc

SEQ ID NO: 92441 - DNA, 2954 bp, Oryza sativa
cgtcactcacgtggctacttaatttggtctctgtaattttcttccacacccccaccgtatccagagcgttcgtccgaatgcctacaccgatctccccgtgcaccgtgcagtgagaaggtgaccatctcgccgctccgcgcgttcgtgaccatcgagggcgccggcgcggacaagacggtggtgcagtggggcgacacggccgacacggtcggcccgctcgggcgccccttcggcaccttcgcctccgccacgttcgccgtcaacgcgcagttcttcgtcgccaagaacatcaccttcaaggtgagcaccactactacactacaaatgcggcatcatttgtgccgtggcgtggctcattcgtttcgtctgtcgcgtgggcagaacacggcgccggtgccgaggccgggggcgctggggaagcagggtgtggcgctgcggatatcggcggacaacgcggcgttcttggggtgcaacttcctcggcgcgcaggacacgctgtacgaccacctcggccgccattactacagagactgctacatcgagggctccgtcgacttcatattcggcaacgccctctctctctacgaggtacacacattgcttctttctcttggttgcatacacatttcctccatgaacattatagcagggaattgcatgcaacccgggtgattaggttgaaggtttgttgctaaccaagatagataatttaattagcgcctgaaatcgagtcaaacaggaaatctatgctcaatcctgtgtgtcagtgtccagtgctacagcccaaatgcacaacagatacaccgtgtcagtaaacactggcccgcagctttctgacagggcactggcctactgtggcacctactacaatgcaccacactggagtcacacagaagaaagaattctactatcgaccactgttaaaactcacagggttacagtagaggcaaaccactattatcggccacattagccccccgatcttgtgactggccctactacagctacacgaaccagatggtgccaatgcgttgtgcatgcccgtgtggcacttcgtttaatgcgaaatccaacgcaaatggaatgttgatgagcccactagtaatagcatagtgagtaatcagcctttcggtttttaagaggagtgtggtaaaacctgcatcgcttgtcgttggcgccggcacggttgccggatggggttttctggagcccggcaggttctctggtccccctggccccaggcgccgtgaccgctacggcccgtgacgcccatagctggacgtctcgtgccgtgcgtaggccccaaaccgtagcgtatgtgtatagccaccagtctcctctgcaaatcctgctcactttggtcgtacactttaaaatctggtactagtccaacactactaccagtagtaaccgacttttttttttggtcagaaatcaaaaattgacctttgggacgatagggtcgtccaagctccaagggaaacatattatctgctgtaccgtgctctaactttaagtgattgatatgtgtactatcccacatctaatatgtccacatgtcaatgacccattcacccatatcaaaggatagttctgtagagaatactcatccgtcgtgcaagtgcgcaacgcacctagcatggttcgaatgctagactttgtaatagtattcaccgtatttcagacattcagtaatactccacacaccacactagtggttattctaacgtgtgttacagtgtgtgatcgtaaagaatactagggtttacgcaaatatttgatcagaaatcctttgccgtgtattactttggtcatgtatgtactcagtactcacgttggtgacacgattgcagggatgtcacgtgcacgcgatcgcgcggaactacggagccctgacggctcagaaccggatgagcatcctggaggacacgggtttctcgttcgtcaactgccgcgtgacgggctccggcgccctctacctcggccgcgcctggggcaccttctcccgcgtcgtcttcgcctacacctacatggacaacatcatcatcccccgcggctggtacaactggggcgatcccacccgcgagatgtaagtagctaccactagtacagaatcgaacatcgtgaacgatcatatcactactattataatgatatgtgggtctcatcctatcataccccacccatcaatatttgtgatgatagcgtcataatggtagaggatgtgaaccccattcacccctcacatccatctcgttcttgtgttttttcgctaacgatgctggtgttttgtgtgtggttggtggcggtggcaggacggtgttctacgggcagtacaagtgcacggggccgggttcgaactacgccgggagggtggcgtggtcgagggagctcacggaccaggaggccaagccgttcatctccctcagcttcatcgacgggttggagtgggtcaagttgtagcaccacgtaggagagaaacacagctcactcgactattagttaacttgtgaagagaaaagaatagaacagaagaagtggcagataaacactctgatttgattcgattgcagatttcaactttgcagttgcattgtgagacagtcctatactgtgtccggccttcgcctcggttttgttttggactgcaaacagtataacatcaacttaggcccactggcccaggcagtagagaggtagcaatcgatgcgatctccctgctcagcctagaagcccatagagaattgaagtggggaaataggcccagaaaaaggttagagtagtgtagcagaagtgagcccaacaatcacaggtgtgttgcttccatgttccaacacgtatagccttttcgaacattattccttttttttcaaacattattctagacagacattttaatggatttctgcaaacttttagtagtagtagtattatagacccagtgaccaatctct

SEQ ID NO: 92442 - DNA, 688 bp, Oryza sativa
aatctgggcgccgagcgagagagctcattgggcaacaagacgtcgatggaacagcggtctttcgcaccccccagcagaacgcggttacagcaatcactctcctcgacaccctcctcaaggaagacgcactcaaccaagccgatcatgttgtcaacatcttgaaccagacgaagaccatgatcgctgcctcggttccagccaactccgcaagcacccgcaccccgactggtagccgagtccctcacttccgatctcatgattatcatcagccaaccctcagtatcatcggcacaggatctagtcacaggagcaggggtcacgacgaacgatttgttcactcgcctcccgaacgtcacagggagcgccgggtcgaacggcctcgctctccacctcaccagcgtcccgtcgacctttgcaacacgatcaaccagcgccgtgcagcacgaggtcaccgccattcaccagatcgctacgacgacgacgtggacggagtagctgccttcactaatgacctgcgttgagtggattggccagccggctttaagccaactggaatcaagaagtatgacggcaccaccaaccctgagtcttggctcaccgtctatggtctcgcaatccgcgcagcaggaggagacagcaaagccatggtaaactatctacctgtggccctagcggactccgcccgatc

SEQ ID NO: 92443 - DNA, 1273 bp, Oryza sativa
caggtaaatgatcctgaaatagctgagctaaaaaagaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtacaaaaatgtaccaggacctcaaagagaaattctggtgggtcagcatgagaagagagatagccgagttcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcggggcacgattcaatctgggtggtcgtggatcgactcaccaaagttgctcattttattccagtacacaccacctatactgggaaaaggttggcagagctttatctttcaagaatcatgtgtttgcatggggtacctaagaagattgtatctgatcgaggaagccaattcacttcaaaattttggcagaaactgcaagaagaattggggactcgtttgaatttcagcacggcttatcatccgcaaactgatggtcagaccgaaagggtcaatcagatcttggaagatatgttgagagcttgtgcacttgattttggtggagcctgggataaaagtctgccttatgcggaattctcttacaacaacagttatcaggctagtttgcaaatggcaccgtttgaagcattgtatggccggaagtgtcgtacgccactcttctgggatcaaacaggtgagcgccaactgtttgggacagaagtgttaaccgaagcagaggagaaagtcaggaccgtcagggaaagactgcgaatcgcccagtctcggcaaaagagttatgctgataaccgccgaagagagcttactttcgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagcttgagctcccatctaatatggttggtatccacgatgtgttccatgtatctcaattgaagaagtgtttgagggtacctgaggaacaagctagctcagagcacattgacatccaggaagatctgacttatgtggagaagccgatgggctgcaggaatt

SEQ ID NO: 92444 - DNA, 1166 bp, Oryza sativa
atctaaagtactttaagcacaacttttcgttttttatatttgcacaaattttttgaataagacgagtggtcaaacagtgtaagcaaaatgttaaaatcccttatattaggggatggagggagtacatcataattcgatatgcaattggggaacttgtggcaatgaataactgaaaggaaaataaaatggctacatatttgtaatggtgacattattattatttggccagtgctttagtaagaagtttctcatctgaagctcatttggtaaataaataatttttcaggtatagcacagactttggtaagaacgagacggaagtgctgaagcatgcggcaaattatctggaaccagcagagtcggagcaattcttggaactacttgcgaacactcaactgaaagtcttgtatcaaccctatgactggagcttaaacatttagctgcagccatggtattcacatagatgtctagttatacttgaatacctgtcacagatactcgtggaagatcacgacttcttttacaccagaattttcccaagagttggtcacagctctggatgctgttttgttgtggcacaaagaaatgagtaccaatccaactctgttcgattcactggacaaaatgtgtgccttccttgtttcttttggacgttctctgttgcggccattcgtttttttggcggtgaatagctgaatgatttgtgatagcctttcaaggatacacacgaatgaattagctagtgttataaagttaaaattggatttaaaatagttttccaagaaattcaaaatatactagtagtagaaagttattttttttctttttccaaaaaaatgctcaggaagcgtgttgccattccattcagaggaagcgtgttgccattccattcagaggaaaagtagagccatgcttctggtgtccaggaatgtgtcgagtcatatgctcctaaatatgcacgcgtgctgattgagtaagagcatgctgtgaatgcttgtgcagaagtacgcattgccaggctcacagggtttacaaaaccataagcttatcaagtgcggtaatctaagtttttgaagaaacggtatatctcgcggggtttacaaaaccttaaaattatcatgtgtggtaatcttagtttttaaagccacggtatatctcgcgataac

SEQ ID NO: 92445 - DNA, 9461 bp, Oryza sativa
tcgccggcctcggcatcccgcgccccgacatcgccaccgccgtcgccgccgacccgaggctgctgtgcgccggcgtggagggaaacctcgccaagcgcgtcgccgagctcggcgacctgggcatcccgcgctcccagatcgcgcgcctcgtccccctcgccaagatcccctttcgcagcagctccctggccaccaacctcgcctttggctcccggtgttcggctcgttggacagcatcctcagggccctcaggaagaactcctccctcctcagcgccaacctcgacaaggtggtgaagccgaacctggcattcctcaagcaatgcgggatagatgcccgtgatgttgccagcaatccaaacctgtactccagccggctgttcacctcgaatcccatgaaactccgggacgccgtggcgcgagtggaggagctaggcatggtccgcggctcgagggtgttccaccgtgggctcgttgcggtggctttcctaagcaaggaggctgtcgcgacgaaaacacggctgctggtggagcttgggttttcgcaggatgatgtttcggtgatcttcaggaagatgccatccttcctgaccgcatccgagaaaaggatacggcgagccgtggggttcttgaagggggatgttggtctggaggaacggtacattgcgcgaaggccggtattgctcttgtatagccttgaacggcggctattgcctcggtattacttgctcaaggtcctcaggacaaagggattgctggattgcaagctgtgttactactcaacagccgcactgggcgagaagaagtttatagaaaggtttgtgcatccttatgaggaccacattgcaggccttgctgatgcttatggctctatttgttccgggaaagtagcaaatggagttgctccattgcttggtttgtagactgaaattgacggatgtaaaagtttctgctggggattttggctagatcgtcgcacaggaatgcaaaatattaaggtttgtggacccttggatcatcttgtactatgttaaagcttgtgctgaagaagtatgtaggagtaggtttgttacttttatcttgtagctctgatggttgaggatgacaatggttaatggcaatggatttggaacaaaaaagcattaagattttatttcacggactaaaccaacactggctgatccaagctgttgggctgaaatattcaaattgggaatttgctttgaaaaataaatggtagcacatgtactcttgacagaaaatatagaagattaccacaacttaacacattccaaggatatttctgtagtactttctgaccatccacattagatttggtagcaactatcgcaggaatgtgctcaaaatacagtcgtgttggggctttaattcaaatattttctgataaaccaggtggccaaacatgagtggagccatgctggggctgttcttgttttttttttctctttgggatgacaattatcaaatgtgattgaattgtaggctaacatgagttacaggttgacaatcatatggggctacggggttcctgccatgatgtctccctgtgcattcactctttgatgatgtgcccaattttgaagagaaacacacaccaaagaagttgcatttgtgattgtttgctcaaaacataccccatttcctcaatttgaatttccatttggcccaagcgtaaagcaaacctatgaactatgaagtgtatgcagcgggatattatttatcccaaagcatgaaccaggaatgcattactgacaatgagccaccacacgttcaggaaaaaaaaatgttgtatagcctgctgataatcacaaaacggacaaagggcacacttaggagatcaatctgtttcattttggcagaatctttggtgagaactgcattgcaattaatcatccatgtaaaatttctgactgttctgcattgatcgctccaaaacgcttgtattttatacacgatgagcgcaggccaacgcattgctttacctctgtcagaacacaagaaactggatgagctccaacttagttcagaagaattaattaaatccaatttggttttgatcaagtttatagaaaaagtagcaacatctacaacaccaaattagttccattagatgtaacattgaatatattttgataatatgtatattttgcgttgaaaatatcattatatttttctataaatctggtcaattttttaaaaaattgactagagaaaaagccaaaacgagtatgaagagggagtagggtttcttttttttcttttacaggagtagttttgttttaggctgtgtttagatccagcggtgaaaatttttaccgtgtcacatcggatatacgtacacacatttaaagtattaaacatagactaataacaaaacaaattatagaatctgtaagtaaaccgtgagacgaatttattaagcctaattaatttgtcattagcaaatgtttactatagcaacacattatcaaaccatggagcaattaggcttaaaagattcgtctcgcaaattagtcacaatttgtgcggttagttattttttaacatatatttaatactttatagaggtgttcaaacgaattttagggtgggatctaaagatggccttaaaggagaaacaaacgtgagaactggaaggcctaggcctttttccaaattaagcccaggagtagatgtcggaaatgtcgaaaaggcccatctacagtatacacaccgtctctctcggaagtctggaagcaagcgaagctccggtttcaagcggcggagcgccgccgccggcaaccgccgtgacgccatgattcacctccggaggtgcgtcctttctcgcctcctccagccaccgtgcctcaccgccgccacgcacgccaattccctcctctccctccacctccgccgcctcctctccggcgccgccgaacccttcgccgtcgaggactacctcgtggagtcctgcggcctgacgagagcccgcgcggagaaggtctccgggaagctctcccacctcaggtccccctccaagcccgacgccgtcctcgccatcctctccggcctcggcctcacgcgccccgacatcgccgccgccgtcgcctccgacccaaggctgctgtgcgcccgtgtggacaggacgctggatgcccgcgtcgccgagctcggcggcatcggcctctcccgctcccagatcgcgcgcctcatcccgctcgctcgcggcggattccgcatcaagtctcttggttcaaagctcgccttcttggtcacagtatttggctcattcgacaggtgcctggaggttgtcaggatgaactgtgggcaattaagccgggaacacgtctatttgctctcgcagttgtgaagtttgcaatcctcagccaggggaagatcaccaagaaatcagggctgtttaagaagcttggatggtcacaggaagatttgtcattagcagcgaagaacatgccaagtatccttgccatgggtgagaaaaggttgaggcaaagaatgaagttcttgacggaggatgttggtctagagataccatacattgcacaaaggcctgcactcatgttttatagcattgagcgccgcttattgccaaggcattgcttgatcaatgttctcaagaggaacggattgcttaagatcaattatgacttctattctactgccttgattagcaatgagaaatttctggataaattcgtgcatccttatgtggagagtgttccaggcattggtgatgcctatgcttctagctgtgctggatgtggagtggaccagttgaagctgttatcgaagaataagataatgtgctgaagcttcttctattaacacccacaagctgggacaatttttaggttagttatcagtttggtttttttacttctagagccaaacgaaattgagctttgctctcgacaagccaaactgagattcaggtctcgattaaggatgtcactatgccaatcaaagactgaactttctattaaatggatttatctataaatctttatgaagtgagctgacgtattttctagcactaagtcgattgaattgttatagttctgtcactgttgctctgatttatatggctcagcaacagtgtttaatatttagggatcaaactctcttgttttttctgttgccttgttccttagttatgtgaggtaaatttgatttagtttatatgttctgggaaactcactgttgcaaatgcttgaaacttgtcctcttgatgtagagttctgatcctaaaaagttgcttttgtgttactactcaaaatgatctgggaaaagattgatgtgtactccacaatacacaacttggacaacaacaccacaactggaggtctggacaagacaattgggtgttgaacaacagttcatttactacagtctacagtttctaggatgccatccagtaacaccatctgctatgctgtttgaactttcgtgatctaagtatgttccatctttttgatagcgtcctgcaattttgtgcattggagcaaattctagtttctttcacttgttactacaaatttatccttgaagaagacatgttaatgatttcgtcttggatatctaacaaatgaatggtgctgtcgcattgatttttattgttgctaatagctggcagaaaatgctatcaacaaggggcagttaacaattcagaaataataataaaaaggaaattgattttaagcattgctgagatatggtccaaattcaatactgttggtagtgagtcatctaagtaaacccaaatttgtgacttttgtgaaattattgataacatggattttttttgtcatttgtctttctttggaaacatctaaagaatgaggtcaggtcaccatcataaggtaagcttgagaagttgagagcagcaccaattcaaaggttctagatggttcatgcatttttggtcagtatctattttattgacagttaaaatagttggttgaggccttgagggatgcttctggtgttcgtattgcctaacagaattccctatttggttcctgttactgttatgaccctagctgcctgctttgcggtcaaagattttgctttattttgttcagacatcaaagttgaaacttgaaagttaacagctggtttccatttctacgtaatttactgtttcgagtttgtagtaactttatttataaatcaccaaatcggtgtatgtgtgtgcctcggtccgatatcaggatggttggtgtgttaccttgaaaaatagttcacctattcatgacataattgggtgttcttttagaatcttagatatacataatatgggcatgacccgttgcaaagcactggtatattactagtgtaaagaaaagctacactgatacatactgcatactactatctatcatactccattatatacttcctccatctcattttaaatgcagttgtgagttttttttccaatgtttgaccgtttgtcttatttgaaattcttttataattagtatttttattgttagtagatgataaaacataaatagtattttatgtatgacttattttttttcataaatttttcaaataagatggatgatcaaacgtcggacacggaaacttacaactgcacttaaaatgagacggagagagcattgtaccgcaacttctcgttttgtgtggtactgccacctagcacatctatttcaagaaagattttcatgttcaagtgatcaagtgacgttctcacatctgagacaatcttagtaatatttgcaaattcgataggcgggtacttctgaaatttgaagactgtaaactgaaaagttcggactgagtgatagcccccaacaagattcatggagcaattggctgtaagcattggatgtttggatctatttgatgcaacaatcccaactgtgtgaatttgtaaactatagctgtgatgcatttcttgcaacaagaggacttcttgaatagaccagcggctttgatatacttttagtacttggtcatgcttttattatggagtttccttcaaatccgttgagcaatgatggtggatacttagacatgtattttcatgaggtttaatatcaggagatagtaattatacacatgtattaattacagaaattcatcattgacaatgagccatcacacattgagatttttttttttatgttgtatggcctgctgatggtcacaaaacagacaaaaaggcacagttaggaggccaatctgttccattttggcagaatatctatggccaaaacagctctgtaattattcacacatgcaaaatttcttacttattgccatgcattaccactccaaaacgcttgtctagttcagtacttcaattgcctgccgcaatcagcccacatccgaagattaggcccaattatgttctgatcaatggatcaaatccagtttacataatgaaaaaataggtatcttatcttcttatcttaactattctaaaaacatcgttctcctttcttcctaaaaaatctccctccttaaaaataccttccaaaaaaaacctgctcccctttcttaaaaaaaacattcctaaaaaattatcgtaatctagttacagtgtacgaacaagtaattggcataagcggctgtttggtgcacatggcgcagcagctacaccaacaataccagcattaaaaaaaatgaatccgttgcagcaaagccccactacaaagaggtaggcacaggtggcgatgacggtagtggtagggcggtgcttgtggcacccacacggttaaggaaggtgataataggaaggctggcccgaccgacggcacgggaggccaacggtagggaggccggcgtgcttatggcagggatgcctagcgaggggggggggggggcagaggatggccggtgctagagcattggcctgttaactgcgggttgatagggggcggacaacaggtgtaaaatctcactcggccttgccaggccggctacgacggcgttttaggcgtcgttttttctctgggggccgcgatcgagccgcccctctccctcaagtgggctgctgggtgaaaccttgttttggctctcctcaagacctcgacggatgatggcgtcgggttcatcgccacttttttctctggagacatcgtctaggaggcctccccagcttgtgcgtgcttctctagatggatgtcctcttatcctctcgtggcagtgccctagtcaatgctagtcttgtattttttttctctattctcatcatagtgtttggacgttaaaaaaaaaactatggatatatgaaactggtttttcaaaaagaaactcagaggattggaggagagttagaatcgggcgcccgatccaaattggcaaaaatcgggtgctaacgtgcgtggaaaaccactttaaactaatttttctcttaaattatttatccaaataatgatccgattgtaccattaaatttattgcaattaaatcttcaaaataagaccacacatggatatattccgatgaaattttttttagcttattattgaattatttttaaatattgcacgatgtttcaccaagtatatcggaattgtttcactaagtagatcgaaaatattcaatcgtttaaatcgggcattgtttcaccttatataaaaacaatgtttcagcaaatagcgaaagaatgtttcagtttagcgcaacatatctatacatagtaaaatattctgagcacactaggtggaacaaattctcttaatagagagtttccaaactatatgggttatttgttgaaaaataatatttcgttcactgtgatatgtgagcgtctgatttttactccccgccggtcgcgcgaggataagcattctcgcagagaattgatcccactggaaggcctcgtcctcgtccaaattaggcccacaagtaggtgtccggagcttacaagcgaagcgaagctgcggtttcaagcggccgccggctaatccttgcgccgccgccgcccgccgcccgccgccatgattcacctccggaggagcttcctttctcgcctcctccatccaccgtgtcccaccccggccaatcccctccccctccaccgcctcctctccagcgctgccgccgccgcgcccatccccccggaacccttcgccgtcgaggactacctcgtcgactcctgcggcctgacgagagcccgagccaagaaggcctccgggaagctctcccacctcaggtccccctccaaccccgatgccgtcctcgccttcctctccggcctcggcctctcccgcccggacatcgccgccgtggtcgtcaacgacccgctcttcatctgcgccagggtggacaagacgctggccacccgcgtcgccgagctcaccgacctcggcctgtcccgctcccagatcgcgcgcctcatcccggtggtccgcagcctcttccgctgcaagtcgctcgccccaaggctcgccttcttgctcaccgtgtttggctccttcgacaggtgcctcgaggttatcaagaccaactatggcgtccttagctccaacgttgaggcggtcatcaagcccaacctcgccgtactcaaggaatgcgggatatctatagcggataggccctcatacgcgttcgcatcgcgggtgatcagcaggcctactaagcacctggaagaagctgtggtgcttgctaacgagtttggagctaagcagggaactcgggtgtttactaatgcggtcatgatttttggaatcctcggacaggagaagctcgccaagaagttggagttcttcaagaagcttggttggtcacaggacgatttgtcattggcggtgaggagcatgccacacatcctagccatgaaggaagaaaggatgcgtcgaggtatgaagttcttgaccgaggatgttggtctagagataccatacattgcacgaaggcctgcactcacgatgtatagcattgagcgccggttgttgccacggcattgcttgatcaatgttctcaaggggaacggattgctcaaggccaattatgacttctataatatctctgtgattagcaacgatgatttcatggaaaaattcgtgcaaccatatgtggagagtgttccaggccttggtgatgcatatgcttctagctgtactggatgtggagtgcaccagttgaagctgctctcaaagcgtaagacaaagtgctgatgtttcttctagtaataccagcaagttgggacaattttaaggttagtttatcactttgattcattcacttcaggagccaaatgaaattgggctttgctctcaacaagccaaactaagatttggtcttgattaatggtgtcactatgccattcaaagactgaactttctattaaatggattagatgaatcttaatggattgagctgacatattttgtagcactaagtcgatcgaattgctatagacttttgtcactgttgcttggatttacagtatatggttcagtaacagtg

SEQ ID NO: 92446 - DNA, 1721 bp, Oryza sativa
ctgctcgttccatttttgtaactcgttcatgctcgtggcgtcaaaagcgacggatggacttacctgtatagggggcaaaagaaccagataagtatcacaaaagcacagcacagtgaaacattggagatgcagtagccagtggttaggttatacctttgcttttgcttgcacaaaatcctccaactttaagggcctcaaagatatttttgtgccactaacgcctccctaaaaaaatggagatcgtatgaacaaacgtggggacaccacatccaagatgatgaacaaagcttaagaacggaagtacaaatatttacaagcatggacaaatcacctagcttgaagtataaatatttacaagcaaggacaaatcaccttttcttcttctagaagctcatgaactggtctgtacgcagctgcgatgcataggttctgcagaaagtgccacgttagtctccatacacaaaacaaacatggctagtagatgttttcttggaaagcaggaggttaagagttgaaccgctatggagggcttagcaataccttcaagtcactaccagagtaaccctcagttgcattggctagttcgtcaaatctgaaatcagattccaggttttcttttgcaagtaaaatcttcagaattttcattcgattctgtgagtccggaaggtcaacgtatatcctacatatcacattgacagaccgtcattttgatatactgaccaagcttagataattttggtaaaatcacacgattgcagatcttaccgcctaggtaaacgccgaattactgcatcatctagatcaaatggacggtttgttgcaccaagaataaggatcctttggttctctttggatcttaaaccatcccaagctgccatgaattcattccgcattcttcttgttgcttcgtgttcaaatgcaccacctcttgcaccaagtaagctatcaacctgtcattatcaaatacaaattgcattagaataaagagatttcgtatgaaattggaaaccacaagataatctcctgaatataaatgactatgccagtttcattaacggaagcaaaatttacctcgtccacaaatatgataacaggtgctagccgactagcaaaggagaaaagggccttagtgagcttctcagcgtctccaaaccactgtaaacagagaaatatatggacaagggctccatgagaaaagttttatgcaagggatggactgctaagttctgtgttgcctcctaatttctttcaagtggcaggcacacactcgcaaaagatggggaaaaacgttaaataaaagctgtactgaaattggtgtgggagctagtagagattttgattcagtgcagactgcagcaccagcacagttcatatagtcagtaatttgtccagtcaccatttataaaagaatgtttggcattatcatgtctttcattcacttaaaaactttgatgaaggggagaaaactaaatacagaagggcatagaaatctacctatggtgaaataaataaaagatttaacatgagtacatgactccaagtccaaacagttaaaaagaatcaaaagagtcagacagaacctttgatgtaagattagaaccagttatgctgataaaatttgctccagcttctgttgcaagtgcctttgccaaaagtgttttccctgtccctggaggtccaaaaagcaatataccttagcaaggctaaacaaaggtccatac

SEQ ID NO: 92447 - DNA, 525 bp, Oryza sativa
aatttgatattgatgctactgaattgcatggcgagttgatttttctccaaagtttcagttcccaagaaaagttgggccctgttgaaattttgaagtttttgaagcggcatgattgttttcccaatgcaactattgcatatagaattttattgaccattcctgtgactattgcatcgcagaatggagtttttctaaattgaagctattgaagtcatacttgcgatctacaatgtcacaagaaagacttaatggtttggctatcatagcacttgagggtggtatgctggggagaatcaatataaagctatcattgaagattctatttcagaaacactaaaagaatgtcgcttttcaagtgaatattatgcacaggtatattattttagaccattttacattgctatcaaatatattatggagtataaattatgtccatattatatcatcacagatcaattaagtttttatccttctttatgacttcccacatggcccccaaatttgacgggacggccctaaccgagg

SEQ ID NO: 92448 - DNA, 6734 bp, Oryza sativa
gacactttgttggattctcttatttctactgctaaaccatcgcagtcaggtggacttgccaaacaagcattgtcttccattgcacagtgtgttgctgtgttgtgcttagcagctggggatcagaagtgtgcctcaactattgaaatgcttaaaggcattttaaaagatgacagcactactaattctgtaaggcgcattcttgatgacagatgtgttgtttaacttctgtactgtttcacttttatgtagtacttctgctctttggtatagtgcatgccatatcttggtgatccttttaagttagttatatagattttcatatatcaacatcttttatatgtagataatgttataactctatagcgttgtgaaataggatactacattctctcttaactagtttcctatgccttcgacaattttgaaaaatgactatgctgaattggagggatcatgctttatttttttcaatttgataggatcaccctaaattgtatagtctgaaagtccttggtaactgttgatgtgcttgtttgattctgatccatgaaaattgccattgaagtattagttatttattaattgcatgaattcaaataactcaaatatgatctctatcattctccttgtattcagctgactgcctatctttgtttaccaggctaaacagcacatggccttgttatgtttgggagaaattggaagaaggaaggacctcagcaatcatgctcaaattgagaatattgtcattgagtcatttcagtcaccttttgaggagatcaaatctgcagcgtcatatgctctcggaaacattgctgttggaaatttatcgaagtatttgccttttatcttgaatcagattgacaaccaacagaagaaacagtatctattgcttcattcactgaaagaggtttgtccccattaggatttggtttgatgtgcattctccatgtatttgttgcttaattcttgcttgtactttaaatcactcaggtaattgcacggcagtctgttgaccatactggccagagtgagctccaggattcaaacattgagaagattttggcattgctctttaatcactgtgaaagtgaggaggaaggagttcggaatgtagttgcagaatgcttaggcaaaattgctctgattgaacctaggaaattaatccctgctctaaaggtgaaatgggattactatctaaactattttcttcattttgttctactgtcatttaatgattagaggtcttttggttcattccttgcgtttttttttgtaggaacgcacatttagtcctgctgcaaacacaagagctacagttgccattgctataaaatattcaattgttgaacggcctggaaaaatagatgaaattatgtactccgagatttctaccttcctgatgttgattaaagacagtgacagggtatggaaattaagcacagttcagcgtttttacttaatgctgtctagatgtggtgttcattgtttccttttgcactttgcagcacgtgaggcgtgcagctgtgctggccttgagtacagctgcccacaacaagccaaatttgattaagggtcttcttcctgaattattgcctcttttgtatgaccaaactgttgttaaggtatagtttcttattgacttcttgttttgttgtgagctaggactgttatatcaagtaatgttttttgtatccatcttatcgtaatgattttttcctgtgcagcaagaattgatcagaacagttgaccttgggcctttcaagcatgttgtggacgatggtcttgaactcaggaaagctgcctttgaatgtgtggatacattgctggatagctgtcttgatcaagtgaacccatcatcatttatcgttcctttcctcttatctggtttaggtggtaagtactgttacactaaataatttatcactttgaccgaacattccgtttaatccactgtagtaatatagatgtataggtggtgtgtaatctttaaaacctttacaccgcacacaaataagtcatgtttattttgtttacttgttcgcagtgcttttttcactagtattcgtatcttcttgtttatgcttagtatacacacgctgtaataactgcttttttgttgtcttatggaaccactttgtagatcattatgatgtaaaaatgccttgccatctgattctctcaaagctagcagacaagtgcccttctgctgttctggcaggtttgttgccttaatctaggtccttacggggatgtttcatacgatgcaaatgccctactctgagttctttttgctaatattcttactatgctgtctcagttttggactcattagttgaccccattgagaaaactataaatcacaaacccaagggcgatgcagtgaagcaagaggttgatcgcaatgaagacatgattcgaagtgctcttcgagcaatcgctgctctaagccgcataaggtcaggcatcattctgtcctgccccgaacactttttttctggtttaaccacacttttaactgtgctgtcatctttctcgttattagtgaatcgccacatctttattctttgcccttgataagcgataactagaaacaaatggttacctcattttacttgcgatacagccattctatacatgccatatgtttgttcgaaagtgacatctgcattctaatttgagtatcttaccttgttttgatcttttgggttacgtctgcagtggtaatgattacagcatgaggttcaagaatctgatgaacaagataatggcctcacctccgcttgctgacaagtacaactcggtgcgcagcgagtaagagctgatctttttgtatatggtagaaaatagttggagccgacttggtatatgtgccactgcctattctgaggtgaagattcaacccagcattgccctatatttttctggtggagctagtccgaaacactgaacgatacagctgagactaagaggtggtttgaaaatttgcgaacacaaatggctggttggaagctagactttttttttttgtcttgtacaaagtatggcggcaattcactagattcagtaaagttggattatattttagccgtcttgtgcgtattttttcattgcgtggtactagtaattcttccaatctctagacgccgtccttttccaagtttggttcaagcgtgatattgaaaattaaaaacttgaaaatcgaattaaaaacgatcaatttttaacttgatcgattttgtattttttttcataaaaatgttgtatttcaatgttcatctctgtaccttccaaccttggcccttgtaagctgacgtcaggccacatgcttcgcatgacgctccaagctcaaacatactgccctacatatcaaaaccatcgtgacctgaacgacgagtcgtcgaccgggaaaccgtcggggctggggatatcgcacctcggctggcggtaagcatgtttatcgcgtggtaacaatataaaaccatgcaaaatttgttaaatattcaaattattttttaagtttatttgaatttaaggaggtactgtggtatttatattaccgtacccgtggtaaccgcgcagggttaccgacggcaaaggaaaccctgccgacgagaaccacatgatttcagctaaagagcactgagcagccatgtcccatgtctctctcttgtcgccccggccggccatccaccgtgaacttcgcctgtcgccgcaagacgaggccacgccgccggcgtcccgaacagtggacgcaccggcgacgtcgcgctccgagcgtgtcgtgccctgtgtcagcaaacgacgctttggcattgcattgcatatgcggcgtgccatgtggtgcccctcgaccactggaaatttacactaggagagaccggcctgagaccccctctgaagtctgaaccccatcatgtgcctgcctgcctttggcaatttgaccgtatgggctacctttgcctaccctcttctctaattcattgtgccctcttctgcactgctcacatgatcatctcttgcaaccagaaaaaaacacacacaagaatttcagttacaaatttagtaggtgcagtaccactatttttgccatggctaaatttgctgcactgcacttgcccttcccatctgtgcatctgcacttctgcatcagtgcattgctagtttgctgctaccactatttttgccatggctccatttgctgcactgcacttgcttgcaaaaggctggaggtgaactaggggagaaagagagaaacttcctggtgctcaccatgtgctgcaaatggagactagtctttttccacaatggcaaaaccgaaaaggagctgtgtgtacctgcttctgtatctctttgctctgcatcatgcatgtgactgatggagtgtgtatctgtgatatatcatcatatcagggagcacttaaatgagcagggaaattggtggtattcattgtttgcctccacttctgttctcccctcacatgctgaaacctaggaaattgtagcatgatgatgcatttggaacctacctgttttatttttcaggtggttgttatggcttgcttgatttatttgagcaggagattcagaaacagtttcttctctctttcttttgaggtgaggagattcagaaacagtttagaattggctctgtcacaatgattaggaaagagggcaccatgatgctgataacaataatgcaagattggttgctttaggtgtataagtaggttggatctcttctgaatcttcttccctctgagctaagtcacagttaagtagttattgtcaattgtagtactagtcaatctctctgcacatggggatgctgcttcttctattgcaaaacatgaattaaaccacagtttctatttatatggtggtacaaaacattggattcagaaatttcatggaagcatccacagagaaactgtaaaaaaccatatctttgatttggtgaaagtgtcaactttgacagctgcattacaagagagaaacaacagcataatatgactcaaatgcatttgtggcttcattttctcctaggaaaacacatatctttcctgaaatttcaagtaaaatatcagtaccgattttctccccgaaatcttcccttcagatcaagcaaaatactgaggagacactgcaacagtgcaacatgtcatgcatcaagcgatttcgccgcggtcaacttatcgccttcgctgaagacgatttgataccaatgtttcctagcttaaagagtgaacaggagaaatgaacagccaagtcatcagccatggctgtctcatctccccttctctttttcagctgtgccaaaccaaagccgtccttctcatgacagcctgacgatcagttaagggtcgtaccaagacaagacctgaagttcttcaggatgcttccttcctgccctgcccctgtcctggccatatatctcaacatgcaaacaaacattagcatccatccaatggaaatctggacctttttcttctcgacatgaaaacgaaataacgaaaactcttgctttattaggctgaacaatctttccatccataatttccacatgcagagtcttttaggctccgcgtcaaaatataagggattttggctgagtacagattagtcaggtttttacatgcggagtgcaatccaaatgttgcaatatttgagtatttataacttaaattttctatcgagagaatttcaaattgaaaaaaaaaaaacttgtttgacaaccggttgtgaagattttttttcagaaaatatgtcggcgctgattataaatttgtaataaaaaggcagtggtacggttgcaaagggagcagaatgccctgctttctttagcagattctgcttcaatcagtaggttggtttgccatcttaggccggaccaccaaatatctcagggcatcacagcttgcttgcactagtgttgctttgtgcccccaaaatgcattgcaagaaaacatttagtactcctacttagataaggacataaaattcaatgcctgggtcaccaaaatttagtcaaaatccagataatccgtgatgttcacaaaaaaaatcatgtgaatcttttgcgttgttctcttaattgggagaaagattattatacttcttttcttaattagatcttatagaacaacagataaagtaaacaggaagagtgagggaattaaagaaacacaacaacattgtgctctagtaaaaattactactacctccatataataaaatggcatcaaactagcctcaaggattacatgtatggttaatgctgaacaccacaaaatcctccctctcacaaactactgcaaatcctagaactacaagggggtaagaaaaaaatgaacacccatagttcttcccatccatcagcagctagtagtagataatactactgctagtagtaacaaatagtaaataaaagaaatcacaaatctgtaggtgaaaaatctagtacccaaatcccaatcctgccctccatcatctgcaatcaatcagatcaccagcagctcacaatccctgtatgtacactctaatcctacccaggggtaaaatggtaaaatggtgtggccacacgcctccagtggcagaagagcgtaaaatgcgccccggccaagaagagggcggcgccgcgggtctcgccggcggcgagctagcagtcgtaggaggaggggtattcgccttcgtcggcggcggcggcggcggcggcggagaggcggaggaggagg

SEQ ID NO: 92449 - DNA, 606 bp, Oryza sativa
ttcctcccctgcgggatggtaggactagtcccgccattttttcatttcttcatggatgtcctggagttctatgacctccagatggcgcacctcacccccaatgcggtgatgacattgtccatcttcgcgcatctgtgcgagatgttcatcggggtgcgcccctctcttcagctgttccggtggttcttcaccgtgcagtcggtgtcaccgccgtcggtggttggcggctgctacttccagccgcgggggccggtgttgaaccgctacatcccctgcgcccttcgcaagaagtgggacgactggaagagcgactggttctacacccccctcgccaacgaagcgcgcctccgacttccaagccagcccccggcgcaggtctccagctggcggaaataaggatgatctgtgccgtggtctttttgcgtcttagcttgaaataagggcccgtacccaagtcccagtcctcgaaaagcgcgggtcggggctagtgcctggggagatccgcatgtcgagactggccaggccgggaacgtggtgaccgagggttatgggtgacccaattgtgggtttttgccgattcccccccgaagttcaccacgccccggg

SEQ ID NO: 92450 - DNA, 775 bp, Oryza sativa
tcatggccaacttcttttcccatgggcataaagagacaggcgcggagtcggctaatgaacctgccacccgcgtcggtccactcctgggaagatttgtgccaacagttcaccatgaacttccaaggcacatatccgcgcccaggcgaagaagcggacttgcatgcggtacagcgaggcgatgatgagtcgcttcgctcgtacattcagcggttttgccaagtccgcaatactatactgacggagctcgtggctcctcaccgggagaccgcgcaggcccccctttgccagttcggccgggggcttagggtgaaatctcaagctctcgctctccctctgtatctggaaagatcgtctgcccgcaagacacacgagacacggtgatgtatacaggttcgggccgctgcgaagcgtaataccctactcctgtgtttttgtggatttgtgtatgaatgagctccaaagtgtcagccaacttcttccccgttctaagctctaaatctggaaagaatcaaaacccctcctctatgggcaaggtcctccttttatacttcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctggctgtcgatgacgcgaccagtgccagaccggtcattcttgtccaccacgcgtcagcctaaca

SEQ ID NO: 92451 - DNA, 5467 bp, Oryza sativa
ccactgtatgttcagttccttcgggcagcagaaattgctgcccttgcagctaactgtgaggatcctttgatggatagggctaatctaggaggttcttacatggatctatttggccctcagaaggcgtaccttagtccattgcttcagtcacagaagcaatatagttactacgggaatctcggggttggtcttggctatgctggtaactctttaacaagtcctattcttccctcgtcaccaggtggacctggtagtccacttaggcacggggatcgcagcatgcgctatccatctgggatgagaaattttggtggttcctttggctcctggaattcagatctcggtggtaagatggaggccaatttagttccatcacttctggaagaatttaagagcaacaaaagcaaatcatatgagctctctgaaatcgctggtcatgttgttgagttcaggtactccttctcagtggattaatatgtttctgtataacccactaaattttaaggatatgtggtagaatggggaaaattgaaatatatagaaaacccccataccatattggatagcgctaactttcatatattagttctagattggaggattcagtgattgcatgaaagatgtttaatattggtaactgcttcattccataattgttggaagagctatgtacacagatctctcatctttattggtctaatctttttttttttttggtttacattcagtgcggatcaatatggaagtagattcatacagcaaaagcttgaaacagccagcactgaagaaaaagacatggtttttgctgaaatcatgcctcaggctctcacattgatgactgatgtctttggaaactatgttgttcagaaggtactgataacatttttttgtcagtataatagccatcatgattttacccgctgacagtaatcctttgaaccagttttttgagcatgggagctcagctcagataaaggagttggctgatcagctaattggacgtgtcttagcactcagcctccaaatgtatggttgccgagttatacagaaggtgcagataatttgaaaacccatctgttggttcttgaattaaacccataatgatcattttgcttagtcaaatatattttacttttccaagtaggcaagtactaataataaaaaacttttacaatctgatcacatggatcccttagcaacctatattgtggacaaaagagagtacaagttacctagttgtcagcaaaactcttggtttgcaaggcatgacagattgaatttatatttatacatgtgtgtcgattcctattcatcggtctttgacatataatgcatctctggttatctaagtgcatattggcaaccacaggcatgcttgatcttatccagttatttgtgtccatgcacatatacccttatatattgcatgaagggctcaaaggtgcagcaaataagatgtttaactgatgttatggacaatattcatgcaggccatagaagttgttgatttagatcagcagactaaaatggttgctgagcttgatggacaagtgatgcgctgtgtacgtgatcaaaatggaaatcacgttatacagaaatgtattgaatgcattccacagcatgctatccagttcattgtttcaaccttctatggtcaagttgtgatgctatcaactcatccatatggttgtcgggtgatacaggtacacttgtagtgccacagcatgctatccgttgattgcttcaatatccagtctattcatgctacttcatagctacactaacctttgtcatgcaaattcactggacgcaaagggtgctggagcattgtgatgatcctaaaacccagcaaatcatgatggatgagatcctacaatctgtttgcttgctggctacagaccagtatggtaactatgttgtccaggtcagtgacaaaattttcctttttgtttttatgggatttgccctgtcagcacctgtaactgtagccgcttgctaaaaaaagggtttctgtacttgaaatactgactactacatagatactgcccaaatgccatcaattacatgtaagagattcttaatatttctttagcactgtgatgtgcaaacatggttatattaaattatttcaaccactttctatgacatgtctagatattagagataggatttttatgaggaaagctcagtttgcttggaccttgccgaactgtgtttccccaagagtaatacactcgctcagttgaacatgcttttccttccccttttccaccttaagctattttgcatttatgtatagggtgaacgatgaaaatagtttgcatatactgtgattgattgatcagtggaatttagcagttgtgcaagtagacatgataagcctggaatgttgatgcatgtgcttctttcccctcatttgctctctcactgcaaaaggcgttttctctcttcaataaccaaccttatttgacagcatgttctggaacatggcaaaccccacgagagatctgctattattgagaagttgattgggcagatagtacaaatgagccagcaaaagtttgcttcaaatgtcattgagaagtgtttagcctttgggaatcctgtggagcgtcaagtcctgattggtgaaatgcttggctccagtaatgagagcgaacatcttgaggtttgtgtctgttttaacttgtgggcatatttcgttatttctatgcggtacagttttgcaacatctctgcttctcagaaaattaagcactaatatgaaaagttgatggtccttgctaaaagtgacttgtctttttgtttgaaatctgaaggtgatgatgaaagatcaatttgcaaactatgtggtacagaaggtgttagagacctgtgatgatcagcagagagagatgatccttacaaggataaaagctcatctgaacacactgaagaaatatacttacgggaagcatatagtggcacgcgtggaaaagctcgtcgcagccggaggtacgggacataacacaaagagagataagttttgtgtgactaggatatgatgatttgttatatataacacaaagctgtttttgtgtgtgcgcaaaaaagcggcttgggcttcaaccatcaactgcagcttgaagaataagcgctatctagttgtacagctaacagtggctaggtttgcactggcgtcatgtttttctatctaaaccaacccctactagtacgaggctctgttctgaatggccttgttagaaataaagagagagagtagtagcttgcaccggagagtgtacattctgtagctgaggaactagcacaagggagggagataaaaagaatcttcatgtgtaccgtgtactatgagttctcaaactgtgtaaaaagaggaggagcaaggtgtacaaattttttagaactagagcgaaagagagggctgttgttagctgttttattaaacttttaaaaagccagtcactagtacttttttctttttgaaaaaaaaagaattaatctcagccctgcccggtatcgatgattcgatatcatatcagggcgtcgcgttttgttgtaacatatactactactactgtaccacagatgatgccttgagctgttctgtgggtgaagctggagctattaatctcagctttgctcttttttactactacatttatcatctactggtcgcttgcttgttcttttcagggtagatcgtgtatcattatcgtcatctttcttgtttctggacatattattataatctaaatgcagcaatttataacagtactaaggtggtgttctttttctcctgaagatgaagattaagtttttttacgcaaaacgatgtggtattaacttatgattgattgtgttttaattattacaaacttgaaaaataaattaatatgctattttagggcaacttttatatagaaagttttcgcacgaaacgcaccgtttaacagtttaaaaaacatgccacgagaattcaaaattccatccattcttttcattagaaacgaatgggacctaataaaacactacatcctaaaatatacagtaacagtataacatttgataggatacattcgtactagatagatgaagtctatatttcatttgattcgaaattgctagtatattatttatgggatatgggtgttactactaatgtaatttttatttggaacataggcagtataaaagaaggatagactgtatagactaaggttaggagagtttattttggttgctgaagactgaaggggagtagggtgggagaagagaagagaaatatctggttgctccagcttggcatcgttgaccgggccatcccaacccaatccaatccacagaatcgcatcgcatcgcccacaattttcaattattatacaggaagaagaaaagggaaaggcggagagcagagccacgccgtcggattcgccctatccgaatcttgaggaaatatctccagtcctaatcagcttgaggagtgccccgaaaagagcacgggaataacgatcgtgccactgcaaaagggcgcgggcggacggccgggatgcaaaagcgcatcccccgaatcaaaaatatccggctcaccggtccacgtggaccgtgatctccctttgctctcttctctccgtccccacccacctccactttgctctttattccccttttcccctctttttttattactatttattcgtcttccccctcttgtcttccacctcgactcaactcaactcgcacaaatatcttctctcttctcacccaccgcccgattcttcgagtccccgatttggttcggcctgaagaagggtctgggtctctctagagagtgagtagccatcgatttgagatttgattagtaattcggaggaggaggaacgagtggtttttttgatttgatttgatttgattgagaagaaaatccgagtattatgggcgaggaggcgccggaggagtacgagctgggcggcggggaggacgagcgggtgatggagtgggagacggggctgcccggcgccgacgagctgaccccgctgtcgcagccgctggtgccggcggggctggcggcggcgttccgcatcccgccggagcccgggcgcacgctgctcgacgtgcaccgcgcgtcggcggcgacggtgtcccggttgcggcgcgcgtcgtcgtcgtcgtcgagctcgttcccggcgttcgcgtcgaagggagcgggaacgggagcggacgaggcggagtcagggggaggcgcggatggggggaacgggaacaccaacaacagcagcagcaagagggcgcggctggtgtggacgccgcagctgcacaagaggttcgtggaggtggtggcgcacctggggatgaagaacgcggtgcccaagaccatcatgcagctgatgaacgtggagggcctcacccgggagaacgtccccagccccctccagaagtatcgcctctacgtgaagcggatgcagggc

SEQ ID NO: 92452 - DNA, 921 bp, Oryza sativa
tcctcccgctcgctcgcaagtgccaagacagactgccatgtctctatcgattccaatggtctgttgcggaaaaggacaatctggtagaccggctcgcacgatacagacacatgcacttcttggggatgctcgcccctccttcctagtaacattcttcaccccccattttctttggttctacttctctttccctttcttgtgctccctcccctcctcaatccgtatatataagctagctgctcgttcttgttggctccttcttcctattatttctttgtttgctccctccccttgctggttggctggctgggtcggtcgggttctttcttgatctgcatttcgccctccgccaccgggatggagaacggacacgccaagaatcttgtggccgtcatcggcagcggcaactggggcagcgtcgcctcccgcctcatcgcttctaacaccgctaagttgccctcctttcatggtaggtaccttccctctcacaattctccattaattccccatgtgttgcatttctgaattatgcatctccctatgtgggctctatgcatatcagcatatgcattgtgtttgctacaactgttgggtcatttccatgtctattgttgtttgtaattgtcttctctaagactctaaccattcaatcagagaccatatataccctgtgttttgttgggatctttctacttgtaacaaaaacaatcttactgcattccacttagcccctgtaagatgttcttttgaaagcctatcaatgttatccaaccgcatgaaaccatcaaattgactttattatttaagattgaattgccatgttgtagtctgcaaattatctaccacaaacgtactactccctccttccttaaatgtttgacgctgttgacttttttaaacatgttgaccgttcgccttatt

SEQ ID NO: 92453 - DNA, 1089 bp, Oryza sativa
ccggcgggtggtggccaggcgtctcgtaggagatgtcgaagattaggtggccggtgcctggaaaggtggtgggcaccacaggcgtcgtgctcggcgtcatcgcgagctccaccgccgcgctgctctccgtcaacgcgctcctcgcggagctctccgaccgcaccgccgctcgagccctcgcctgccgccggctcatgtcaaggggagagagagagagagagaaataagggagagaggaggaagaagggtggtgagagagaggatgatatgtgggacccgcatgtcagtagggcccacaattattttttgtatgaatgacaaatgggtttaattttaatgccacataagcgccacgtcaatgccacgtgggacgaagaccaagtcaacactgccacgtgtgcgccacgtcaacaaaaccactctccaaaatcactaagggagtcaaattgtaccggttttgtaagttggggttcaagatttctggtactgtggttgagggatacgatttagattcagtggtcagttgagggagtcaaagtgatcttattccacaaagaaaagatgcggcccaagcccaacactacggcccatctctccggagcctcagagctggatgcccctctgcctctgcttcactgcttgcattgcatatttgcatacaaacacttctggatatgagaagctcagttaatttgcatttggaaatatattactccagtaaagactatctctcctccaccatccatgcgtctaaccaacaatgaaacgggtcatctggaattgaaaggtggcagatagcaccacacgattatacaatttttcaactgcaaaacgaacattacctcggacattaaacacgcacgtttcagctggagacatccaaactactactcccaccattttaaattgatctacatatagttttttttgtttatttctaaatgatctacatatttgtgttcatttattaagtctattcgttatttgtgtattggagtaaatagacattgatgcatgtatccatgcacacaagtatttataacccacatgcaatatcttgatttggtattggctaggaaaatattgggg

SEQ ID NO: 92454 - DNA, 5273 bp, Oryza sativa
acctgtggaagtcgtcataatcaaactggtacccaacagcctgcatcatcataagattgaaaggaacaatacttaagagggttacagaacagcaaggaagatatgaacaagcacccaaaaaggggggcaactttgctggggaatagagtaaagcatacagaccctcaaaccggccatggtagttccatactgcttgtagaggaggacgcatagctccaaactgatgctctcttccacaccaagcttttcgatcatataagctgaaacatccaaacaacaccacatacctcatcaacatatctgttccaagaaatgctaatacgttgtgcttgactgtttgtgtaccttggatgttccttacgacgtcggctccaatgccggaggtcaccggatacagcgtgtcatcaaggtctaaaaaggaaaatgaacaaggtatgaaaatcttgcagtttcactttaaatgaaattccttttttttttctgaaatgcaattggagacagcaccagtgatggcaagaattactattgaatcattcgctccgtccctaaatatttgatgccgttgacttttttaaacatgtttgaccatttgtcttatttaaaaaattttgtgaatattattcaaaaacttgagtagtagtatatttaacaatgaatcaaatgataggaaaagaattaataattacttaaattttttaaataagatgagcgtttaaacatatttaaaaaagttaacggcgtcaaatgtttaaggagggagggagtactggttaagcaatgggtagcataccgaagacgaggctgtcgccgttgagcctctgctccttgctgtagttgctctcgcactccatctcgatctgatacaaccaaccaaccaacagaagaaaaaaaaagtaacgactttacgcccaaacaaacaatacaaacacaggattgaagagagatatccgattcagatctaagctttggcgttacaggccggactagtacaagatttgactaggatccccaatgaactgccgccatccttgatacacacaaaaataaaaaaggaaattggctggtccaagaaaagaagggaatgggaaaacagacctgcttgatgaattggttgtgtgaaggcagaagattggttcgcgcggtgagccggagtgaagaaacaaaagggatgagaaaagcaggaaaggaaatcgtgggaagaatcgctgggcaggcaggagattgcagttggaagcggccgtatatgtagatggagatggagatggagatggagatggagtgaactagtcgatgaggcgtcggcgccgcccctccccgcgaggaatgagaaggaaagggagccgttgtgctgtggaaaaaaaatatattttcttctctctttcttttttcatgtctagggctaacaacttttttgacggaaatatttgatgggtgttttctcattgcttactttgtccctgatgacgccttacactctccagaaaaatatatattgttaatttaatatagtattaattattataagaaatagtataaatttgtacccatgaaagtgtttttataaagcaagcgttatactacatgccaaattcagatgatgcaacaaataaatattcatggagatatttaaatccgatgtttattggtttcattagtacttgactgtcgttgacaaattcaatttcagttgatggcaggctgcaaacgtgacaggattattgttactagtacttgttctgcacgtattggtatttggggtcaatgtgtaaccatcagatccaaacaaactactctatcctagtagcagtactaatttttgatgagtaaacagctatagattgttgttaaaagtcaatgtcctcgtagcagacgtactacgtgtgcagttatctgtccaaatcattttctcttttctgaaagattcagttatctatccagattgctccacaaacaaagagcaatgaggaagaagtgaaggttcagctctttcttgcttcgtgctccatacagcaacaagaattcttacaagagaagaaataagcagattgaggaagagatggcggcattattgttccatgaagatgagtcgctgaagcatcattgcacacagctcatttggatcacctacctggttgcacttgaactggatgctggattgaattgcttcttgcatttgcatcggcagctcggcaccaatctgtcaaaccgactacgctaccacttctcatgtgcacccatcactccttgcaggctgccgcgtgtaactcgaccacaagaatcaacttgtttttttttttgggttacttcgtgttagtagttctttaaaaaaaaaacttgctagtattattcatttcataaaataaaataaagctgaacttgtgactgaggaagaggcgtgatcatcatggagaaagtcttcttggccaagaattcaatatcatactggctggctgcttgcttgcctgattttaataagtttggaccaggcttggggttgcaccgaccatgctatatgctggttcgctcttttttcctttatgccggctcaaaggcgtcacccaaattccatcttactcctcttcatctcttctttctcgagaacggtctcagcatcggatgccgtttacccgtctgcacaatgctgctttcaggaagcaacaagaattatactactagtaaactgaacaagagtacaacttaaccagtctgaatgcagcatcctgtgtggcaagctgttgtttacagctcaaggcataaacaaaaagactgacaaaggctggcatttaagcaacaaacataatccagaggtttgatccattttgaagtcatgaaatggccacaaagtgtgtgagaataatacaagcatataagtttgtgataaattacaaggcccttgtttctctgcaatgaaattccaaacaagaaactagccgacttatgagcttctaatacaaagaattggttatgttaatatgagttcttctccctttctctcgatctcacagacacacacgcgcacacaaacaataaatgaataattaggcctcacaatttacaaatcgctgaagaactgcacaagttcagaaaattatgtttcatacaaacatatgcattttctttgcctcctattatggtcaccgtatgtggcttctcgagaatgaccagagcccaatatcacgaacaggagcctggtgcaaacaatatggcagttcaagctacaagccacaaaataaataaaatctgtgttcaacaatagatgcctacctgtgtcttcattgaaggaaaaatattccaaaatctgagggtttcatccccggctcctgttactattgtctgcaaatgagtaatatgcatcatttaggacgattcccaggaatatttttccggatacatgatttgcagtttggaaaaagatttacctgtccatcaggtgacattgcaaggtaaagcactcgcagcgtgtgtccagttagagtagcaacctgtttatcgaaaacataaaatacttagtggtactgcactagtggaaatctttcttgaacagatattaaaaattcaaaggaattattctactcttatccttatctgcaaatacaaatgaaaatagccccctgtgaaatacttcacttggatttgcagccatactgatattgttctttttaagcattacatgctcgtcaactatgttgatactaaattccttttaagcgtttaagcaatccatgagtcaatgtctcggcccacagaaaggaatgagttctttggaaacaaccctaggagaaatcagacacataacttcctctgctttttttcacgtttttatccgaatgagtgattacttgatgcacaattgtctaactggtgaattagtaggcttgacagcccacgggaatttaagcttacctttgacatagatgggtacttccacaccatgatttggttttgggaatacccatgagtgctcacaagctcatttacatttttacaccaggcaagattacaaacctgaaaacagaaagcagctggtgaggatgacagtaaaaattcactgaactactttttagaggcttgttcagaactactcgcctggctgcctgtgtccactgaattcagcatgtttccattaaccgtgttccagaacctgatacacctatcagcggttccaccacctgatgccaggaggccttgctgatgtggtgaccatgctattgctttaactgcagctgtgtgttctgtcagcctcaatatcggctgctgcgaacgttggttccatactagcagctgattatcatttccaccggatgcaagctcacggtcgtcgtgcgaccatttcagtccacagacctgaccaaaaaaactgtcacttgatgcacatacatggttctgaaatcttactgtgagatgggatgattttaacttgcatagttagtgagctattttccaaaaacctatggcttggaagtagttagaagtctcacctctgatctgtgccctgagaacttgctgatatagtcacttgggacacggatgtcatgctgcaatatgttcttgtccctgctaccggaggacaagattcgggagctccatgctaatacaccagtccgtgtttggtgtcctcccatgttcctaatccgtttacagcgagagctatcccaaatctgttggaatttatgtatgcatcaaattctcgatagccatgaacaaattcacagagttgaacaaaaacaataggctaattcaagtataggtagtttgagatttgcagacaaaactgtcgcacacatcctggacacattgaaagaagtatgtacgtgttgtgatagtgatagttagtactagaatcgaataaaagtttagagtttcagcaatagggcttatgtttcaaatctttactagtgtacatctatcatacgagatggtgaacgaagcgaattgcatcagcccaggattcaggatatttggaacaattgatgtatatagtttgtgtaattgttgtgatgaaatctaaagagtgtagaaaacaattactactaagtactagatagataaactgaagacaatcatatgctgcagccaatttattcagtagaaagtaaagaaaagaaaataagagggggaacctggacatcgccaaggctggtgccgatggcaagataggagccttctcgggtccagtgcacagcgcagacgctgtccctgggccccaaatcgcagagcttggtgaccttgcaattggaagccgaccagaggtagacgcaattcccgaggccgac

SEQ ID NO: 92455 - DNA, 945 bp, Oryza sativa
agtggtgcctccgcctacacggctggcctattaagccgccgctgttgggcgtttacgacttcaccgccggcctgcctccgttgccgccgactggtgtcctcgcctatacggttggttggtcacaccaccgttcatgggcgtccacgtcttcgccgaccggctggccttcgccgccgccgactggtgtttccgcctacacggctggcctattatgccgccgctgttggacgtctacgacttcaccgccggcctgcctccgtcgccgccgactggtgtcctcgcctatacggttggttggtcacaccaccgttcatgggcgtccacgtcttcgccgaccggctggccttcgccgccgccgactggtgtttctgcctacacggctagcctattatgccgctgctgttgggcgtctacgacttcaccgttggcctgcctctgccgccgccgactggtgtttccgcctacacggctggcctattatgccgccgctgttggacgtctacgacttcaccgccggcctgcctccgtcgccgccgactggtgtcctcgcctatacggttggttggtcacaccaccgttcatgggcgtccacgtcttcgccgaccgactggccttcgccgccgccgactggtgtttctgcctacacggctagcctattatgccgctgctgttgggcgtctacgacttcaccgttggcctgcctctgccgccactgactggtgtttttgcctatacggttggcggactccgccgttgttaatgggcttcaccatctacaccactggcttggttccactggcgccgactggtgtttttgtcaccattgatggactgcttcattcccacatcggctacttctgctgtcaccgagggaatacgacaaagctaagtcatcatttattttattctttatatgatatttttccttttcctctgcctcactac

SEQ ID NO: 92456 - DNA, 3345 bp, Oryza sativa
ttacacaaaagcgaaggtcagaatatttggaactaagatgtatgttgtaatacgttggatatcttatatatatgtctactgaaaacaaaaggaaatgggtcatattagctacagagggattgaaggaagtctctgtgtcatacggaagtgaaggtaaagaggagccgaggaaagcattccccatgggaggatatatgttagacaaggaacgagaaatgacttcacacacagataaaggttagaacatttgcatttggtatattgcattttcatatatgtcattgaaatatatagagaactaaataaattgtttctatatgggccttgaactagagacaatctcaaagaagtccgcgtatcatatggcccaaaaatgaaactaagcaatttgttccctactgggtatgaacacaacatgtagtatataatacatatacacgcaacagaagctgaggatatttggaactgtagggcactagtgtaatatatttcatgtatttcttatatacatgtatattgatttttttttaaaaaatggccttatgagttgcagatggtctaagggaagtttcggtgtcatatggaagtaaaggtgaagtggtgactcggaaagcatttcccatggaacgatacgtgctagacaaagaacctaaaaggaatctgcacagaaacaaaggtcagaatatttttaagtacagttgatgtattgcattttcatatatcatattgacatatgcagaaaactaaataatttttttctaaatgggcaaccaactttagatgaacttagagaagtctcgggttgtatggctcaaaagggaagctaaaaaatttgttccccactgggtatggacataagaaacataagcatgcaaatgaaggtgagaatatttgaaattagcggatattggtgtaatatatttggtctatatcttatatacacatgtttattgaaaatttcaaaaatgggatgaatgagctacagcagatctaaaggaggtctcagtgtcgtatggaagtaacgatgaagagaagccaaggaaagcattccttagaggagggctttttttaggcaatgaatatgaaaagtctgtacacatagacaaaggtgagaatatttggaagaacatttggcgtattgtattttcgtaaaagttgttgacatatatagataatataaaaatattttctgtattgcccgtaaattgtagaggacctcaaagaagtctcagtgtcatatggctcaaatgtgaaactaagcaatttgttcccaacagggtatgcacatcagaaatatatattaacaagcggaggtaacattagaactagtggatgctcatgttacgtatattgtgtgtatatgttatatacatgtatatttgaaattataaaatgggccatatgagttgcagctggactaaaggaagtctccgtgacatatggaagtgatggtgaagaggagccaaggaaaacattctctaaagtagggtatatgttagataaggaatgcaagaagtcttcagatgtagacgaaggtacaatattttggagtgcattatgtattttgtatttttctctaggttgttgacatattcggaaaaactaaataaattgtttctacatggaccatgaactgtagaggaactcagagaagtctcagtctcatatggcccaaaattgaaactaaacaattagttccccacagaacataagaaatatatatacacaaacgaagataagattatttcgaactaaaggatgttagtgtaatgtattgtatgtctcatataaatgtatattgtaaataaaataaattggccatatgggctgtagggggactaaaggaagtctcggtgtcatatggaagtaatggtgaagaggagaccagcaaaaccactcctatgggaggatacatggtagatatgaaaaacgaaaagtctctgcaagcagagaaaggtgagaacaggatgtgtgcacaattcatgaattaatatattgttgacataatatagaaaactaaatgaattgtttctacatggactgccaactgtagaggaactcaaagaagtttcagtgtcatacggttcagatgtaaaactaggcaatttgttccccatagaacacaagaaatatgtatacagaaatgaaagtgagattattttgaaactaaaggagatgttagtgcaatgtattgtatgtcttatataaatgtctattgaaaataaaaataaatgagccatacgagctgcagatggactaaaggaagtctcggtgtcatatggaagtaatggtgaagaggatacaagcaaaacctttgctatgggaggatacatggttgataacgaacgtgaaatgtctctacaaggacagaaaggtgagaatagaaagtatactcacaattcatgaattgtagttttgtatacattgttgacataatatagaaaaccaaataacctgtttctacatgcatgagctaccaactttagaggaactcaatgacatttcattgtcacatggtccagatgtaaaactaaacattttgttttccacataacacaagaaatatatatatgcaaacaaatgtgagattatctgggactaaaagatgttagtgtaatgtattctatgtaagacatagatgtctactgaaaataaaaataaatgggccatacaagttgcattgggactaaaagaagtctcggtgtcatatggaagtaatgatgaagaggagacaagaaaaatcattcctatgaaaggatacatggaagacagggaacacgaaaagtccctacaagcggagaaaggtgagaataggaagtatgcataaaattgaattgataagtatattgttgatataatacagaaaactaaataaattgtctctacatcggcgtcaactatagaggaactcaaagaagtttcagtgtcatatggccatgaagtaaaactaagcaatttgttccctacgagattcggacataagaattatcaacacacattcgaaggtgagaatatttggaaatagcaagtttgtctgttatactttcatataacttatgaatgcgtctagaaaagcaattagggtattcatactgtaagttgttttcctttgaaccttttgtgtttcccttaaaattgtctaagcacgtacattttgatagagcgatgctattacatatctcggttaccaagagacactaaattttatgttaaaaatatatttgtcacctctcaccatcatccaggactgtaaaatttctcattttgatgactttcttaatcttgtatagcctatcgatatatgcatcggcatatatatatatatatatatatatatatatatat

SEQ ID NO: 92457 - DNA, 5800 bp, Oryza sativa
cttggtgggagaatgggcgtgaggcgagagtggttgtggacgctgttcaccacgtcggatgagaacgcgtgggtgggtcgtagactagtagctggtgttgcccgtatgcgggtggacttggttcatggaacggttgtggggtgcgacgatggcgtgtcgctggccaatggcttgtcgccacgtggagattgacacgtcgacctgtgcttttttttctttttgcccttgggaattagtttatagtgtaggaatgctaggggtggtatgtctatggacaaatgaactccatcagaagtttatagtgtagcgtcattttacgccatttgatctgctcagttgctgtaaaagagctgacgtaaaataaagatacttagaaaaatatatgttgtaaaatgatgtaaaatgacgctacactgcctaaacttctgatcgaatctaatagctgacgtcattttactcattttacgacatcattttttaaaaaataaagacacttagaaaaatatacattgtaattttcaatatttacacataatcctttaagcactattcgttttggaggaatttcagaagatttggattcctaaagatcgaagcgtatgaatgtcattcgattcctaggaatgtagagataggaaaactaaagaattttttttattcacacaaaccttatgaaaaaaaatcatatgtgcatacattcttattctttcacttttcctattcctatatgttgaaattcctccaaaacaaatagacccttagcaaaaatgcaacagtacaaatcaacacaacaaggaaaaaaacaaaagagatactactagaaacgtataaatacatcatgagcaacttgtgtgtgcctagcgcatacaaagcttcccatttttttttggcttatcagctccagctaaactttatattttgaaatttaatttagagtagactttgagagattttttttatcatagtttacttttcagcattaattttacattatattggttgtttcatttatttttctacatcttatcactcatggagcaaatgatgaggctaaactaaaaaaaactaactgaagtcactcgagaaatgtgatggcagttttctaacaaaaccgaaaagagatttggtagtcaatactgaaatttggcaactcattagattgcaatattgtccacgagctattagacaacacgtcaagtgcaaagatagtgcaatcaagccaaactctgaaaaatggaatagaaatctaggagtataatttcttatgagaaacaaaatcaaacaaaaatcaactggcgagggaactcgagttttatctatgcaataaaattcataaaagtttaacccacaacaaaaaaactaaacgtttaacattagggcagcaaaaggcacaccacacataatgagattgaaggttgtcggaagctagagtaaataatcgagtggcaacgtcttatattctggttgaaaattcataacgatcttgtcgaaattgaatggcaactcaaaaaggataggaaagaaaaggttggcatctttatttgaaatcaataggcaactcaagttgccagagaaaatattgcagcaactcgagcttatacaaacgaacacgtcaaaaacttcaaagaaaaaccaggtatcgaagtctggttgaaattaaatagcaactcgtataatcgtattacaagaatcaaattgcagcttgaatcccttgagggttgagccacatttcgggctatcatatcagagtagcaaacctcaccagaacttaacacagaaactctgaaagaaaatacgagaaaacacacttttggatggacatagctatatatgcccatgtggccaatggaattttgtggtaagaattcagagagaacttttgtttacgtctgtccaggaaaaaatagttcatgttgaggcagaaaaaaattttcttaggtcttctcgttatgtacccaaatgagctaaggtagaatacaacttattcttttcgctgttcaccaatggaaaagaaagggaaaaaaaagcaaacacattcctatatcagtacaactatgataacacgaaaggacacgacttattgagcaactgctgccttcttctttggtggtggattccccccagcaagtagcacatatgagtagaagcagatcatagcggcactggtaacacaagaaatagtaagaggaggagcaaaaggctgaaatgaacaattcattcaggcaagaaaaaagataaggggggattacctgagtgcagtgtaaaaagcccagggaagcagtttctttgtctgacataacaggattgataaatcagaaaaagagtaagattcagaattcttgagaacaaagaggaagtgtcacttactgtggtgtacgcctggaagtgcttccatgctaccgcagcagcaacagctgcaaatgatgagcagagcaggttattcacagtcagaactacaatcttgcttataatagcaatctgggttcaatttcgaatatttctgaactcgcaatcgagcataaacaatgaagagatatatcctattatactatcagatattcaagtcactgcaaaatcataacttgattcattgaaacctgagaagatgttaagttaggaaatggcgatacctgcttgtgccagtatgaatggcaagcttgacttgccactcctccaaaccttaaggctaagcacaccaagggccaatattgcaaggccaggtgcaacaccgaaagtaagacttacggtactcctccaaaacagaaatccaacaaggcccatggaaaataaaattccacctgaatttgaacaattaaatgttagtaggactcattattataaaatagaaaaaggtctcattagcctcctagaacactatgatcagtctatttaacctcttgaagtatgaaactgagcattcctagggtatgaaaacaggtttaaataacccccccccccctatagtggttttggaggtgctttcaccatagtggtagcagacgtgctaatgatgtagtcactcacttgggttggctctggttagcaatgactaagggtgttggtgccagccacagcgaaaggtagtagctaaggaataagatggaagtccacaatcagtcgatgacatgtaggaaattacctaagtcatggcgaaaccacctccaaaacttcatattttagggaatataaatctggtttcatattttagggggaaactttagaggacagaatggacttattcctagagaatatagatgcaacaaaaaataggataacagtattggagcatttaaccagcctccacaaaaagatgacacatacaaagattcctcaactagattccatagtagaatggcagagggcattatgccctttagttaggatgtgtttagttcatgctaaaattggaagtttggttgaaattgggacgatgtgatggaaaagttggaagtttgtgtgtgtaggaaagttttgatgtgatggaaaagttggaagtttgaagaaaaagtttggaactaaactcggccttaaaggattactttaagatcatgaaatgcaagaatttgaggacatcataaataataacagaactgaaccaagctatgtttttaataagaatcaagtaacagtcagaatgtcagaattataaaatcaatacagaatgttgctttgaaggaagttgaagtcataccaaaagggatccctaggcaaaagtcatgtattattgcacccttgtgttgaggaacagcctcttggtctatgtctatttctgcattagtaggcgatacagtggttggctgttgattttcatcttctgtatgctccgcgacagcattaggatcaacaggactgctggtatactccgccttcatgcacattgctatcaatggctgcaaggccataaactagacataagaggaggaaaagttttcacaaagataaggaagaatgtaaagactagtgggcaaggtatgcctaacttcgtctcagaaggaagaatagtaagttacttgaataggagaactgatatacattcatctacagacatacataaattcatgggattcaactaaaggccattttgttttaataaaatatggcctccagggttccaaagataacaaaaacatgatattgcaatatcaaacaattcataattatctcagcacaaaactttgctgccaacaaaatgatctttgcttagacattgagtggtctgcaggaaccaaaaaatatagatcggaatcctgcaaggtgcaggaatttaaatattagaagacgatcagcctgtcatatagatactatctcgcagcttacctaggcttggtttgacaaattgtcttttaatgtcaatcatcataaatggaatgttcattggtctatacaatatacgctcatctgccatgtgctatcgtccattgcatactaatataatcttgatggcccagcatgtatgttcacttctccatattgaacccacttgtttatgccaaaaacatgccaacagaagttacacgacctgcggtatcccatccagggatctcaaccgcagcaatacacttgactaacacaattattatgctctttacatagatgctaatgactgatatccaacagatgtgctactacagcattaataccactgctttagaatctatgtaaatgagttcttgagagagtatggaagtgctatcatgaatgcttttgtgagaccaggtagccataaatacctcataatatctgttatatagcagtatgtgtttataggatttatcacaatattactcccaaaagcatattacatttaattacacaaggtttgtacgaaaaggttatagttcccgaatccattcttggaggggagacgttattgcagagcacagactagctggttagcacataatacagaggaatcactgaaatcaacaggaattcgccagcagacatggcaacaataggagtgctaaagcacgacgtgatgttccattatgtggtgcctgtaacgttcccattcaattggcaatgtaagtaacaaaaaaatggggaatttagttatttctttgctttctaagaaggttttaagttaaacatatagagaaaataaaagaaatatttgttacccgaaactgatgtaaaaatacataggctagtgatagttgacctctaattttaatttcatgtttctttttaaacaaaaacatttcttgttgatggaaatgatacgcagatctcctttgcattcttggtaaaacggagtctcaacgtgtttggtttgtgtattcctttcttaacacaatgcatttctagtttctaccctgcaggcctgcaccatgtcatgaggtagtacatttctaaggaattcaaacgcggctaaaatcactcgatgcgctgaaaacctccagcggcgcggtctgcctcccttaattttgccaatccatcacagccgcgaaaacacttaaattccagatccaggaggaggaggaggagaaaaagaagttacagaaacctctctcaccttgggcagcacgacgccagcgggaaccccgcggagcgatccccgggcgatcgacgccgggaccgtcgacgtagcgagcggcgcgaagcggaggacgccgccggagggggccggccacctcctcgccgccgccgccgagggcccgcggagctgcgccgccaccgccgccgccatgtcgatgttctctcggtttggacttcggttcccgacgcgtggaagccggaaggggagaggagagggaggagtcgtcgtgctcggcggctaactctccttctggctcctact

SEQ ID NO: 92458 - DNA, 8166 bp, Oryza sativa
tttcatttcttgaatcgttacatgtgtttacatacagttgtgcttgctaaaaatgcaggctacactttctcctgctctggaaacagcattagactactacctgcgggttttggctattgctatcagttatgctggccctgtcttgctcaactatagacaagaatttaaaaatataataacatcatcattccaggccccttcgtggaaggttcatatttccttcatcattttgtacttttggatacatacgtatatattacaatttgaaatgatggattccatcttttgaatacctaggtcaatggagctggtgatcacctccttcgctctctgctaggaagcctggtttcatattatccaatagatcagtataagtatgtttacaatatgaatacccattttaagggcatgagcaatggtttagacaactgctacctgtataaactttacacattatatttagataatgtacaaacaacttgtacaatagatttgtctaattagtggttcatataatcaatgatttacaattgatagatgatatgatgctatctattcgaccatttgctgatccagatggcatccttctctctctgatttcaccttcctccacttcagtcctacgtggcatcccctcctagattctgacacacaccattgttctcgccccaagaaaaactgcttttacctattttaaaaagattgcttattttgtaggcccttttcttgtcagcccattgctaatattattgaaccatggggctgttcgaaagctcatcaggacagggaagttgaaatgttaaatttcactccaaagtggcatgatcccagtcaagatgaactatcttttgcaaatgaattgttagaatttcatttccaatcagcattggaagatcttgtgagtatctgtcaaagaaaaaatcattccgagacaggtaaatattctagttttgaccatggaatgaatcctctctttttttttttttttcgcattgggtgctcaagtagagggggcaatgaatgtcatgttattaaaaaaaatggtacatgcatgtttaagtctttatgatcatgtttgttgactggaagctgattacagtagtgttgatgcttaattgtttacctatttaagtatttacttttattagatgattccttcatctggtgtgttgtttttcttttaacaggacaagagaaggagcacctaaaagtaaccctattacgcattcattctgcattgcagggtgtaatgtcttgcttacctgaaatgcggccatcatataaagatgggaaatccaaggtagtggagcccataatttttattgcaggatctgctggtagcactgttggcaactcagaaatgcgtgaaaaggctgctgaacttgtacatgtagcttgcaggtgaacatttgtttcttgtacacccaaatttatctgcttagtcttttttagcttattttgtctcaccatttgcatttcttccaataggtacttgttgaaagaaagaactgatgatagtatactcctagcacttgttgtacgtgtcattgatgctttagtaaactatggtatgttaattaactatgctcaaagactcatactggggtgtagatttgcctgtttatatattctactgctgtaggtagcttggaatatgaagaatggtcgagccattttcaagcttggaagttagagtctgcttccataattgagcctccatgcaactttattatcccatttcattctcaaggcaaaaagaggtattgtcctattttgttcagtctgattctagtatatggattttgagtgagttcattttttttttgtctccaataggcctagatgggcacttgttgataaagcacacttgcataatacatggagaagttcacaatcatcataccatagataccgtacaaatgctgatgtatctccatctagcctcatggttaatttgatgaatgatctcctagatctctcactacacaactatgaaactgttcgctcgtaagtgctctagctctttcttcctctttcaagcttgcttatgtatttagttatttgtatatgccgatatagtttcacttgtggctaagctttattattcatttaattggaatattactatcaacatacgcatccactttatgaactcaacaatcgatgaaattggttgtgttttgctgaaaaccaggcaaacaagaaacaacttcttatcttttcaaaagggggtatttcaattgcttacacgacaccctttgagccatttcttttaaataatacatgcatatttgctcttagaaatggtccaaaattcaatgctaaatgtgaagttggctgttttttttttttttttttgggggggggggggatgagacctcacaaaaactttctttatttttgcaaatgaccttcttggaaaacatttttatatatcccgaggagaattttatttcatctattgcatttttgtaatatgtggatattattaatttattgtaacctcattgtataaattgagttttgatcgatgggttatgtggtcatgccagatattaccacttcactttgttctgatgtttccatttttctgcattatttttatcctttatcctgagcagaattttatttcatctatgcatttttgtaatatgaatactacaaaacaaatggatagtattctatttgtagttacttcattggctggttattgattttgacctaattgcattaatgaagtattgatcaaataatttattgtaacctcattttataattgagtcctgattgatggattatttggtcatgccagatattaccactttactttcttctgatgtttccatttttgtgattattttaatccaggtattctggaagatcccttacaaaattacttaagcgctggccttctctaatttctaattgtgtcctcacattgactgataatttgcgagattcaaaagcacctgaacatacggtgcttggttcttgcaatattcttggaactcagactgttttgagacacttgacaactgtatgtctattttcacaatttatgtaatttagtgttaagttattcataagggcaaagatagttaagttattaaattagtgttgacaatgctaacatcactattccatgcaggactcggtatcactctcttcatttatcatgggcatcttggagaggtagtaggcactactctatgtttgtcctgttatttctaataatttggaactatcagttgttcgatatgtttcattgtaaattatacttaaaaaaataaaaataatcggcactccgcatagaggagaaacttgaaagtaagacacctgtttgacatgtcttttttctttgtagctctcatcatgaatcgctcaagtgtcagaaagctattactgaggtacaattcaataatagaacatgaaggtggtcatgagataatttattacttctaaaatattctgtatacattctttacagctctttgtgaagtataacatacgtttctctgggatatcaaggagatttttcaagaatacagaatgtgaagcagacaagccaggatttatcagtttagttcctaaaataaatgctttgagttttgagagtaatagtctgcattggcggtaagcaattgatataaccgaaccaaatttgatatatctctgtgacatatggcactttgaggctttaaccttgaaatatttaagattcatgtcttctgatagatatacaccaaatcaaatatttcctctattttcttcagttcactaccttttgctgttgattttttccccaccaagttctgaaccttgccatatctttacccactttgactaattttccatgattgcaacttctgctacctcatcatcatcagtctttcataacattaattaatcctcaaattattgaatgaaaatatttctggtagtattaacaacaacattaataatagaaagcacatagtatgtgcaaattgttgaattgaattagctcgataaacacataataacaaaaatatatgattttagatgcatccaccctgaatcatggtgcaaatgtaccatgacaaattctgaaacaattcgactgcattgagataaaatggacccatcattttacagaaagaaaaaaaaagtacatgcaaacgcaaaaatgacaaaattcaatgcactatagaggactatcttttttatttatcaatatgtagactagatttaaatttgttttttttatgataaactttattttgtgtgaatgcttttagaatttcaatttttcatgaccatttgcactgtatcttgaagaggatgccccatgttgccccagatatttttcccttttgttgataggtctaggtctcaagtccagaccggcaggtcaccggttgggccacttgtttatcataattaacattagttaacattaatttgaatcaatagtattttactaccgcattttcatatgctatattaatatacatgtatgttgaaagaagcttgtgcatcgaagtagctgcatatgcaaagtcagcctccagatggaaagtcagccttgaccacatcaatatattttaggaataaattgcaccatgggtataacaagttgagaatttgtaccttgagttgttcatcttgtttaagtgatgggttaccatgtggcattgactggcatgccattttgctctatgtttagtttttcattttgcagaaaacctctcccattcttgatctctctcttactcacatcctgttcctatttcatcaatgaccatagctttcatctgtcacctttcttaccccacctcactctatccattaccctgcatatatgaacttaggaaaaacgccggggtgggggtggggggatagagtggttaactggttgtactctgagcagtcacacagtaaaatggagttgatcatatgcaccacttctacaaagacaaatgctgcccaactgttcagtgccttgtttctaataatagttcagattcgatggtaactgttgtcagagtacaattaattgtttcagccattaatatataaccttggaacctttgtattctcagatacaatttgatggccaacagagtgcttctgttgctaattctggcatcaagaagtgaatctgacatacattcacaaatcttgtcagaaacagctggtatggatagcttactctctttggtggtttcttgtatttgtcaaccatgatatattttctttctttatgttcatgaaaaataaagtttgatacttgtatcctcaattttattacttagaacttagaacaacttttttttttgtgtaggtcatttcttaaggaacttgaagagtcaactaccccactcgaggatgcttgcaatttctgctctgaatacactattacaaggatcacctgataaggcatctcttcaagattcacaacaatcattagatcgccctgaagaaggaagcattttgtccacaggagaaattttgaataatataattcgggaggatggatttatgagtgagactctaaacagtctatctcatgtccatattatttctgataatgatggttcatcgaaagcaagttatggtgcttcatcttttcaaagcggttctgataaagcaatcacttacttctattttgatttctctgcgtcatggccacgcacgccaagttggatttctttagtgggtggtgacacattttattccagctttgctaggatatttaaaaggctaatacagcaatgtggaatgcctgtaatatcatcgcttcagaatgcattggaagagtttcttagttcaaaagaaagatcaaggcaatgtgtggcagctgaagcgatggctgggatgcttcactctgatgtgactgggaatttggagtctgggaacaactggttgatacttcagttgcagaaaattatgctttcaccatctgtggaatcggttcctgaatgggcagcttgcattcgatatgctgttactgggaaagaaagatctggaagtcgtgctcctgttctcagagagaaattattagattgcttatgcacgccagttcctcagtccgtggccaccagtgtacttgccaagagatattcttttctgtctgttgctttaatcgaaatatctgcaccaaaaatgtctccagctgaggagcagtaccatgttaaaattctcgatgaactgcttgccaacatgagccatccgtcggcccaggtagcgttgattcacttgatcatagtatatcttaatcttgcctttttttagtttcaattttatattattttgagttttcatttcagttatacccgaataacatttccttgtcttttaaagaaaaaatgtttgtttcctctttgtcttttgacaatgtggtaacatgcaaccccattcactaggatttagggtctgattatgcatgttctagtccagataggttcactggatcttgggcttggcaagtacaaactcgtagatttgtgatatttcctgctaactggagaaggcttacactatcttctgtcgggatacttgttaggaattaaagatatggtttattaggaaagtagaggttgtattctcaacagacaagggactggtcacgtgaatagtacccctgggatactgtagccaagaatcatcactatataagggacccatgtctttcattataattaagcaataaagaaaactaaagttaggtttagcttgatcagtgtctcctagtgatcaggacaagccctccacctacaaaagtgatataccctttatcccccctatcataagtcaacacccataacactgaaagttcaattctccttgtttttcctgattcactaggctgtaatctgtttgggattagcaacaggttgtcatttagagctgacaaagaaccataacatacttattgctgaacatcacaatattgcaccacttacctatttcagaacattatgtttctgctccatttgttcaatatgtggtattatacacttttgaagttcttttaactatttttggaaatgtacactatgcacaataacacatgtaatgatgcatctgagcttaggtagaattggtcaacactgtttatatttatcataattcaaacacaattcacataatatatttagaaaaatttctgagcttattgtatcaactagtttatggtttgacaatttgccactaccacatggtcacccttttttttttgtcaaaaaaggaattgccttggaggatttaactgagctaagcctattcaccttccattgtgttcagataagagaagcaattggtgtgaccatatgtattgcatgctcaaatatgcgattatctaggttatttgggcatggtgattctctagatgtttctggggatgtaagcatgactgaacaaacagggagtgagaactggtcaaaacagttgacagatggagctactgaattatctatcagtatacaaaataatatttctaagcaactggagtcaacaccagattcagtaactgaaaatggcttggacaagaaagaggaggctgatgtgaaaagaatggaaacggtccttactttatgcttctctccaaactgaaaattccacaattcatttggcatgtttcaaacttatcttgttcttgcttcttttgcagatttttcacttcataattgcatcgctgaagtctgggagatcatctgttctactggatgttattatcggactcatctaccctgttctctcattacaggtatacatcttatgtttacatgatgacatgatttttttttctcgaaaatgcagaactgcgcctcattatattaagaagagagaaaggggctagagccctacaacacaccacacacgacccacaccactcaacacaactcccaactcagaaaactcatttgttcttttctctggttttcaaatcattatttaagtaatgacttgagtcttcccttttcttgttgaaggcttgacaaacatgaaatttcttccaagttgtgcctttttgtattaagtggtctgaaaattttcaccatagtttttgcttgtctactattccctccgggttgataatacttgtcgttttggacaagggcacggtctctaaaaaaacaactttaaccattattttctattataatatatataaaagtgttaaca

SEQ ID NO: 92459 - DNA, 711 bp, Oryza sativa
atttggtttttatattccaatttcctaatctatgatgatctcgttgagttttgcttgtttgaaaaaacacagtgctttaagaactttttagatcaccatgtccgactcttttttgacattagattttagtaagatttataagctgtataatacttatcttttttgaagcgtgggatgtgccttttgcacaatacataaccatattgactaatcttaccgttgcctgatgctattcttctctgtatctgactatctgccgatgatttcttcttgtgttatttcacaatattgagattcataataactcaaggatgtgcatatcaggtacatgatactagcaacatccacagtatcgacattcgtgaaatatatattctatgtcagtgacatgctaatggaaggtcaatgggagaaaaaggcagtgtatacattttacttggagctcatcagtgaccttgtacacttgtctttgtatatgctcttcttcatagctatcttcctgtaagttctcttaagatgatatttctgctttatgtgttgtactgtcaacctgggtaattgatcttctatattgatatatcaggaactatggtgtcccactgcacttgatacgtgagctgtatgagacatttcgcaacttcagaatccgtatcgcggattatgtacgctacagaaagataacttccaacatgaatgaaagattttcagatg

SEQ ID NO: 92460 - DNA, 609 bp, Oryza sativa
tacggcggcataaaggccagccgtgcaagcggaaacaccagtcggcggcggcgaaggcaagccggtcggtgaagacgtagacgcccaactacggcggcataaaggccagccgtgcaagcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggggacaccagtcggcggcgacgaaggcaagccggtcggtgaagacgtagacgcccaacaacggcggcataaaggccagccgtgcaggcgaggacatcggtcggcggcgacgaaggcaagccggtcggtgaagacgtagacgcccaacaacggcggcataaaggccagccgtgcagcgaggacatcggtcggcggcgacgaaggcaagctcggtgcggtgaa

SEQ ID NO: 92461 - DNA, 1017 bp, Oryza sativa
ccgattggtgtcaccgcctgcacggctggcctattatcccgccgttgttgggcgtatacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtatacgtcttcaccgaccggcttgccttcgccgccgccgactggtgtttccgcttgcacggctggcctttatgccgccgtagttgggcgtctacgtcttcaccgaccggcttgccttcgccgccgccgactggtgtttccgcttgcacggctggcctttatgccgccgtagttgggcgtctacgtcttcaccgaccggcttgccttcgtcgccgccgactggtgtcctcgcctgcacggctggcctattatgccgccgttgttgggcgcctacgtcttcaccgaccggcttgcctttgtcgccgccgaccgatgtcctcgcctgcacggctggcctttatgccgccgttgttgggcgtctacgtcttcaccgatcggcttgccttcgccgccgccgactggtgtttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatctggtttatacagctaccactactgatggacatcatcgtcttcccgccgccga

SEQ ID NO: 92462 - DNA, 632 bp, Oryza sativa
ttcaactatgcatcaatgtttgattcatggcaaggcgacaaaatagagatcgtgccagccgacaagtcagtaaatgttgccagtgctgatttagctctttgggagatggatagccttgattgtttatctggaaaagtctgggatagagattttctaaaagtgtccgattctgatatacagccaattgaagatggagaacccaagctattactttaagggcgtcgtggagggttcaagtgtctacactacggacacggtagatgatctcgatgacaagcatggtcaaggtttcatgtcggccgatgatttggaagaagtggacataggtccaggcgatccggcccaggccgacatttattagtaggaacttatctccagagtttagaaccaagctgatagagctcttaaaagagtttagagattgctgagcttgagagtattatgagatgcctggactcagccgatcgattgttgaacatcggctacctatcaaaccaggggttatgccacatcaataacctccgaggagatgcaaggccgacatgcttgaaccggtcaaggctgagattaaaagattatatgatgctggttttattcgtcctcgccgatatgctgagtgggtttctagtata

SEQ ID NO: 92463 - DNA, 598 bp, Oryza sativa
gacaagaggagaaatacatatttataaatattttaaaatacttgattttttctcgagtattatatttatatcagatactactcatcctatatgtttgttctgcaggatccagatccagatatgcataaaagggattcatggctttaagctatctcttacgctccaggaatggatcagtcagaacatcaccaccggctcgcctcgaccgccgccgactggtgtttccgcctacacggctggcctattatgccgccgttgttgggcgcctacgtcttcaccgaccggcttgccttcgtcgccgccgaccgatgtcctcgcctgcacggctggcctttatgccccgttgttgggcgtctacgtcttcaccgaccggcttgccttcgtcgccgccgaccgatgtcctcgcctgcacggctggcctttatgccgccgttgttgggcgtctacgtcttcaccgaccggcttgccttcgtcgccgccgactggtgtccccgcctgcacgggtggcctattatgccgccggttgttgggcgtctacgtcttcaccgaccggcttgccttcgccgccgccgactggtgtttccgcctgcacggctgg

SEQ ID NO: 92464 - DNA, 747 bp, Oryza sativa
gacgcagagaagctcgcctcgtctgccgcatgtcctcaaaacgggaaaagcaaaacccccctttccactgcctcgtcctccctttttccttcccgagctcgaccgctctccctctgtcctcgtctctttgcacgtggaggcagagagccgctgacgccggtgcgccagctcgcggcccccactttgaccgcgccggcccgcgctccgcgttcaaattcgaccgctcgatccaccgaccccgccgcccaacgcatcctcgccgtcgccattttcgggtcgcctacgaaaccgtcgccccaccgccagccgagcgccagctcgtgtgcgatctcccccttgcctataaatcctacccaccgagccccaaatcctccctcaacctcggtcgccgtcgcgcggtcaaccccggagcaccgccgcctccttcgtcgccacggacaagaacgccgcgccgacaccaagccgttccaccccacgtcccctccttccctggtgcgcccgcttcggcgtcgcattcgtccccgtgcgccgccaacggccttcctccccttcccatcctcaaatcgccgccgacgccattcctcgccgattggtgagctccccgtccccttccccttgccgtacgccgtgttgcttcggtctcgttttcactcttctcgccatcgccctgccaccatcgccgccgagcgctccgcgcgccgtcgtcggcccttctctctcgtcgaaccactcgctgtcgccctcccg

SEQ ID NO: 92465 - DNA, 4749 bp, Oryza sativa
cagttgttgagaacaaccgggagtaaagaaaagatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaattgtcaccgtgaaagggggttacccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggtagttgttccatcgtgtcccatggcatcgacacgaacagcgctgttttggttcgtgctcttcatgtcttgggctctcatgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcctggacattgtctggaaggataccccttattacaactggtagcagttgtgtcatcaacacgtgacagtcatgagactttaggtttgtgaacttcttctccttcgtgcttattattcgcttgatattcgtggagtatccaaacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttataccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcataccaaaccgtatgtttcgtgcgtcctttccaaattctttaaattttctgtcgatgtttcgccactgcgaaccatcggcggggtgtctcagcatcccgtcctgttgacgctctttaagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaattgttcggacatgcgtgaatcttatgaacttccagtcctaacgggcagactatcttcttagcctcgtatgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccataagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaaatttggagacaaaaaaagtgtgcaaaacataagtgcaaatgtagtatgacaaaaaaaaacattggaggatgaagttgcaaacctttt

SEQ ID NO: 92466 - DNA, 2270 bp, Oryza sativa
cggccttcacttgggacagtgcagcaggaacccttatgagtatgggtgaaaacggtatggaaactttacggattctggacctatttttgaaaatggaattggtcggtccgaattttttcgaaatttttcggaaacgcaaacgaattcggaaaatatttctcagaaacagaaacgaaaatgataagagtagcttccgtcggaactcggaatcggtcggaaactttccggaaattttctcggaatttccagaaattttgtgactgaaataccctggattctttttttaagcaatgaatagtgaataccatggtatttggctgttattttttaaaaataatatttgttatgcaaatctgaagttacataagaatatttttttcatgcattgagatttatctacaacattactctcttaaacatagataatttattttatagattgtgttttgtgatgtactgttaagacttaacaattggacttatatgattgtgttttatgatgaattgttgactgtttgaaacttgagaattggatttatcagtttgagggggttttttactctaataaatttccgttaccgtattcacgccggtttattttcgctccgatttcagttttgataatatttgatttcgttttcgtatccgaggtttccgattcccaaaaaaatatgaaaatgaaaatgataaaggtggtttccatccatttccgtaccgttttcacccctacttgtgagttgtgacaccccaaaaaaaatggaggagaaaaataaaaagaaaagagggttgcttgagctgcttagctccttgggcctgaaccagtgtgcagcaagttgggccttagcctggttggtagcaagtgtgcgtgcgtgcagctgcagtagcagcctagcaggccggccggtggctagcagcagcagcgagcggagcagcagcagttctggagctcggcacgcaccagctagtaccatgtaagtttggagagaaagagacagcagtagtgtataagaatgctcgagcaacccagactaaaggggttacaaatcgaaacctcgaatccagaactaaagatgatagcgccacgtgaataacgctaccatctttattaccggttaccaaccagaactaaagtttttttttcttttttttattggtttattttgctgcttgcaaccagacatcaatactgccatgggaccaaaattccacggtgatgtcatataaactccacgtaaagttgaaagacggctggtgaacttattccttttccaaacgcaaatgatggtccagccccgaaatgcccagtgcttaggattaaaggattagttcatcttaggtcccttaacttggcaaggaatccgattttcgtccacaaacgggaaaatcagatacagccgtccctcaattgtcaaaaccaaataaggccctcggtggttttaatggcggttttggctgacgtgacgcctatgtggctaatttgacttaatcttcatctgatggggcattgacgtgccggttacgtggcaattcaaacccgaaaaataataaacctcatgagacccacatatcagtttcacataaaaaaaatagtagggcccacataggccccacatgtcattttcagtcccccctttttcctcatcattctctccccatctccctctcttcaactctctctcccctctcctctctagcgacggtggaacggctccggcggctgtggccctggctgcggcgcccggcggagatgagctgggcgtcggtgcccatgccaccgcctcctccattgacctcgccgtcgccggtctcctccagtatactcaactgcatcaagaggtatatactctttctaagaaaagaatggcaagataaagagctgacattgcagagtaacaacactgctactccagtaaacactgagaggcagagtgtacatgtaaaccaaactcattttcccattcaactgctatttgccatgctaattactaaattgagcaccgaaaggatcaaagaattaattaacccgtcgctgccgcggctcctgcaaccaacctgcaccttcgtgctggcgccggcgaccaagaagcacccaggcttgctcccgagctcgagcgagacggagccgggcttcccgtcgagccccggcacgacgttgaacatgcaaccggctcctccattgacctcgccgtcgccggcgacctcctgcccaaatctggcctgagcttgccacgctccttgtgggcggtggcaaccgcttcttgaagggcggg

SEQ ID NO: 92467 - DNA, 1858 bp, Oryza sativa
acgcagaagagaaaatgaagtttgatatttcgattcaatcacaaatttacaccttcctctgtaacatcgaaaatagcctacacatcagccacgttctccgtaccaagaaagaacgataaaacttaaagtgttctacacaccaaggaaaatctacaatcttacaagatggtgacacacaatgtgctctaaaactaagatattagaatgcgcatggcacaatggccaggttatttaatccattatctaaaaaaagaattgctgcacagcctgcactgataggtaagctaagattgctttggcggtcatgagcctgctttcttcttcatgttcctccatttcaccctcaggtcggatgcgaggcgtgtcctgtggaacacatccctgccgtaatccagtatctggacccacggaattggcccgttgtcacttggggtgaattttgccattgcttcctgaatgaaaaccccgcgaattgtgtaagcatacaagagacacatgtatgcgcattacttactagctgggccacagaagatggcgcaggatatcggtgaaggtaaaagggattatacagaccaagtgtgcttaccctcaaagttgcctcctcttgttctgtccagcagagctttgtgcgccttccagctggtccgacagggttagagctgaaagaaaaaggcatgcttaaattcttgatactactaccaaagtgtcacactttcaagtgaaaaaaaaatacaacaaatgaagcatccgaattggtatctgtgctaagcaaacactgaagtcctgtaaggaaaatgagtcaaaatttccattgatgattccctttttgttgtatatacttgtgttttcacgcatcagagaataataagaaaaaaccattatctatgtcaggaccacaagtagagtctaatttcaatatcctaaatatgatttcttggatcaatggttcctaagaatttgctttccatcttacaatactattacatgataaagctaatgtcctcttaaaccatatggaagctattgcatgatgctgtctatcagtctatgacattgaaccatgaatattcatggaaacttggttgcaacttgcaagagcgctgatactcaatgttctatcccaccaactctcacagtacagttttatttgtcacatgtctaaatcagagtgttcaatttcatttggtccattgaaccacaattcatagacatgtctaaatcagagtgttcaactaccatttcttttggctatatgcaaactggcagtaaatgggagtacaacaggagaaagaagtttcctcaaaaaaaaaaaaggagaaagaagtgcttatgaagcttattagttattgatatcacttactaacgcttgggtggatatgcatagttccttttccttgatggtgaagccatatgttgatcatggtgccccagtgttttcttagaattaattggaattgctgtattattatcctgatatcttgctttgcggtgtctcaacttgcgccaatgaggcgatggttgcttgctagggtcactagaagatgtagcttcgatttcatcagaatcttctgactgttgagaacttgcaaggacatcttctttgtcagcatcaatattctgacttgcagcaggactgcacttgttctgagatgaatgtgctgttttgtgcgatgaatttgtattaccagactctccactagcttctgcattttcctctggctgctcctgctctgcaacctgagcttgttttctgttattctggagtacaagaattctttttcatggatacaacatcagagttatgaacagtgggcgcctttttagtgactactttctgagtgcaagcatccctagcatt

SEQ ID NO: 92468 - DNA, 500 bp, Oryza sativa
tccaatggccaacaatagccgaagcccaagggacaacgccagcccgagccctagggatggaaatggtgatggtggtagccgtggcggctcacgctcgcccagagcaagcgagtcccctgaagcttgaaatttaatcccagtctctggcgttcatcttgtggatggtcgatgctatggttgtaatagttatatttccggtttaagacgagatcaaggagtcttaacacctgaaaggatttggtgcccttggggctatgctatattgctattggtgtgtaatggatcgatgaactttctattagcctgcattgtttttgcggtctggtatcaccctgagattgcaacttttgttgctttggtcgctgaacaacgttgacgacagttctctttcatctttgttgctaaatgttcctggagacagttctctttcatcttgttgctaaatgttgctggtgtagcgctcagaagctgccttgaagtttgcatatcatgttccctcg

SEQ ID NO: 92469 - DNA, 2514 bp, Oryza sativa
acaaacagagaatgaatggagacggatattggggaaaaatgcctggtccatgagcaaacttcctcgtgaattaagtggtgctttatatctgagttatgaagtgctgccgcaccaactgaagcaatgttttctttattgtgcacttttccctgaagatgcaagcattttgcgtgacgatcttactaggatgtgggttgctgaaggctttatagatgaggaaaaaggacaattactagaagatacagcagagagatattattatgagctgatccatcggaacttgctccaaccagatggtttatattttgaccacagcagctgcaagatgcatgatctcttaaggcaacttgcttcttatttgtcaagagaagaatgttttgttggagacccagagtcactagggactaatactatgtgcaaagtacggcgtatttcagttgtcactgagaaggacatagtggtgttacctagcatggacaaggatcaatataaagtgaggtgttttacaaacttatctgggaagtcagcaagaattgataattcacttttcgagagacttgtatgtcttcgcattttggatttgtctgactcacttgtacatgacatcccaggtgcgattggaaatttgatttatctgcggttgctcgatcttgacaagacaaatatatgttctctcccagaggccattggctcccttcaaagccttcaaatattgaatttgcaggggtgtgaatctttgcgcagacttcctttggcaacaactcaactatgcaatttgaggcggcttggtcttgctggtactccaataaacctggttccaaaagggataggaagactgaaatttctcaatgatttagaaggatttcctatcggtggtggaaatgacaataccaaaatacaagatggatggaatttggaagagttggctcatctttcacagttgaggcagcttggtatgataaaattggaaagagctactccttgcagcagtagagacccatttctactaacagagaaaaagcatctcaaagttctgaatctacactgcactgaacagacagatgaagcatattcagaggaaggcattagcaatgttgagaagatctttgagaagctagcacctccacacaacttagaagttcttgctattgtgaatttctttgggcgaaggttccccacctggcttggtactaaccatttgtcttcagtgaaatacgtgctcctcatagattgcaaatcttgtgtgcatcttcccccaatcggacagctaccaaacttgaaatacctaaaaattaatggagcaagtgcaatcaccaagattggacccgaatttgttggctgctgggagggtaatctcagatccacagaggcagttgctttccccaagctcgaagcgttggtcattgaggatatgcccaactgggaggagtggtgtcagaaccctgaaccagaaatggagaaacagagtagcgatttgtgaattttggtaggatttgggtggccgccgcaagactatctcctagggttctaagttagctactcctaagacaaatagaaattgtgattcttcttatcttcttcccacagcaaaagccagcttaagtaagtttacagcagctaaaattattacagtgaatgtaaagagcaaaacgacaagctttgatagctacagcggcttctcatgacgttaacaccgtcggatccctctctcgaacacgtggctttgtctcatctcttagatcttcattacccaggatgaaacgttttctccctcctttgcatcttcagttaaccgaaactctgaactttctaaaatttcctccattcttcttacgagtctgacattactccccccttaagcccaaccttgtcctcaaggttgaaaatttggaaacactttctgaatataagaagcatcctcccaggttgcttcagccggagttaaattgctccacagaattagccattgagtgacagcaacattgttccttggaatcattctcctttgcagcactgctactggctctgttttgatttgaccatctggtcccactgccggtaaatttggcattggtacagcatgagtacccaggtgctttttaagttggctcacatggaagaccggatgtatagcagcttcttcaggtaactgcaatctataagctacagcacctaccttctctagcaccttgaatggcccatagtatttgcctcttaactttaatgatcctctgatcccaaaagcattttgtctatagggttgtagtttcagatataccatatctcccacctccagctttctctctgttcgattcctatcagcataatacttcatccttctttgtgcatcttccatgcttgctttgagtttctgaactatagtctctttctcttccagggttacccttgcttcttgagatacatcacatgggacagaaaattcactgatttgaggtggactgtatccataaagggccttgaatggagtcatttgtattgctgtgtgatatgttg

SEQ ID NO: 92470 - DNA, 716 bp, Oryza sativa
atacgtaaatggattaaatttccaatataatctggtattgtttgcacaagtgagtcacttagatccaaaacacgaagatgagttaatctcatgaaaaatgtgttatcaactccctgtagctgatgatcagttgtaaaagttctcaacttaatttcctccttaccagtgaaaggtatgaccaccgtgtctttctctccgacaactaacatgcgtcgtagtttacatatagtattgtctactaatggttttagatctccaatatgacattcttcccttgatagataacaagcaagttgccttaagagatcatgcattttgcatctgctctgatcaaaatatgtgtaaactggttgcaggagattcctaattattagttcatagtagtattcttctgctgtatcttctagtaattgatctttgtgcacttctacaaagccttcagcaacccacatcatgataagctcatcacgtttcaaggtccagtcttcaggaaatacaatacaataaagaaaacattgcttcaaatgcagtggtaaatcatcataacttagatatagtgcaccacttatttccttagggagtttagccatggaccaaacgtttttagctaaaatccttttccatttgttctctgttttatctttgcttgccaatactcgagcagtaaccttgattgcaagaggtagcccaccacatttctgaacaatctcaatccc

SEQ ID NO: 92471 - DNA, 731 bp, Oryza sativa
attatatggctggcctagaagcagttagatacaataatggtccaatcatacttctatactccttctgatcaacagcttcaccatcttcatcaggatccaacacaactatagaaccaattggtgttgaaattgccttgcaattctccatcctgaaccatctcaaaagatctttcgtgtacgataactcacccatcatgctcatctcaaattccctgcgcatagtctcagcaaactctacaaccaaagcgtgagttgaacaaccaaagatgatatcatccacataaatatgaacaaaaagcgttttgtcaacctttcccattgaaaaaccttttgcaagaaaaaagttcttacgcctatcataccatgctctaggtgcttgtttcaatccatacaaagctttagacaatttaaaaacatgctagggaaaattaggattttcaaaacctggtggttgtttgacataaacttccttctgtatgaaaccatttagaaaagcacttttcacatccatttgatacgatttaaacctttcgaagtagcaaaagccaacaaaagtctaattgcctcaatcctagcaacaggagcaaaagtttcatcataatccaaaccctccacctgagtaaaaccttgagcaacaagtatagctttatttctgacaatcaaaccatcctgattttgtttatttttgaaaacctacatggttccaataatattatgtcgggctgcaggaa

SEQ ID NO: 92472 - DNA, 1734 bp, Oryza sativa
atgccgccgttgttgggcgtctgcgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcgtcaccgaccggcttccttggccgccgccgactggtgtttccgcctgcacggctggcctattatgccgccattgttgggcgtctacgtcttcaccgaccggccgccgcatccgccgctgactggtgtcaccgcctgcacggctggcctgttataacgccaactaatgctatcttcttcacggctggccacgtcgccgtcaccgctaataggcgttatcatcttcaacgcaagctgtctacatctgctgccgactagtttattcacttccatggctgcatgattccgccaatgttgattggctttatcttcttcatcgccggtcgtctcgtctactgctgactagtgccctcgtctctacatctggtttatacagcctaccactactgatgaacatcatcgtcttccgtcgccgactagtgcttttattttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcacaagttttgctacatcaccaaccatgacgttgttgtgaatctcgacatctcggcatgcgatgccgtgttattttactacaacaagtggctctccaacattcatgatttctacttggacatcttcaatacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttgggcaacaacatcaactctcctccaagtgaagcatctacaacagctataacattaatttgatggattattgtcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcttcttcatcatgtcggttgcgtttgtcgtcgtcaactattttctt

SEQ ID NO: 92473 - DNA, 10513 bp, Oryza sativa
tcatggggccctccggctccggcaagtccaccctcctcgacgccctctccggtatcctttcttccttcctttgccacctccatctctctttgcttcatgcatgctcagcagcaaaatcaaaataaatattcttttgaggagattaacaatttaacatggtttaaattcatggaacagttaatttttttgcgttgatttttgtgataggatttgtattcaaggcaaggatttttgatagatgggatattggggttgttttgagtgtggcatcccattccatttcaccccatgtactgcacgaatttcaccccatgtactgcacttcttgctggcttgctccatgcatgcccagcagtcaaaaaataaaaaaataaatcaaaacgcggtttatcaatgaattcttttttcgaggaaacatggtttgaattcatggaacagttcaaatttcgcattgatttctgtgccaggatttgtattttaaggcaaggatttctgatagattgatatggggttgattgattctgtttttgagtatggctgcagggaggctggccaggaacgtgctcctgacagggaaggtgcttctcaacggcaagaagaggcgactcgactatggcgtcttggtgagtttgctaatttagctcacaatttcaacatgcagatgctcatacaatttctaacttttttcactctgaatcttactcatcaaccgtattcatgttttttctattgctgattaatcaattcgtcagcttgattagagtgttccaagttcgacgctgcttgagtgttaaattacgcacgaatttatcactgatactacatcttaaccccactagctgcaaggacgaagaatgtggacttaacccagggaacaaatatagattcagatcttgtttggaattgaaggagtgtaggataaatcgcagatttgacgttggggtgtgtgagacttcctgatgactggcagaactatcacacgtgtagccactcggtgcgccgactcggggtattcgacggctaaggatgcatagatagatgtatggcacctagctagatacagtcatagagtacagtactgagcatggcatcccatgtgcacactctttaattttaggtgaagcattggaacaaatgcaattatgcttggtaccaaagtagtgtataccaaaccaaagcaagccattaatttagctagttagggtgcaacaaggctttttatttgatctgctggtgattgcttagttcctcccatgttcatggtttcctcttcagagttcctatgttcctttcactttgaatacaggaatgtactaattttgcttgtcttatcttcaaattagtatatattgcttaaaaatatcactgtgagtctcttgtagcagtctgtatagttgcactcagaatggagtgtgagagggacagtttggtgctgcccaactaatttttcatttatgccaattaataagaggacacatgtatagcatatcagcattacaaatgtagttatgagtctctttcatatgtttcaatatgtgcacgcatgcactgtcactgatatttcaaagccagatgggcttctaaattaatacagtatcagatacccgatccctccggccggtcataaaaatatgtcgttttcaacatcctaagtcaaacttttgaaacattaaacatttctatcttttagatatttgggttagatatgtatgaaaatcataaaatccgttgatgaaaagtactttttgtaatattgcaatattattcggttttgcaatggcagaattaattatgacagcttcgtatagttgactgctgaagcgagagaggtcgatcagaaatcacttaattgctagtgctactaactctgcatcaattcctacaatttcataacagttttaggagctatctgatttccttggaagaccctttttacatgatgactgattgattaatttcaaatctattacatactatactatactagtactataagtttttttttgcgtaatagtataagctaatttcactagcttttttactataaattgaaagattgcttgagatttttaaagccctctggaaccacagtaattttcataaaaaaatttcatagaattcatagctagtcaacaacatgattctcacatacacataaataccacagaattcctcatcattggcaaatctgagtgtgcctatcatttcaaatttaaccactatggtaaaatttgatttgctgaggtaacttaaatcaaataaccaatcaattagtgatgtagtaatagcacgggcatatgatgacaggcgtacgtgacacaagagaacgtgctgctggggacgctgacggtccgggagacggtgacctactcggcgctgctccggctgccgtcgaccatgtccaaggcggaggtccggcgggtggtcgacgacacgctcgacgagatggggctccgggagtgcgccgaccggaacatcggcaactggcacctccgggggatcagcggcggcgagaagaagcggctgagcatcgcgctggagatcctcacccgccccaggctcctcttcctcgacgagcccaccagcggcctcgatagcgcctccgccttctccgtcatcgagacgctccgccagctcgccgtcgacggcggccgcaccatcgtctcgtcggtgcaccagcccagcagcgaggtcttcgccctcttcgacgacctctgcctcctctccagcggcgagtgcgtctacttcggtgacgccaagcttgctccacaggtgtgtgataaatcttcagagaaaagtacttgtagtaataatcttcctttttgttttctccaattagcaatgaacaagtagatgatgattataaaatgagttttagatataatttatgtgatggtttctgtaattgttgctgttcctgcagttcttcgcggaaacagggttcccctgtcctagccggaggaacccgtccgatcacttcctccggtgtgtcaacgccgacttcgacgacgtcgccgccgccatgaaaggatccatgaagctgcgagcagtatgtccagctactgaagagatgtttgtaaatgtgatttttatctgatggaactgaattccgacaattttgtgtttttttcaggaggcagattttgatccgttactcaagtactccacgtcagagatcagagaacggctggtggacaagtacaggatctccgagtacgccatgatggtcaggaacacgatacacgagatcagcaaaatcgtaagcacaaacctgaatctcttaccacatccaaaattaagatcaattcaaaataaaaatgaaaaacctgatcaaacattccaaaaattccaaacgcaaaatgcaggagggagtgatcgaggaggtggtgatggggagccaggcgagctggtgcaagcagctgacgacgctgacgaggcggtccttcaccaacatgtcgcgcgacttcggctactactggctccggatcgtcatctacgtcctcatggcggtgtgcctgggcaccatctactacgacgtcggcacgagctacgcggcgatccaggcgagggcgtcgtgcggcggcttcgtgtccgggttcatgaccttcatgtccatcggcggcttcccgtccttcatcgaggagatgaagatgttcacgctggagcggcagaacggccactacggcgtggccgcctacatcatctccaacttcctctcgtcaatgccgttcctgctcgccgtgtcctgggccagcgcatccatcacctattggatggtcaagttcaggcccgggttcagctacttcgccttcttcgccctcaacctctacggcggcgtctccgtcatcgagagcctcatgatgatcatctccgccctcgtccccaacttcctcatgggcctcatcctcggtgctggcgtcattgtaagctaaaataacctgcacatttctattaattgctactctcttcgtttcaaaatataacaatctaagatccgtactagaaatctgacataactcctatctagttctagattgctatattttggaatagacggagtattactgaggaatgccttttctagcttgtatgctgaatctttccatggatgtatatatgatgtaggggatcatgatgctgacttctggattcttccggctgcttccggaacttccaaagatcttctggcgatacccggtgtcctacattgtctacggctcgtggggtttgaaagtaattgacttctgaatgacttaccatgtgcattcttacttggtgcagagaccgaagttacgacaatggtgctaatcactctacctgcattggaattgcagggagcgtacaagaacgatctgatcgggctggagttcgagccgatgatgccggggcagccgaagctgacgggggagtacatcatcaccaagatgatggggctgagcctcaaccactccaagtggctggacctctccatgatcttcgtcctcctcttcgcctaccgcctcatcttcttcctcgtcctcaaggccaaggaggccgccgcgccttacatccgcgtcgcctacacccgcttcaccatcaaacgactcgagcgccgcgcctccttcaggaagacgctcgccatgtcgtccatgtccaagcggcacaaccagccgccacaccccatggccgtccaggaggggctcaactctccaatgccatactgaagaactgttattacaagttacaactactactactgatgatgatgaagatgaagatgatgattgatcgatcgagcaagaagaggccggtagtttgggcgaccttgcgacgacgatgacaacaaagatgatgatcatatagatggtgttcgtgtgccacgaatcgattaattaatacttgtgtatgtgttgcccttggattgttttcagctcgttggaagctggaagggttcataaactgatagcgtattcttttttttaagatcttgtattttactgtaagaactcggtctctgtgaccaatacacatacaaaaaggatgctgtgtagttgagtgtttgttgtttcttgtttttttccctgattatttatctggccatgtcgatctggttagaacatgcttgtgctacattgatctggaagaaaatgcctgcagactgattactatcgatctcaaaggacaaaacgatgagaaaacaaaattttcatgagggcagaatggaggtaaaattgatacggcacgaggatcatgggtattgggaagtgcccttttcccctatatatgatggaattgaagtgatttcctgaatagtatgcatccaggtgatttctgttatcacaacagattcaacagtgtagttctgagagagaaattataaagcagagtattgaagaatcatccaatgttgcaagtgcaagaataggaaggattcatttattcattgtactattatatcacctgaacaaaagtactaacaaaatatagtggttgagtgtagcatgacaaactttttgttcaaattaatgctcaaaaagcacagcacaaaactcatgatacggttaaaaaaaatctacttaaaaaactttcacatgttttttcggtcgaaaacttccaaatgtaactacaatgtagtttacactgtaactaaaatatatgatgcacatagctgataaagggtaccctggtttgatccccgcccagcccgcgcgaggtttttgttctgcccgtatatgtagcacaaatcttggagcggatcagacagctagaaaataaagtttcccaaacaaaaaaccatcacaaattttctagtaaaacaaaaaaaatcacatgagaatcaactggatctaggaaataccactctggttttcaataaatgacgatgccattgactttttaggcaaaatttgctacgggactcttaaaaaacgtgtaattagctgtgggacaccgtaaaaacgtgaattggctatagaacaccgcaaaaaagtgataattagctactagacaccggaggtattattttattattccctataaaaacgaagagagaaagagtgttgaaagtaccaaaatacccctgtgtcgttttgcttgttctggagtcccactgatgccgctgccccatgccagcgagctgccacgccatgaccggactaagcaaggagagaaagagataagaaatagaagaagaagacaagagaaaaaaaaaaggaagagcaacctgtagccatcgcgtggccgccggcgaacagcacgccgtgccgtgccacgccaccacggcaaacggctgccgccgggcagcccacaccgagaccgcggcgctcacacgcgcgccttggcacgcactaccgtcgctcacgccgtgcctctgccctcgtcgtcgcacggtcatgccggcgccgtccgaccattcctcattgctccaccgccgcacatggcaaggaaccatgaaaaggaggaagaaatggaaaaaaaaaaggaaaaggcgctgatgggcgtcgccgcacgccgccaccgcatagtcgaatggcgccgtcgccaggcccccacaacgcgtgaacccatcgtatctaggtggtgtttggttggagggactaaagtggggctaaactttagtcccttagggacttatgtttttgtgagagcgactaaatttagtccctagtgtggagagaactccttcagcgaggagtttacgtgttaattacttaccacaaaccgggcttaacagaatacaggtatatatagctcggatagagttgttgtgcatctactaaaacataggaaacttatcttatctatctaaacagcccaacaactcttatccttcgctatttgttacattatcatatgtgagaaatatctaacactccccctcaatctgaacctgtaaggtttagattgtttctaaacatctctaactgtctgactgacagtgtcttggtgaagccatcagcaacttgatctttggtagatatatattccacttgtaaaaattttcttgcaacccgctcacgaacaaagtgataatctacctcaatatgcttggtgcgagcatgaaaaacaggattagctgtcatatactttgcaccaatattatcacaccataccttagcaattttgggtgcctgaattcccagttcatgaagtaaggtttgtatccacataatctctgcagtaacattagccaaagccttatattctgcctctgtactagatctggatacagtagcttgcttgcgtgcactccatgacacaagattaggccctataaaaacagcaaaacccccagtagaatgccgatcatccaaacatcctgcccaatctgcatcagagaaagcacttacaagaagagaattagacttgctaatttttagcccaagcttaactgtatgtttcaaatatctcaaaatcctcttagccgccgcccaatgcttagtggttggtgcatgcaaatactggcacaccttatttactgaaaatgataaatctggtctagtcagagtcaaatactgcaatgctccaaccagacttctgtacctggtactgtcttctggtccaaaaggattaccttcatgagcacttaatttttctgaaatagacaaaggagtattgactgctttacagtcactcatattcactctctttaacacatccatagcatatttctcttgtgtcaaaactatgccattatttacttctttcacttcaatgcctaggaagtaatgcagtcttcctagatccttgagtgcaaattcttgattaagattcttaagcaaagcattagtggcatcaatagatgagctggctactataatgtcatccacatataccaacataaacatagcaacatctcccttactgtaaaagaacaaagatgtatctgacttagatgatttaaaacctaactcatgcagcttagtacttaacctggaataccatgccctgggagcctgctttaaaccatataaggccttatctagtttgcacacatagccatctttctgttcataacctggtggctgcctcataaagacatcttcctctagaaccccatgaaggaaggcattctgtacatctagctgacgaagggtccaacctctagagattgctatggacaaaatagttctgatagtagcagccttaactacaggattgaaggtgtcctcataatctataccatatctctgtttgaacccctttgccacaactctagccttatatcgatctagactgccatcggcctttcgtttgaccttatagacccacttacaatctattatattctgccctttcttagaaggaactaggtgccaggttttgtttttcataagagcctgatattcactatccattgcttctttccaatttttatcacctaaagcctcatgcaaagtttgtggttctccagaagatgtaaaacaactgtatctaactgtcccatcagtgtatattttctcttttctaataccactttgtaaccttgttttaggtcgtattacctcagatagctgtgcagactcagacggcgcagatgatcctggctgatgtgactgctgcgcaccacctgacgaagacgcgacagcacgggcaggcgatggaggagcagcagtaggcgatgcagcaggcgacgtggcgcgcgctggttggatgcccgagcgctgctgctccgactccccctgcgtcgcagatccggaggcctgccgctgcagctgcgcctggaccgacgctgaatctgaggcggattctcccgccaagtcgccatttgctccatgtacccggccaaatgcccccggtatatctgaattcacatttctgggagattctgcacatgaaatatcagtagcatttggcatagagatattaaacagatgatcatgatgttcctctcccccttgatcagatgttttctcattgattagagtaggaggaagcaaagaaatttcagctcgaagacgggcgccagcatttggatgaagattagcaaagggaaacacttgttcatcaaaggtgacatcacgagatacatataccctgccggtagaaacatctagacatttgaaccctttgtggatattgctaaagccaagaaacacacattgctttgaacgaaattgaagcttatgagtattgtaggggcgcaaatttggccaacatgcacagccaaatgttcttagagatttataatctggtgtttgcttaaacaaccgttcaaggggtgtatcaaattttatgaccttactaggaaggcgattaatgagataagtagcagctaaaaaggcttcatcccagaatttcaaaggcatggaggcatgagctaaaagagatagaccaacttctactatgtggcgatgtttgcgctctacagctccattttgttgatgtgtgtgagggcaagagacatgatgggagatccctatttcattaaagaaagtgtgcagcttaagatattcgcctccccaatcagtttgcattgaaagaattttgcgatcaaattgcctttcaacaagtttctgaaattcatgaaacttctgaaacacctcagatttatgcttaagaaagtagatccaaacgaatttactataatcatcaatgaaactaacatagtatttctttgcacctacagactcagaggcaggcccccacacatcggaatgaataagttccaaaggattatttgacacactagttgatctaggaaaaggtaattgatgacactttgcttgttgacaggcatcacacacagactcattgacagaattactaagacaaggcaatttattttgactgagaattctaagaacaattggcttggagggatgaccaagacgcccatgccacctcacaaaagatggcgtcgcaacgaaggcctgtctcaaagacgatctggctggaagtgggtacaggcctcgtcgacagggaccttcaagaattgtcctcctcgtggccttgtccttaatcaaaaaatatttgccatgaatttcaagaaaagcataattatctgcaacaagtttatgaacagatactagatttttcgccgcttcaggaacatgtaaaacatttttaagatgcaaggggtgactaggagtaggaacaatagcatgaccaacatgtttaatactcgtaccttcgccacttgcagtgtgaatttgatctgttcccttgtatctctccttggttgtcaatttgtctagctgcccggtaatgtgatccgtcgccccagtatcaacataccagttggtatcaacaccgtaggcgtatgttgcagcaccgccaagcttctcatcaggaacatatgagtcatcataacgatgccagcagtcgcttgcaacatgccctcgcttgtgacacacttggcacacggggcgagtatcattgcctcgcccgcgtccctgacttgcgccgctaggggcgccacggccgtgaccgccacgaccgaagccgccgcgtccgccacctctgtttccagtgctgctgccgcgtccaccacgaccaccacctcggtttgccgcatttgccgaagtggtgagat

SEQ ID NO: 92474 - DNA, 596 bp, Oryza sativa
tcatggacttcctttacatttgttatctcccgatgcggatgaattggcaatggtgtacaccgtggaccaatggtcgaaggagtttattgatggcgtgcattattttttgagtgtggacaatgcctacaagtctaagggttttatatgttgtccatgcacaaggtgcaaaaactagaagcattcttcatcaacagctcttaatatccacttgatgcaattgggattcatgcctagctataactgttggaccttgcacggagagttaggggttgcaatagaagaggatgaagaagaagacgataacatttcggactgggttcaatacggtggatttgcagaaaatacaataggcgtggcggacagtgctattgaagaaaacaagggtgcggatgatcttggtcggagttgtgtgacgtaaagaaggactacgaaagtggaaaggatgtccaaaaattgaagcgtatgttagcggaccacacaaaatgtcattgtacctagattgcgaacaagggcagaaaaagttgggtaccatgctgaaattcttataatgcaagacaaaaaatggtgtgactgacaagacatttggcgtgttgttg

SEQ ID NO: 92475 - DNA, 1861 bp, Oryza sativa
acttggcatagcggaagtagacggctcatcttgagtggaggtggatggcttgtcttccacttcaataggcttgacatctccaatggacatgttcttcatagctctcatcaagccttcatcacctacatcatccaaattctcatgtccctcttgggagccattagtctcatcaaattgaacatcggcggtttcttccacaatacctttgttcttgttgtagacccggtataccttgctatttgaggcataacctagaaaaaacccttcatcacaccgactttcaaatttggttagactatcaccctttcggtaaatataacacttgcaaccaaaaacttgaaaataggtaatattaggcttcctcccaacaattagctcataggaagtctttttcaagagacgatgcaaataaagcctattggttgcatggcaagcggtgtttatggcttccacccaaaaggaatcggaaacactatattcatcaagcatagtccttgccatctcaatcaatgtacgatttttcctcaccactacaccattttgttgaggtgagtaggtagcggaaagttcgtgtttaataccaagatcatcacaatagtcctcgatattggtattcttaaactcggaaccattgtcacttcttattttcacaagagtgcaattaaatttattttgggcccttttgcaaactttttgaaaagctcggcaacgatagacttgacatgcaaaaagaacacccaagtatagcgagaataatcatcaacaatcacaagacaatgactattaccaccaatgctcttataggttgttgggccaaacaaatccatatgcaagagctccaatagtctcgatgtagacatgatactcttagtaggatgagaacatgcaatttgcttgccggcttgacaagcactacaaagcttatatttctcaaacttcacatctttcaagcccacaactagatcacgttttgaaagtttgctcaattgattcatgccaacatgggctagcctcctatgctaaagccaacccaatgaagtttttgcaactaaacaagttttcaaatttgcttcactagaattgaaatcaaccaaataaagatttccatatctaaaacctttgaatacacaagacttgtcaagaaggctagaaacaataacttcttgcgggaagaaagcacatgacaagccaagatcacaaatttgagcaaccgaaagcaaattaaaatttagagatttaacaagagagacattatcaattgacaaatcattggagatagcaattttacctaacccaattacctttcctttgctattgtctccaaatgtcactttctcttgttcatttcctcctacctcaaatgtggtgaacatagccctatcatgtgttgagtgcatccactgtcaagcacccaatggctcccaccggtgcggtagttcacctacaaaagaagatcaagctcttttaggtacccaaacttgtttgggtccttggaggttagagaccaaagctttgggcacccaaatggcattctttttaccaccgagtataggggaacccacatatctagcaacaatgctaccatcatgagccttcctaagcatataatgagaatcaaacatgcatgtcttaggaggcttaccaccagggcaatcattcaccaaatgcccaacctcacgacacttggagcaatacttaccattgctcttgacaaaacgagtggcacagtgagaaggtttcttacccttctttggaatgaatccaagtccctccttgttaaggatgcaccattgctcactcaaaatcttgtcaagagtgttcttacccttgaagcacctctccaagctcttgttgagcttag

SEQ ID NO: 92476 - DNA, 894 bp, Oryza sativa
gccgtatgctgagttctcttacaacaacagttaccaagctagtctgcagatggcaccgtttgaagcactgtatggacgaaggtgtcctactccactcttctgggatcagacaggggaacgccagttgtttggtacagaagttttaaatgaggcagaagagaaagtcagagctgttagggaaagattgagaatcgcgcaatctcggcagaaaagctatgcagacaaccgccgaagggagctcgctttcgaaacaggggattatgtgtatctccgtgtcactccactcaggggagtacatcgcttccaaaccaaaggaaagttggcaccacgctttgtgggaccatacaggatcttggaacgtagaggtgaagttgcttaccagcttgagcttccctccaacatgcttggcatccacaacgtgttccacgtctctcaattgaagaaatgtttgagaggacctgaggaacaggcaagtccggatcacatcaaaattcaggaagatctgacatatctggagaagccgactcgtatcctcgaaaccagcgagagaaggaccagaaacaaagtaatcagattctgcaaggttcagtggagtcatcactcagaagaagaggccacttgggaaagagaagatgagttgaaggccacccacccgcacctcttcgccagcacttccgaatctcgaggtcgagattccgtttaaggggggtaggtttgtcacaccttgaagtttccccccttttcttgctttaaaaattggttaaataaattgcccgaagaaattatcttaattaacctagagctaaatccctagttaataaatgcaattaataatcggaaatagcgtggtggaatttttcttgagttccccatgctccaatgcattaacaagat

SEQ ID NO: 92477 - DNA, 1102 bp, Oryza sativa
gagcgtaagagataagcttaaagccatgaatcccttttatgcatatctggatctggatcctgcagaacaaacatataggatgagtagtatctgatataaatataatactcgagaaaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttagtcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctatagcccccgactcactgctcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcataataggccagccgtgtaggcggaggcaccagtcggcggcgacggaggcgggccggcggtgaagatgacgatgcccttcaacggtggtgtgaccaaccgaccgtataggcggggacaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcg

SEQ ID NO: 92478 - DNA, 3870 bp, Oryza sativa
gtcttaaagctggagcaaaaggttatcaaatctcaacactcaaatttcaaatagtaatgaagttctgacaacccttgatgatctggaagaacaaagacctctagctctgcaggaatggaatttcagaataattctcaaagaacatattctcaagcttttgaattacaaaaatgagttctggaaaaaaagatgtaccatcagatgggtaaaatttggggatgagaacacaaagttttttcaggcctcagcaactgatagtcatagaaggaataaaatctcgcatctcagtttggatgatggaagtatagttactactcatgctgaaaaagaacagattttatatatggcctacaaaaacagaatgggaactcggggctcaatggacatgatcttaaatttgtctgatatggttcgtagaatggaaggcttggagtgtcttagtgagatcccatctacagaagaactggacaggatcattaaaaacatgcctactgatagggctcctggaccagatggtttcaatggcttatttttaaacaaatgttggagtatcataaaacaagacttctatgagttggcttttcagttctttaccaacaatgtctccctcgagaatttgaatcactccttcataacgttgatcccgaaaaagccaactccagaaacagcaaatgatttcaggccaattgcacttcagagttcagcacttaaattcattacaaaaatcttggcaaacagattgcaggaagtaattctgaaactcattcatgataaccaatatggtttcatcagaagcagaaccatacaagattgcttagcctggagctttgaatatattcatcagtgtcatcagtccagaaaagagatgataattttgaaaattgactttgaaaaagcttttgatttggtggaacatgaggcaattctccaaattcttcaggccaaaggattcaattctacctggttagactggatcaaaaatatcttgtcttctgcatccacttcagttctgcttaatggaatccctaggaaaagtttcaagtgtttgaggggagtaaggcaaggggaccctctttctccattgttatttgttctagctgcagatttattacaatccataattaataaggcttcctcaaatgggttactctcaactccaatcccaactagcggtaattcttttccagttatccaatatgcagacgatacattaataatcttgaaagcagatcagagataagttttttgtctcaaagctcttcttaacacatatacaatgtgtactggattgaaaataaattatcacaaatcaaacatgattcccatcaacactgacagtcaaaaaatggaaattttagctggcacttttggatgttcaataggtgccatgccttttacttacttgggtctacctcttggcacttcaaaaccaaatgtcagtgactttgcaccattgattgatagagtggaaagaagacttccttcaacaacggtttatctaaattatggacaaaggctcaccatgatcaattcagttctttcttctttaccaacatattatatgtgctctcttaagctgccaaagaaagtaattttgcacattgatagggcaagaaagcactgtttgtggaggaaacataatgagtcagaaactaggactcattcacttgctgcatgggatctagtttgcaggccaaaaaagagaggtggtctgggaattatcaacctagaaatccaaaacacatctttgttgcttaaacacttgaacaaattcttcaacaaaaaagacctgccttgggttcatctaatatggaataaatactatattggtttggacaagcctccacatgcgcaaattgagaagtgatcattctggtggaaggatattttcaggctaatcccgttatttcaagctatcacatcggtgactgtaggaactggagattctgctctttttcggaaagataattggagcaatcacaatttggaaaatgaattccctgtcttgatttcttatggaaggaatgaagatgtcactgtacaaggatttctgtcagccacagatattggtcaaaactttcacttacctctgtccaaccaagcaattcaagaatggggtaatttaaacaacagattacaaagcttacagattgtcactgaatcagacaaatggtcatatgtatggaactccgattgataccaatccaaaaaagtttatttgatgttctttcagcatcttcaggttgctagaccgatatctatactctggaaaagcaaatgtacaatgaagcttaaagtttttctctggctcatgttgatgaatcgactcaatacaaaggaaatgttgcagaaaaaaacaattcaatatacaaggtggtgtcaactgtttgctatgcagctccatggaaacagagaacatgatacacttatttttcagttgcccttttgctcaacagtgtttgcaacaaattggtattcagtggaatgtaaaccaggaattcttgaacatgatcacttcagctcagatctcttttcaacatactttcttctttgaagttttggcaataggatgctggcacatatggagtagaaggaatgatctcatctttaacaatgttgctctcagcttcgacaaatggaaggatgattttcagaaagagtttgccttgcatatgcacagggcaagagagagggacaaaacagattggcaatcatggatagctaactttacttaatacttctcctttttccctttttgtaaattcttgcatccttgtaactatgttttatttatttatatttaatatagcacagtaggagcctctcctgctgttttcagtcaaaaaaaaaagagatcggtattctcgagccagtgtacctacacaacatgtttcctttcgagaggtacatgggcgttctgaagaagtatgtttgtaaccgtgctcgtccagaggcaagcatcgccaaggggtatggaaaagaggaggtcattgaattctgcgtagaatatattgaagaccttcgcccaatcagggtacctgaatcacgccatgaagggagactacggggaaaggggactcttggaaggaaagcaataatgacggtagacaacaatttattccgtaaagcacatttcacggttctgcaacaatcttcattagtggctccttacatcgaggagcacttggctctagttcgcaccagaaacatcggtaagtccgatgcatggattacacggcatcacattgatactttccccgcgtggctgcgacaacatctcatgggtaacgagacgattaaccaacaactggccttcctggcaaggggaccatctggctcgatcgcgacattccagagatatgagatcaatgcgtacacattctacacgagagcccaagacatgaagagcatgaaccagaacagtgttgttcatatcgatgccatgggacacgatggtacaactggcacgtattacggtgccatcaaggacatatgggaacttgactatggacctctcaaggtccctctgttccggtaccaatgggttaggttgactggtggaggcgtaacgattgatgacagtgggatgacaacggttgaccttaacaaggttggatactcagacgaaccttttgtccttgccaacgatgtaacgcaagttttttacgtgaaggacatgtctagcaaaagaaagaagggcaaaaggcctgacaagccgaagcgccacgtggttctcccaggcaaaagaaaaatcgtcggagtagaggataagactgacgaggattacgatcagtttgatgggcaaccccctttcacggtgacgattgaccctagcatcctcctattaaatgaagacaccccttactcaca

SEQ ID NO: 92479 - DNA, 2195 bp, Oryza sativa
ttgtttcgttcaataattaactccttgcatatatgtaaacaataataacttcctttttatcgttgtagaatggagattaaaagggctcgacggtggggggtttacgatactgggttcatcgaccctcggaaaatcaacgccgaaatgatcgacaagtacgagaaagacatagaggacaatctcgtccatctcctgacgcagcagcatttcaagacgttcatactactgccgtacaacacagagtgagtttttactatcgttcgaacaaatttcattcccatacatataacatgtacattttcatatatatatcatcacacgcatattgcagattccactgggtcctgttacttttcgacttggacgcatgcagagtcaatgtctataactcaatgaataaagaggagaagactttcgacaaggttttccaacggatagacatgtaatataattgcatctattcaaaagtcacggggatttttcctattgctattatgcgtatctcggataataattaatcatagcttgcaactgcatgtagggtttgggattggttccgtcaattggtccccgggacttggaaagaaaaacttggatggaggtttaattttctagtgagtacatgcatgatccaaaattatattgaattgaatctctaattacagttaatataagtgtatattaaatctctcgtcctttctcatgtactgtgtaaagcaggactagggaactaacttgtgccgctactacgtatgcgagtatgcccactgcctatcaacccaaatctacaccacacgagagcttgatgtacgtatatataaaccattcaaaatttcattgcgtatcgatttgttgtgtatatatatatatatatatatatattaatcagatttgaaccgaggttcatttgcaccaggaatctccaccgtagatgtgtttcaggattcacacatatgtatcagttggttactgcaggaagtgtctcttcaaaccatttaatcatggtcaaaaggtggtatggtcagatggagaggacagacatgcatgtgctgtattttctccgtgccagaaattcattatgttcacagggtgtctttttttttttccaatcggcacgttaaaacgatatatacaaattaatgatgaatcgagtaatctaattagccttttacgtcagagctataaatgagaaaatcattatgtgtgccatacgtatatggtacatatactatatatatgtatgtgtgatgttagtatatacgtgcagtttctgctgatcactctgtggtgtcatgtgggctgcagggagggcataatcgagaatgcaacctgtaccattcaacctaccaacgcacagccctatatagcagctcaatgaggttggtacatcttgatgctcattagtcacatgatggaacatgtctatgcatacacgcgtcaatcaggtgattggggtgcatatgaactgtggtctatattatccatgtcatatatatatatatatatactagcaaaatgcccgtgcattgcaccgggtaatgccgcgttggataatgtttaactgaatgattttgaaaacggtctaatatgacaataataatcacaacagatttctttttgtttggacaattattccacatatacgtgtatgatatgaacgatgttcctaacacgttagcgtaatgattgtaccatgggaggaacaaatggtgaatgcattaggttactttcatgcaagaatagatggacgaaaatttgtatgattaacaaaaaattctatatttaaaataggtaagtttatcataaaactaatgacaatcacgacagataagattacttttgcatatttactcagtctcatagtggtgatgcatgctttcttaagctgtcaactctcgtgttgcaagcgtgcgatctggtttccaaaatcatatgtcgactcacatggaggaagcaaggcgagtggaagggagatgtccattcagcgccaagcggagcgaagcggcggcgacgcggcctaagcggcatcggcggtgggtggggctccatctctcctcttcctcctacgacagatggtgagcagcacagagcggcctaaacggcaacaggaatccacctctcctcctccaaccggcagcgagcggagcggagctctggtggcgtggcccaagcggtgcctgggagtccacctctct

SEQ ID NO: 92480 - DNA, 2291 bp, Oryza sativa
tccaccactctatgacacatccaacggcttgattgtctagatattattcttcttttcatacttatagctgcattagttgagtttgatcttatgagtcgtgattagaatctcaatctctagcctgcctttgattgccgattagggtagtatcagggtttcagccgatcttacctgatttaactacatttatcttatatgccttattgacatgttaaattcgccctttatgttaatatcttgatgcatttaagtatattaggctttcgtttggtatattttacttgctgtgatatcttaatatagagtggtatcgaagtattagccgatacacgctagatctatcttatcagctatggtataaacacatatagtcttgttattaatatatatttcgatctaagtgatttatactgtctcggcatggcgaccgatctatcgcaatcacttgatttaagtatatatcgatataaggactatataccgttaatatctacagccgatcgagtatatttagttctttcttacttattaatgattgccgatcgatgcatatatgacatcggctcaaagataaatgatatgtcatcggcatctagccgatcagctatcatttatagatttaaccgtggtttctttgtctttgtttcttgttgattgcaggatcaaatcaactggcacgctcgcatacccaaaggcaagttttggacctgcattggagttaagcagatctctcaggcctcgtgttttcacatcaacacgcttttggcacgcccagtgggacccattagaagtcagagtcacaacagcggtctctaatggctgagaaaccaccagcatcactgtcctcagctggcaaagaggggactcctaaatctaaaatcccgaaacctggtacatctgaagttaatgagagtaacatcgtgcccatcactccggactggttgacacccgagcagcagaaggatcttgaggctatgatgcagtaagcacggaaccaattcttgaactcattcatggagacccgcaagggaacagttgttcagaagtataaagtaaaagtaattgctgatgttcccggaacaggttcttccaaggatgcagaagtacaacaggttccagatggtacaactcaatcaagtgataaaggtgttgcagatggttttcaagggattcaaggtgatggctctcaaggggttcaaggtgatggttctcagggatttcaaggtgaaaatcttaaccaagatggcgacactgcatcgctacagtttaacaacttccaagatcggattgactatgccgtgcaacatgctttgattaatcaatctggagtattagtcaacacattatcaaacatggtgaagtcgatggttgatggcttgatagctgaatatcaggctacaggaccggtttatttgccaggaggtgttttcccaaactatcggcccttaatcactaataatcaaccagttgtctagccaattcctcccaatgcaccatcggctcaaccgacagcaccagtatcggctcctgcacctgttgcaccatcatcggcactgggtcaattaattaatcctcggttgttggtgagagagcagccacagtatagtggacaaaatgtgaatcggctaactcaagatcaagttacaactatgttcctaccacctcaacctactgttgacacaatccagcaacagccgattcaacaaacaccaccaaggcagcaggttgtgcagccgattcaacagacaccaccaagacagcaggttgtgcagccgattcaacaaacgccactgaggcaacaggttgttcagccgattcagtagcaaggtttgatgaatgcatcggctgtgtttggaacacctgacgatcagctaaggtagcacgctgcgaatcaagttgtcctagagcatttggtccataacgtgcaaccagatcaaactgtggtacctcaggttattcccgaacatttggtgcgcaatatacagccgaactttcagaattaccattggggcaatttgaattatcagtattagcctccatcgccgtaagttcaatatcagcagggaggaccggctcagccccagtttgttcctcaatacaatcaattcgagaccgtgccacaacaagcacaaggagtgcctcagcaacgaccatgggctgtatgattgcagatgtgatgagagaacagtttaggcttaagccgaaagatgctgaaaatttgtatcggcatccttaccccgagtggtttgagagagttcctctgcctaaccaattcaaagttccagattttt

SEQ ID NO: 92481 - DNA, 1158 bp, Oryza sativa
atgcatatgcaaccacttccccatctggcatcagaacacaaccctaacccaagttgggatgcatcacaatacacttggaaacccttctttggatcaggtaaaatcaaaataggagctgatattaagcgattcttcaactcttgaaaactctgcttacattcttctgaccacttgtacttcacatccttttgaagcaatcgtgtcatgggcttagcaatcttggaaaaattctctataaacctccgataatatcctgcaaggcctaggaaactgcgaatctctgaaactgtctttggttgtttccaattggttatggattccacattactaggatcgacggcaactcctcctgctgagatgacgtgaccaaggaacttcacttcagacaaccaaaattcacacttgctaaacttagcatacagttgatgttctcgtagcttctctagtgcaaggcgaagatgttcttcatgctcttctttggttcgggagtagataagaatgtcatcaataaagaccaccacgaacttgtctaggtattccataaacaccttattcatcaagtttatgaagaaagcgggggcattggtaagtccaaaagacataacagtacattcgaacaatccatacctagtggtaaaagctgtcttaggtatatcttcctctttgatcctcaactggtgataccctgatcgaagatctatcttggagaaaacgatggcacctttaagctgatcaaacaaatcatcaattctgggcagcggatacttattcttgatagtcacatcatttagtgcacgatagtctacacacatcctctgggtatgatctttcttttccacaaaaataaccggagctccccatggagatgaactcggtctgatgtatcctttctgaagcaaatcgtctacttgcctcttgacttctgccaactcattggctgccattctataaggtctcttatggatcggagtcgttcctggtaccaaatctattctgaactctatatcccttttaggcggcataccaggtaaatcgtctgggaacacatcgggatactcccggactataggaatctcttccaaagttatttggttcagtcttgaccttaaaggctcagaagacaatgcatgaacagttacaactcgaccatcattactg

SEQ ID NO: 92482 - DNA, 1739 bp, Oryza sativa
aatatcatgcttgtcatttacttctaacttaccactattcacttcatgttgtcctcagttagcattcaacgtattcctttacacctttgaccttgatgtgttctttcccgatttctcttatcaatcacctttcgacctacttctttgcctggtaataaacatctttttcgatacctcctatcagtcatcttttgacctttgtcactaagtactcttcactccgagagttgtggatgcttctggtgacgatgtggtactttggtctgctacctttcagtgaaaccttgaagtgtttcgccaaaagctatactgactgtcattgcctttgatccgaaaaagacacgtctgaaactcttagtccaaacaaatgtctctttggttaatcacttgattttcttttccatcctcaggttggttattagctcgaggttagaacatggttcctctgaaatgagaccctaggtctcctttgacagtaaacaattatacacataatctcatatcgacatcttctgaaagagtcctcatagaacttgtttttattacacctttctcccatattacatgaatacgaggcactgccttaaacaaaaagggaaggtgcttaacatcggtacattgcatcctcaacatgaatcatccataaacatagcaagctcactgtttctagacatgaatatatttatttattacatgattgctgcaaactttcgattacagtgataagtagcgaactgaaaatcacaaacatggttactcattctgattctggagagatatagatggcattgtcctagttactgcatcatccttgattggttctgtgatgatgtgataggactgcatattgctatcattcacaggagaaaaattccttctgattgctggttgaagtggataatggtcttctgcttggtatcaccctcctgaggttgatttcccttcgctcggcctggagtaggtcggggagagaaacaacttcttccatcgacgacaattcattgctgaggctgtcagtgcagagaatggttggtgctgaaggtattattgctatgatttattgcagagtcaggtgcagcaggaggagcattggtgctgtggatgatatcgtcgaggttgctgttggagctgactagctgatgagacaatcgtagggttgttcgttggatttctgcggtcttggtcaacaacacactgagttggcaatccttgggcacatggtttgtaccttcgcatagaaaacatgtgaccttgcgggtgggacactcccctggtggatggtcttcttcacaatgagggcagagtgtgagacacatgctagcaatgtgtccaatttctccgcaacgggtgcatgcttttaattccatctcttcctcgccgagacgtcggggggactcatattcataatccgaggagacttgatctgacccttcactatcagatactctgccaccatggcttaggaggtgctgggtcaactgccgtgcacctcggaaggtatttcctctttgacgtctaggaatagttatccctgctggaggccattcggtgctggtaatagtcatcttacgtacttcttcttcagttcgcatcggcgcttttctcttctgattcttactcttcttgcctttggcgtgcttagtacgtgaccccacgtggtacgaaaggctaggaggaaagcaattcccgggattcaatggattctcttcattgggctctctgctttgcacactaggctg

SEQ ID NO: 92483 - DNA, 4675 bp, Oryza sativa
cagttagaacttgggacttgatagcagtgcgagtgacaaaatgcaagtcgaagggagatagctccgccgcccatttgctgagccgcccagtgacttccttgcctcggagtacttcgcccaaagggtattgtgatggcaccgtgactttgtgggcctggaagtagtgtttaagcttgcatgaagccatcaccagggcgtaagcaagcttctccatttcaatgtatcttatcttcactccttgcaaggcttcggagacgaaataaactggtttctggcctgactctgtctcttggacaagggcagcactgactaccactggcgaagctgccaggtatagtagcagttcgcttcctggcgccgggctgatcaaagcgagcagactttgcagatattgctttagcgcatcgaacgctgcttggcattcgggtgtccaggtgaattttcccgtgccccggagggtcttgaagaagggcaaacctcattcggctgcctttgagaggaatcgattgagtgccgcaattcggcctgcgagcttttgtacttcacgtactgtcacgcccggaatttctatccaaaattccaaacgcttacatgtgtgtgaaccctcgtccaggaatcagccgaggcacacaataacaaattgataattgagtacaattattactctaattaataagcgaacaaaatgtcattacagaggtagatagttcctctcaatcaataaaaatctaagcagcggaaagataagataaacggcgcagacgactccactccacaggcagcttgaccagggctacaccaaatcctccacaccatcagcatcactgtagaacctttcctctgatgaatgattgaaaggtgagtatatgacatactcagcaagccacgcagcaaatatgcaagtgcacaggataacaaaggatggcatagtagggtttcatttgcataaacagcatttgataaacatttcagaatttaataaaacagttaagtaataattaaacaatattaatccaacgctatacaacataccctgttgtataggcccaaccattctgaacaaccatcccggctgtacagttctatctccaaaccaggaatataccattccaaaccaggagctaatcaaattattaccagttatagcatcttttattaaggtgagaagtgtgagactaatcatgaaagacattgttagacccgcccataaccgcgggcacggctattcgaatagttttactctggccagaggtgtaccactgtacccacaagacacagccccacatcatgtctccatgtgcctcaataccaccacggtacctcggaaaggagctgtgacaatacccctcgcacaacacaatccaccgcagcgcacctttcctggatcataatcacccccttataaacaaggcatggactccccagcgacccccgtgggcttatctccgccacttctcagtctggtgctccgcaatgaaccatgctataccaaaggtaaagccgttgcccacgctggcttgtggttggcacggttaatgtttcacaaccgaaactcgtgaaccggtccttaattgtcatgagcacgatctctcaaaaccatgtgctcacaacccaacattatcaggttttaattggcaaataattaattaaccaatcacgattgaccatcgtgaactatcagtaagccatcattaattaatagtgaatcataagttatcccaatagtgtgctaatgtttctaagcatggctaagcaatcacatctaatatctagctgaaccaatatatatagcccaactagtcgagttataaacacccaaggtatcaaggaataaagtaagcaagaacaaaggggctataacaaacaataggttaattccacccaatgacattcgaaaataaatgcaatagttgaatagaaacagtagctttaaacgggatcaacatgctcaaagggttgtttggaatctgtgtgacttgccttactggccttggaactcttcaaattcttctcctgcgaaaacggactctccggaaacgtcggaatctaagcaaaaaagagcaaaatcaccaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatatgggttttaattgaattatgacgcaataatgaattatttttgaaaaggaaaaagggtttattgcgtcagcggctagggtttgcggtggaccgggtgcacggcagcggttcgcgggaacgaacggtcgggatcgatcctatccaaaacggacggctgagatcgaacggtccacgaccgggccacggcggacggtcccgatgacgtcagcggcgacgtcacctccggcggcggctcgggagcgcaagctcgccggcgaacgacggcgctacggcataaacggagggcaccaggacgtagagcgcgacgcggcgaactcaccgatgaccaaaacgacggcggaagatgaacagacggcggcggcgtcgaggaaaaggcggcggggtccttcggcttgacgacgacggcgatgctccggcggtctacagcgacggcgaaggggcggacgaggacggcgacgcgatgacgaccacgatggcggtctccccgagcgacggcgacgactggaacgacggcgaagcacggctggagcgacggcgacgacaacggcacaaggtctcacggcgctagggcgcttccgacggcgagagacgaaggcaagggtggcgacgggtagcggcggacttggggatccttttataggggcaaggaggcggtggcgaaggcccacggcgaccagcgacaagaaggaaaggttagggttcggaggagagagaccgatccgaatcgacctcgaatccatggatttccaaacgaaattagccgatgattccaaaagagaaaaggtggaggagatcccagagatcatttcccctctattgatttcaccggagaaggaaaaggcgcggccgaacttggaaggagacggcggcggcgcggcgctagggttcgggcggtggtggcggcgcgaggaagacgaagattgacaggtgggacccacctgtcagcgacagcgagcgcgcgcgcgcggacggctgcggactgggccgacttgggccgggggaaagagagaggaggttttgggccgactttcggctcaaagctaaaagagacttttaaaaacctttttcaatttaaattattcatgaaatgcaattccatttattaaaaatacttccttagctcaaataaatcgcagaaaaatctaggaattatagaattaaacaaagtatttaatgaaattttatctggccccattttatattggaatttgttaattaaaattaaattttctcttctagccttttaaaaataattccaattaaacaacaatttatatatttaggatttgtagggtgtgacaaacctaccccccttaaacagaatctcgtcctcgagattcggaagaactggcgaacagatgcggatgagctgacttcaattcatcttctcgttcccaagttgattcttcttccgagtgattactccattggactttgtaaaaacggataactcgatttctggttcttctctcttctatttccaagatacggattggtttctgaacataggtcagatcctcttggacttctatctgttcaagattagcttcttcggtaggtacccttaaacactttttcaattgcgacacatggaacacattatgaactcctgccaaagattgaggtaactccaactgataagcaacctctcctcttctattgacaatcttataaggtcccacaaaatgcggtaccaattttcctttggtgtgaaaacgatgaactcctcgaagaggcgtgacacgaagatacacataatctccttcgtcaaaacttagatctctacgacgattgtcggcataactcttatgacgagactgggccacacgcaacctttcttgaatgattttcaccttctcttctgcttcccttaggatgtccgtcccgaaaacctgacgttctcctgtttgatcccacaaaagcggagtgcggcacttccgaccatacagtgcttcgtaaggagccatctgaagactagcttgataactgttgttgtacgaaaattctgcataaggtagattcctatcccaacttccaccgaagtctaaagcacaagctctcaacatatcttccaaaatctgattcaccctttcggtttgtccgtctgtctacggatgataagcagtactaaagttcagcttagaacccatctcttcctgaagcttcttccaaaaatttgaagtaaactgactgcctcgatcagacactattttcttagggacgccatgcaaacacacaatccttgccatatacaattccgccaaccaacttccggaataggttgtctttactgggatgaaatgagccactttggtaagtctgtcgactaccacccaaatagagtcatggcctgatgacgttctgggtagaccagtgatgaaatccataccgatttcctcccatttccattcaggaatcttcaaaggctgcagcaaaccggcgggtttctg

SEQ ID NO: 92484 - DNA, 2660 bp, Oryza sativa
ctcaccgaaccaaaaagtgatgcggagagagagatgacgacggtgacccggcggcaacacatggagacgacgacgacacaagggccaaattagattttggattaagaccctatggataaactacaccgatgaacgacatcggagagaggaaagctcaccgaggggcggcgcgacgatggatgatgacggcagacgtccggcaacgaggtagaggcggcgatggggtcgggtcagcaatggcggcgacgtttcagtgatcttcggcgaagaaaacccggtggccgggcttcaccttgctcctgcgaacccaatggagacgacggcgaccgaaggcgacgacgggatgagcagtagggcctcgccggagatcaaaactcgacggcgaacttcgggttgacggcgacgatggagctccggtggatttcagcttcggggaagtggaggacgatcttcttctcctcctcgcgaacccaacggcggcagcggcggcgctccggttcacgacgacgggcaacctccggtgggatttggcgcaaaataaccagcgatcgggatagagctcgactttgcggtgccgagggaggtggcggcgctgaccggcgacggcggaagacgggacttgaggggataggtagaggacgactagggggtcctttatataggcacgggagctcgggtccgggcccaaatcaacgagaaactttgggaaagactagggtttacgctggaaaaaggaaagattgaaccacgaaataggaaaggatttccatagaaacttttggggatttcttggggaaaaggaagaggagattgagaggattccattgccgcaactaatttggaaaaaggagcaacgaggtggccggactttggaaggggatcggcggcaataggacacgggcacggctggctcggctctgcctgagctggaagatgaacagtggcgcagggattgggcttctattgcacagcctgattaaaggagaactcaaactagactttggggagaaaaggccgaccagagagaggaaggaaggatgggccgaggactacaagtaaacttttcctgtttcggcccgaaaaggaaaaggggattttaattacttttcccaattaaattaatcactgaaatgatctttcaattgttaaaaatacttccaatgctcaaataattccacgagaattcttgaacatacttggacactcaaagtatttaacaatattgaaaccaaaccatttaatgattaatttattaattaaataattactgaaatattcattgcattattaaaattaggaattgagctccgaaaaaaatccgagaaaatttcagagagtataattaatcatggagaatttaataaaaattaaatccagccatgctttatatttaggaaattttatttcccacatttaacttcacttgtaaattaatgaacatttaatataaattctattaataatttattaaataatttataaatcctgaaacgaaaattcaggctgtgacactgaaaacgctctctgttcctcaacctttgaacccttctcttctgattctttgtaaaaataccagaaggacaccattgagtcttcctgtcttcatcgtcctcttggttacaatctcggttcaccgggcccaacctttgatgaacaggaactcttgcttgccttagccgattgcttccattatacgatcggcttgaactttctgcaacattgccgcacccgggacagtcttcaatagatggcagcctcatacctttattccagcaaaatctaaagaactcgcaaccccaatgagaatcaaaaccgccatcatcttcttcataatgcctctcctgctgtctgtcatacttcttctgatacttattgataattttagccgaattcacctgaaaacctcttgctcttcctccatcggctgttcggccagctgtgtgtaccatatttacaggaaaaggattgccatcgaccttcatcggcctcttagaatcatcaaattctattttgcctccttcaatagccgcttggatctgctgtctaaagattttacaatcattggtagaataagacccagaattatgccacttgcaatacctcttcttgcctaattcctcagccgatgggattgtattaccagtaggaagttgaatctgtttctcccgaagtaacaaatcaaaaatcttatcagccttgatgatatcaaagtcatacctctcttcttttccagaactcttcacccattggcatggtataaccttcttgtttctaacccattcggctgctgctatttcggagtcgtcatcatcatcatcatcatctgatccatatatgtaaggacagacatgattaacccttttaaagttcttcctggcttctgcaaacctctgttcatgcaaggttaccttctgtgcaaggtgagacaaactatcaaagtcttgagacgagaacttctccctgatcggagttatcataccctaaaaagccagatcggctaactgggcatcagttaaactcaagctgtagtatttattcctcatctctctgaacctctgaatgtagtcctgcacatgctcatcatgcctttgcttaatcgctgttaaatctgatagtttcatctcatgaatcctactatagaaatagcttgaaaatgcttc

SEQ ID NO: 92485 - DNA, 1056 bp, Oryza sativa
actatttgaactagtataattcacaaataccaacatgccatctctaaatatggcatcttcatatttagttcaaaataattgcccgtaatagcatatattgttcaagaacatgtcctctaccaccacaagtgtccatggagtgacatcgattatgaatgaactcactaggcactccaatccaatgaaaccttaagccccttctattaaaattcatccactaaactaaactaaagttgatatattcgacaagcaacgcctttcgattcatcgatacatcacctaagagccatgacagcaatgataacccatgtaacacttagaagaaaatggcacaagcaaagcaaaagggaaacaccaattccagtagtcgatagaagcaaaaaacaccgtgtaacagcagaatcttacatagtcccggaaggccagcccaacctccatgcacttgaacatctcatcggtgacctccatgctcaccatggtcacccgctcctccctctcccgccctagaaaaatcaacagcaaggggcggaccccccaatttttttggggggaaaaaactgttattagtcctaaggttaagacaaagagaaaacctagcttccagatcgagaagagaagatcaaagttaaggcaaagagaggaggtgtggggtagagaaggatgagaatgagagaggatgcgcgtcggcgccggtgctcaccggaggcggaagcagcaggaacaccgcaccgccgctcgcgggatggatggagatcggccgcaggcgacggggcgaactcctcgaggagacgggagtcgaggccgaggcgacgccgggacggggagatggactcggggtcagaggcgagagtatgcgatggaagcagcagggcgcccggcgacggagaccggcgcgacgacggcgcaggcggcgagccaaggagatgacgcgggccgcggcggcgtcgtcgggtagcggaggccgcgacgcacgcagcctcagcgtccgcggagtcggtggataaatggaccgagcccagccgtgctgtcccgggcacgatggcgcgtgggccgtgc

SEQ ID NO: 92486 - DNA, 3798 bp, Oryza sativa
ttgtaagttgagggacgccggatatctggttttgtggttgggggacaattttgtaactcgatgacaagttaagggaccttcggtgtactttttcctatattatgtatgggtttggcccaagtttgttgcttgggtcacaatgggctccgatccattttggcccaagaaaatgaccccgagtcgagcgaagcatcgaggaattcccaggcagccgccagccggccgatcccccgtcgctcgcctcacttcgtcggctcgtcgtcgtcgtcgatgccgttcaccggaggactgggggcggcggccagccgttcgttgcagcgcggcggcgagatacttcttctccatccaccggccgcccgtcgatcgcacattcgcacgtacgcgacgctcctcccgcactggccggctacaccatgctgaatcgggtcaggactctccacacccttcatacaatttgcttcgatatatatccaactatattcaggagaactaggggtttcgattgatcgtctgaattcatttttgtcaaatcgtaatgcgttagtagttggggatagaaattggggtactaggctactagtaattacgaatcggaattaatatcgaatgacctagattgccatttcaccaatgtgcatacactgatatgcgcagagccacatatcgatttgctggggtgaattagaactttctaaaaaaaaaaagaactcgagacaatctggagtatacatggattctgcgtctctagttcagtacgcgatccatggctagctatgcgtgctcgaaagtcgaaaccagctgaatcaggccctgtttttttcagtttgggattattataatctagattattgagtcagattactataagctagattgtaataatctgtagtagaataagcagttagttgtttcttttctagattattagagtctagattattgggtttgcaagtctaaagaggaagtggggtggcatggtgggtaatttttcactcaataatctggaaaaagctcacctaaatgagcttatcagattataataagttagctccagattataataagctacttcaataagttgtctgtttctttcattttactcccaataatctggattataataatcccaagctaaaagaaacaaggcctcggtgactttattttcaccatatttattcagttttctctccaagtagtacttctcttcaatttctacctacattatattgacacactagctagtttatgcgcggatattctcgatcggttggcaacatatttaaaatggatatttgtttttccacattatcgtatcttggattaattttggtagttcaacacacaccatacatcaactataacatacaccctttgtccggctggttgttcatagagtatcaattacacagtagcaaaccgaaaaaaaaaatcgtttagtttacaggaaactttgtaaatcttgaaagagaaacacttatatgtatctgtttcttgatgcactcttggaagtgagacgtacgtactgatcaaatacccgtacgagaagttttttttttctttctgtggctgccgatgaagctcatagaagatatctaatagcacaactgcatcaaatgaaagtaaatattcgattagagtactagctagcttgttccagacagctgaaattgatcgcctttcgatcgaacatatatagaataggaaggatatcttgataagcatagatgcatgggggataattaaacatgctaagtctcttttgggatcgatttgagttttgcttttcaaaccgcagcaaaaatgaaagtaattattgctaattctctagatttgatctaaagttgctactacttccattaattggtcatgacaaattggcatttggacattctaatttacacggtatttgagatgaaactttgaccactattttctatcaaaatatatttgtaaagttcaataaaattataataccttctgaagaaaatttatacacacatatatatgatgatttctattatttatacaactaagtatacagaggataatgattcttaaaattataaaagtacaaattaagtccaaaacaacatgttattatgacatgagggaatttaattctttaattactagttgttttaagaggactacaaattaaagtaaaccatatacgaacttattttttagataatggattatattaaacacggcctctacaagtcacaagcacgagtatataagactctcctgttatatgggtaaagcataaataagttttaaaggcggacaacaagcaagaggaacttatgattagtctcagtactaacttacatgcatgcattctaatcagtctagctaaacatatatagtttgataactatatgctccatctgctagctaactttgttgctcatagcaaagttatggaataatatgaggtaaacatgatttttatatatattgagaaatggagtgataattgaatattcaatatatgcatgaagcactcagaaatggtttgcagttttgttttgccacttgccatgcatatatgtgctagaatgggtagatgtctgcttaatttgcaccagatttgtggatacttgttcaaattattgtagaaatatggaagatcaattatatccccatatatgcagttttgccagactagctagcaaagtcacaactcacaacgaagctgagaatgcactttcttgctacatcttaatttgtctgagtagatatatattcctatgcatcatcacgtggtctctcaaaacaggagagcataaattcaagcataggctgatcaactctttaatttgtgttagtagctactaccactgcgcttatgctaataagggctaggggtaccgtacgtaccacgggcatttcttacttgtttctgaaggagtatactataccttcgtcctaaatatagttgattctggactagacaaacaattgttcacatatatatagccataagttttatatttgggatggaggtaatagaagcaccaattgcaacaagagatagcatgaaaaaaaaaccattagcaagagcttttagaaaatttcttttgagagcattgatgaattcatgaattgtttgaagagaacatatcgaattggacaaagccatccaaagattatcttccaagctgtacattatagtgacatgatctgaaaagttgtcctcgaccatataaaaaaaatgacatatatttcttatcaaattttcaggagcatgcatgattgcaagttttttttcttcattcattcattctagagtaagaactagagagagattctcattacatgatcaaaacgacgaatcgtctaagcaaaatcaacaggtaaaagccaacttaacaagaccatctttccacaatgagcatacacaaaaacaaaccctaaatccaaatatccatgcaaaagtaggcacgcacacacgcctacacggccactcaccttgtcgccggccgtacacatgcggcatgccgtccacgcgcgcggcgtcccgagctgatcaggacggcgcccatgccgaggcgaacacgacgttgtgccccttccacgtgagcacgaggtcgtcgtcctcccgcttcatcccccacccggccgcgtggtcgttcagcatcgccttcacctcgccggcggcctcctcgccgaacgccgccgcgcggaacccggcggcgcgcatccgctggccccacctcgtcctgtcctcctgccgctccaccctctccaccccttcctgcgccagcacgttctccaccttccaccccacctccg

SEQ ID NO: 92487 - DNA, 750 bp, Oryza sativa
tcatttcaatgtgaaaggcacaaaggtggaagtcaatgtctctgaatggactagtgaatctgcagccatagggaagatgcatgtggtgtgggtggtaatagaaggtctgcctgatgaaatgaaggggtatcaggctctctttgaggtgggatccaatctaggagttgtcatggaagtggatatgccaatgttagctgcaaaagacattgtcagaatgaaggttggaatgatggacgtcaaacaatttccattatgatcctatctacacctgaagccctgttgtatgaagcttgttttaatctggagtcagtagtagaaatgggatggcttaagggacaacagcttgataagcaataggaaactactctaagagttgaagagaaggaagaacagaaggtgctcaccaaaggtaaacaagtggaagagatgaaagaattgactcaacatgtggttggggctcaacagaaaggagattgtagtcaggctcagatggaatcagttcataggttggttgaagaagacagaatcaaagccattcagatcctgcaagacagtcagttggctttggccttgcaagaagaggatataaagggacatctcaatgaagataaggggtgtgatgaaaatcaaactgctcttctgattctgaaagatgatgataagatggtttctcaggaggtatcaacagccaaagaggtgcaaaggagtcagctggttgctagtagtgaggatgatatagaagggctgcag

SEQ ID NO: 92488 - DNA, 2499 bp, Oryza sativa
actaacaaataatgaaaaacaataatgaggctcatcttgctttgctttggacaactttttcatatctttggaccatcaagaaagaaaaatgcatattagcttacatgtcttcgaattgacattgacagattagctttataactttatatgtagccctcattaatcatttgaaatcaaacattgaataccattggaagtctcaatgcactttcactaaaatatgaatagaagatccatgtgatgctattaaaagcaacaaataaaatgtagtactaatagaaatgcacctcacagatcaagacagtaatatttctttcatcatcaaaatatactccaaacatatttttcttcagcgagcggacagcgagtaatatagaacacattttaattagtcaacatgagcacagcgagcgatgcagcccagtacatcttcattgactacaaacatatacatcagttttccacttctttcttctgccaatatacaagaatttttcgtattttcagaagagagatgaagagacaagtcaatgtaaaatatttcctagaagacaagtaccaaatggtatatattttgaaccattaactttaattatatcagcttgtaccatgcataaacatttgaaaagaaacatacacatgtaacacattgtttacaggaaaaacttccacccgatcagattcaaaatgctacaggcaccatatactaaaacaaggcggctcatctatctgggttggaggtttaacaaatatgaatatctcagcaaattgagcagacaaactaactatataccattgtcagtgttctcttccttattcagaaaacaattaatccgtgtgtttctgctttgaaatacaagtcaccaacgtcaacaggttagtgttatctggtagtcatgctcaataatacgaagaatatattctatttatcaactatctttgagtgtactttgctataacttcaaacaaattttgctgttcttgtttagaatatccaggatgaagctgaggaaggttgctaacaaatattttggcatcagtcaactttccattcctacaatagccctccactattgaattgtaagttctctcattgggcttgcaaccttgagtgaccatatagcgtactaactcaatagcttcctcaaacattgagttggagacataactcttgacaaaaatattgtatgttacaacatctggtttcagacctgaacatttcatctcagagaacaatcttgatgcttctttcatctgtccttttcttccatatgcatagatcacagtgttataagaatatctatcagggcgcacaccacttgacttgatctcagtgagaatattttcacacttttcacaatcacctaaacgagaatacatatgcatcaagctattgtaggtagcagcactgaggttgatagcactttccttcatcagtgaaagaatcttctcaaccttcctgaccatcctgtttttcccatatatggaaaccatggcattaagaacattaatatccaatgaacaccgcttctgtcttagttccaggaaagccttttcggcctcagctaaattattaactttgctgttgaccaagaccaatgttttcactagccaattatgtggttctatcctctctgaatatatatcatctgataaagctttcattttgtctaacctctttgcatttgcatacgcatgaagcaatgaagaataactatactcatctggcttacaatctcgctcctccatctcagcaaacaacttttctgcttgttcccaacgcccaccacgagccagggcagacagaacagcattataagttgaaacatcagggtatataccggcttccatcatcctcttgtatatctgcattgctaggtcaaacaaaccacatcgactatacgaactaataagtgaaacatacgtatccctctcagggatgtaaccagctttcttcatctccttgaacaccccagacacttcagaatccaaaccattctgcccaaacacagctaagagcgtgttccaggtcacaatatccggcacaaaaccagcagacctgaactcatcaaagacagccatcatctctgggaacttccccctcaccccatgcatcttgatcaatgcattgtatgtgcacaggtttggcttgcatccgttcctcaccatttcatcatattccacaattgctgcatcaattttgccagctctgtcaaggccagagatcaatgtcgtgtatgtcaccacatctggcttcattcccttcacctccatctcctgcttgagcgcaactgcctgttccaacaacccatccttcacatacgacgaaatgagtgagttgtaggtcaccacactgggtgggcagcccacacgctccatctcctggatcacctcaattgcttcgtcgtgccttcgcgccttaccatatacatcgagcagcgaattgaatgtgaccttgtcaggttcgaacccagaagccttcatttcatcgaacacctg

SEQ ID NO: 92489 - DNA, 3804 bp, Oryza sativa
agaaaatacagataatttcaccaaattatcataaaactatacatttaaggtgatgtatcacaaagctatagatttaaaactaagtatcataaatctacatatttaaacaataaaattaccccgaaactatccttttggccttttggggtttaatctttaccaataatattaatattatgtttgagttatatacgtttaagatttgtgattaaattaatgttaaatctatagttttgtaataactttgttactaaatatgtagttttgcaatactctatccaaaatttataattttgtaacaaatttgatattaaatctgtagttttgggatatatctataattgtgtgaaattcattcttttttgagaaattatatttttaaaagcgtggcacgaataatccacttctcttttgtttaaaaaacaaaagccttgtgaagtgagtataacttaaccgataaggtttcttatgttgtaacaagctcactcgagttcaagtttcaagtttgacatggacgctctgtattatggctaattattttttcagtggcacggaacatattcgtcgatagtgaggtgtcctcggtgattttgtcaattttatggtagcctacactatcgaagtttgatacttttaaaatcttccacccatgaaaaattaggaacggtaacaaaccaaaatttggtcgaatggattagtgggcggggtggctaggtggctcaccaacgcaggcccgtctatactgcgtaggccacgggtgacaggttgaggtttgttctggctgtggacgtactagcgacagagctagggttggtgcaataagggcagtagcaacgcaagctgcacgtacgaggaacctaaaaaagccacataggctttagacatgggtccaaaattagtttccacacagtgcaaatggcctcatgagtgaatttaatttttcgctttaggccctaccacttttgatttcaaccctcatatttttctcaatttacaaagaagtgtaaattttacactaacccccctaaaattgagaaaagaatataaatcaccactatcaccgggtccacccccacaaccctctccccttctcacgcacaccatctcgacaagttcattggcaacaaactccgccgccaacgcgctctccccagttaccctacctgggcaacgaactttgcaccggcgacctctccaccctagcgatgagctctgccaccgctagcacctctctcatccccggtgacaagaacaatatcgcgacggccactacctccggtgtctcccaacttccccacctcagcaacgaactatgtccgcggcggcctctccccatcatgcccctccactttcggacgccgctcgagaccacaaggaaaccgtatccagcaccgccgcctgatgtcatggcctgatctggcctcaagctcaatagccatggtcggatttggcctctcttatcccttgccaacaagtgccgatcgagcatagtgcatcgttgtcggccatcgccttcgtcgacaacctcactcctgtcacctctctactgctgccgccatgcctccatcgttgttggcttgttgctgccaagctcgggtggagagagagagagaagggcttttgagctcgagtgggaccgctactaagctcaggtgaagagagagaagggtttttgaacttgtaactcacaagtaagaccgatcttccaagtgaagacatggtccccacccaactctctcttccacggcaagaggcgtcctatgtggcgggctagagccacacaccacgtagacgcactgtgaacggcctaacataacagggatatagctcattccctcctcggccttgccaacccgtgatcacccaacgacacgacaactatgggcttttttcgtttattgccaaaaaaacccttaccatttgtaggtaaagccaaaatttggcaagatcaagatatgcagatggcccggactaggttgacccgaggcttgacccactgcagctcagatttttacctaacattgtcattttgcaaacagctagaacaaaggcctgagcatacacaaacaacaactcgtaccattcgaattacttactaacagtaaaggatcccagcttagatagatcagggacccaacaagacagttccgaagatgcagtcaagaacatcaaagatcctggagcccatctaattagcggtggctcactatctgtgcttccccagcgagcaacctgcatgtccgaccatattatcatctctttcaaacaactacgatctccgtcctaaaatatagctacttccggttatacatggagaagtgcagtagctatattttgggacaaagggagtacaaaaactatatttgacatacctttccactcctaacattccaagcatatacactgccatcaccagagcctgcatgaaaaataaatattaggtaatgaaagaggatgtgccaaataatcacaaaggatgttagagaaaagtgggtcaccagatattatatggtttccatcagggctgaatgatgcttccagcgtcgaattgcttaccactggcttcacgttgtatgttgctatctgaaaaaggaaaaggtcaaagtctccacataacaagtctgcaaaatataaattaccaaagatagtttgcatgcttacattattgccatgaaatgaatctagcacatgaacacgcccagctttggtggttaaaagaagccgcctgccatcactgctgaactttatgacattggcttctgaatcatcattaccgacagagaaaatatcaaaaggcccctgtggatgtaagaagttaaatgggttgggtaattaagatcaaacaacatactcattcccattaccttctcaaaatttcgagcatcaaacatccttatgtagccaccatatgcaattgcaaaaaccaaaccctgatcatcataagaaactgcaggcctcccctgaacacgcagcaaaccctacaaaatccaagagatgcttttgctagtaaacactccccaaccataccatcaacatttctactgtaacatgcccaatgctcaataaaggtacagaacctcagagaaataaaatggatgcatacatatatgacttgtttaggattgtgaggaacccaatttccgttttcagaaaaaaagatgatgtacgtaattaaaggggcttgtaagtatttagttgcaaaaatcatacatctgggcttcagaatgatatttcaccatcagatggactgatggaggacaataagaagtctttttaaccgataatcagaaataagataaactaaatctgtaaaagccttaattgactgtaaactgcaggttgccaaattgacgggaaagtagtcaagcagtcaaacagtaaacttattgaggagaaatgtacctgtgctttttcaacccttgaatcccataggagaactgttcgatcaagtgaaccagagagaatgttcccgttctcagagcacaatgagatagaaacaaccctgattaagacagatagtatcctctgttggtattggctaaccgacatattttattggaatttatatttattataaagtttggcaaacctgtctagatggcctttgaaatatctcaaaaaacagttattgaccagtgagagtagacggagagaatctgcacagttaattattttaagtatttgtatacatgacttatatcactctgaagctatgacaatataggacttaccatcccatccattttttgaagaatgcaagacataagttgggttttcagtgaagcacacaagctcaaccccata

SEQ ID NO: 92490 - DNA, 4085 bp, Oryza sativa
tcagcttaagaagtttcactcaggtttctacttgatcatgacatacacattgcttcatcgcagcatgtgtggtcatttataaccaatctagaagcttaaagcaagtatatatattttttgacttcgcatattgaaaaaaatgctgaattacacgtataagtactaaatcagccaatacaacaattctcatgtgctgctcccgtcagctgtcgcccatcgtcgacctcgaatggtgcaaagttgtcaagagcatcttttttggaccagctgtcgagaaaaataagggaaacagtttgctctttagtttgtgtgttatgtcactatctctcgaaagattatattcataaaatacttcaaaaggaaactataattcagaaagtactgctgaaatgtgggagtgactaatgaggtgcctaaatgcattcggtatgtttccagattgataatcctttggttttctacaggagaaaattgtatgtaacaattttcaagagttgttcctttattcgtctccaaatataataaattttgtttcaaaatacatttacttctaagtaccaagagcatttgtggtgataaaatatctaaattactccttaccttcacaaccccttccaccaattaactaggagcagaggtggaggcaaaaaaacttatatgccaagactgagctaataaagtctcaacatatttcagaatttatatggtgcttctatagaatttaaatggggattaaggagctaagcctagatctcaagccctagctatcctaagcctagccccgcgcctgactaggagtctatgacaattaacgagggacaatattgtgtttttacatatatcttcataatctcaaaaagaaaccctcggatattttaggacaggggactatataatttcctttataaaaaaaatgtcaagtagatttgatgccacgaggatatctcatgtacaaaaatgttattgcaagcatgaaattctaagaaattccaataccctcaaattgtccaccacatcaaaatgagcatcatatggaattttttttccctaggataccgcgatttgaagacgggaaaatggacatcgaacttaaaaaggaacccaaggaattttacaagaaattggattggttaattttctttaagttttcctcaaaattcaggccctgagttttctagctttctaaattctaatcataccctcagattacactcattgtctacgtgactcctatgtgaccctggcaagccaaaagggagcagcaaatttgcgagaaattcaccgatccgggcaaaagttggcgagacaaggcagcatcatcataccagtcaccaacagggcagcgtgctcttctaccgaggccacaataatgtgcttgctcaaaccagctcccgtatagctgactttctgtagcatcattcccagctccttctcccctttgcaccttcatttttcaccgtcactcacacaaagctcatacatattgttccacgagctaagcggctgatgaaaatttagactagttaggtttcccaacttttatcttctagtttaattttcaaaacttggatgagaatttgagtcgtttaaaggagtcgggagatttccagggaaactaaatccgcaaaagaccctccaaataaggtatcccagtgagatgcagatgcaatgatgcgcgtaaaacccttttcattttcctgcatcaaccatcggcaagctgctgcagaggccgggtgaaaacggtcacggaaattcccgatcgaccgagcaccgtttttgtataaggggtactgtttccgaccgtacgtaccatttttgttatttttaaaatttatcttttcgtaatttttttcatcgtattaatgtcaatacaaactagtttaaataataaatatgattaattaccgaccgatcgatcatcatttctaaagagatgctaccgattccgaccgttttcaccctgggtggcgaaacaaagccttaccactacttcaccatggtcgtctccctcggtcaacaaaggtgaaaaaagaacaatgggagccctacacgtcacagagtagatgacaccagctaccaccttgacctgaaagtgggccctaccggctctctgttgaccagtcaacgcatgagggcccttgatcgatggatcaactgaaatggaggcagtacgtagtagtaggagtagtacacagtcatcaggtgaccgggctgcctgcctgcctgctggtgaatggtggcgatgcgccactgatccggaagcatccgatgctaggtgcactgcagaagtacagcgagcagtggctgccaagatacaacttggttaacttgcaagcgagaccagcattaacatgtactcctacactaatagagcagctcgtggacggtgacttgagctaaacacgcatgctagatctgggaaggattcagcatgaagacaagaaaaacagtggagttttcagctaagcaagcagcaaaacacacatcagcattagtggtagtagcagcatgcagtactaggaatcaggcatcatctttcaagtgccaccacaaccaagaaaatttgcagtaacatgaaaggtcaggtgatctcaaattagtacagctctgatttttctgaaggcctacaagaggagtagtaggggttcagtaaaaaaggttacactaaaaacttctgcattcagaggataaaagatccatctcagaggccataaaagtgaggaaacacgagtggcctgatgagagtgaagaacatttatgctcctatttacagatttcacggtggaaaattgaagtagaggcagctaggagtagctaatatttgctgaatatacttgctcatttggaaatgaggaggattaaactctactggtatgaacaattttttgggctttggtttaatttcactccaagaaatgcagctactagctatagtaaacaacaacactaacagcctcgccgtcacacttccactctccacatgatcttgtcgccgcggcggccgacgttggcgccgccggcattgtggtggggaggcgcgcggtccacggcggcgacgcgcgccgggtgcctggcgcgctcgccgtgcggcgccgcggccggcggcggcagctcgcaggactcgccgacggggccggagcggatgtcggcggcgggatgtagcagtcgacggacaggccggggacgttgaacgccacctcctcgatgctccaggcctcctccatccgcgtcttggtgtggctcatggcggcctcgccgaagcggaacagcgtgacggcggagcgccccgcgtgcgcgatcatgatgccctcgacggggcggtagtcctccagcgcggagctgatggtggtctcccagtagacggcgtcgccgccggagtgcggctggatgcgggtgaggtgggagtcctcgatgtgcacgatcaggccggtgcgctggctgaagtagccgaacaggacgtgccggatgatctccgccggcccctcgctccgctgcttcagcgtctgcgggtcggccgacagcttgaggatgaagcagtcctcgccgttcaccttcttctcgccgacgcaccgcgcctccgcgaacagccccgccgtcgtcagcggatcgagcccctgcatcgtcgcaagcaatggcgagaacacgccggtgagggtgattgagatgggtgggtcggctaggccagatctagcggcggtgaggtgtccggacctggaggacgcggcggagcgggcgcacggggcccttggcggcgtgggcgccgagccacggcgtgtggcgccagacgaggcggccgttggatcccgcgtgcaccttgctgccgccgacggcgagctcgacgtaccacatgtcgggcgccatctgccagaggacgaagcccccctgctcgacggaggcggcgccgcggccgctgggcccgcggttcttgacgacgcgcgtcgcggtctcgaactcggacgccaccatccgcaccttgcccatggcgtacgcgttccgcaccgactgcagcagccggtagccgcccgacgccgccatgtactgctgcaggatgtactgcgccgtcgacgactcctgcatttttcaca

SEQ ID NO: 92491 - DNA, 1801 bp, Oryza sativa
  unsure (1)..(1801): unsure at all n locations
ccgatccattcccccaccatagccaatagagatccccatccccttccaccccagcgcccgcccgatctccgcccttcccgcgcgatcccgcgcgatggcgctcgatctcccgcgccgcgtgcgccatctcgatcccctcccatgcaagccatctcttcccctttcgcgcgcgaagatctcttcccctctcgatacaaatccacccaaaaaatctccatctactattttgccagccccaaaaatccggtaagattgacggtctccgcccccactatccgccttccctcttccccctcgctaatctctcatgcccgcatgcgacagatttgtaccgaaaaccctagttcccctccaccaacagccatctctcgccggaggaagagggaggttgcgccacctccaccaacacccttgtacatgctatctttttatagaattcccagggggggtgttaaagagaaaatatattttgtaaggagatatttatggcaagaagatcaagggatcataaaatatcaccatgtacaatggccaatagtgtgctctccaaaagagcaaacagtgaaccatattaatattaatgtgtatgattttttatataaaagatgaagcatgaaatttatgtgctaattatacactaaaatgatcttgtgacaagttattgatgcaagtttatttgttgcatggttagttactggtttttaagtatccaactctaggggatttggacccatgtgcccacatgctataagtttcagtagcttgttttagttacaattgcagcagtggtggatccaacataaaaaaattagttatgatgaaactataatcttcttgatttctatataggggagtggaatctcgtcctcctggtgggttcgttaatcttatcaatgccccatcaaaccatatgcatcatgtcgccgaagggagtccatcacagcctatcaatgttgagaatggagatgttgctaggacagagaaacgcttgtcatggacaaacgatgaagacttgagattggagtggcctaagtgagttatttatttgtcaatgtgatgtacatcacttgcattactaacaccggtaaacatctttttcctaaaaattgcaaatcagcgcctagctaaacaactcaaataatcctacagaatcaattttcaagaagaatgataaatattggggcgatgttgctgcagcttacaacagcactaccccaaaaagccgagttaggcaagttaagcaagttaaggatcattttggtaaaattaagaagaaggtagggaatttttgttgctcttggaaggaggttaattcattatatgccacgtacctagaatgccagaccaaaatacactcaaaaaccactaactccaaaaattattagaaatttcagcagagtctcccctaaaaatacggacatccacgacaggcagttataagataactcaacaacaatataatccacacaatacaaaccatcctagctccacaaattccacgtgaaagtaaggaccagactttaaatgaccgttacaagttctacgcaaaacttatgctaagcaaaaacgtaatctaaaactgaatttcaatagtgtgcaataatagtgtagttcaagggtgttactcccatcccatgccgatcaatatcattagatatctaaaaaccaaattaaacacaagaatgagtaaataatactcagcaagtacaatattgaactagtaaaacatacacatgtntaatgcaataagaaaccaatatgaaacttttgttttcctttaatttaaaacgaaggagacaaa

SEQ ID NO: 92492 - DNA, 2807 bp, Oryza sativa
ttgattcaaccctgtactagggcaagggctaatttgtttaagtgtggaaagaatcaccattctgcagatagtgtgtttactagggcatgtcgtgggtgtggaaaggctggacacatggggttggtatgcaagcgtaaaccaaattctatcatcaagtggcaaaggtctagcccctattcagcaaccttttcgagaactagctaccctcgcggttcaggttcttccactagtactccccgtggtgctgttcagatgatgacagcttatccacttccttaccagcggttcacacataattacccaccaccaccattaccaagacagtattggtccatacctcaatctcttgctccacatgctccactctagttgcctgcaccgcctatggcgcatccttctgcttcagctccacctcaccagcaggcctcaggctctactacctcagctatggctggagtctacaacatgcctgcagggtcatcccttggtcgcccggatgtcattacaggtacactttgagttgattcgcatgatgctctaattctgtttgattctggtgctacattttcctttgtttcaatcgagtttgtgaaaagagctgatctatttagtcaagaggtctctcgatctgtccaagtcagctctctagggggtataatctctagttcagtagtatgtccaggttgtacaatctctattgatggggaagaattcgtggcaaatctaattgtgattcccttactactctttgatgtgatcttgggcatggattggttgaaccaatatcgtgctttaatttcttgtttctagaagacaattaccttggaagctccatcaggcgaggagatggttttccaagggagcgcgcctccgcattctcttttcgtgatggcaaggttatttcctgggcagcgtgctgtaaagatagtgttattatgagccttagccgagaaggcatccaagcctttattgattgaagatgttcctgtagtgcgagattatccttatgtttttcccgcagaattgctagggatgccacctgagtgtgatgtagagttccgtattgatcttgttcctagtacacgacctatctccagagccccgtaccggttagctcgtcctttccaagaagagttgaagaaacagttagatgatctattatccaagaaattaatccgatggagtgtgtcgccatgcggtgcacctgttatttttactaagaagaaggatggaagttggggtatgtgtgtggactatcgggccttaaatgccgcgacaatcaagaacaagtacccattgcatcatattgaggatttgtttgatcagttaaagggagcaaaggtgttttctaaaattgacttgcaatctggttataaccaaatacgagtgcgagaagaggatattgaaagaccgcattttccatgacatatgggcattatgtgtatagagttatgtcttttgggctgaccaaagcttcggctattctatggagacgatgaatagcatgttgcatagctttctagataagtttgtggtggtgtttattcatgatattctgatttactccaaagatgtagatgagcataagcatcatttaaggatggtgctagggacttacgggaaaaccaagttccatgttaaattaaaaaagtgtgaattttggcttcctgaggtggttttcttagggcatgtaatcaatcagcggggtatctcagttgatcgagcaaagtttcaagtgttgtcggatgagaaaggccgactaatattaaggatgtgaggagctttttgggtatggcagggtgctaccaacacttcgtgaaggattcgcgattatcgctaaaccaatgatgatgctcacacaaggatgtgaagtttcaatggacggaccaatgtgagaatagtttccaacaattgaagcataggttggtaactgctccagtgcttactttgccccaacctggtaagcgtttcattttctattccgatgcttcacgagtaggccttggttgtgttcttatgcaagagggcaatgttatagcttatgcgtctaggcagttaaggaagcacgagcataattagcccactcatgatcttgagcttgcagcagtggtctttgctctcgaaatttggaggcactatccgtatggagaatcttgtgatattttcactgatcataagagtctaaaatacatctgcactcagtaggatttgaacttaaggtagaggaggtgggtggagttgattaaaaattacgatctcaacattcaatatacaccgggtaagacgaatgtggttgcagatgctctaagccataaggtcgttcctccaactgtgagttttttataactgattttgaacggatggatatctcctattattatgccggagcggcgagtactgagtcacgagtcattcttgagtccacaatacccaacgagtgctagaggcccaacaacatgatcgattgctgcaacaagttaagaaacttgtaaaggaaggaaaaactagagatttcactttggattctttgggagctatgcgattccatgggcgtttatgtgtcccacaaaaagcagaaatcaaggaagagattttgcgagaagcacaccgaacaccatatactatgcatcctggtgagaacaagatgtatcttgatctgaagaagatctattgatggaagaggatgaaagtggatgtggccaagtacgtggcatcatgtgggttatgtcagcgagtaaaggctgaacataagagtcctgctggaaagttacaatcattggaagttcatgtatggtcttgggatgata

SEQ ID NO: 92493 - DNA, 2128 bp, Oryza sativa
caagccttatttgacttttaaatttgcacattttaattgttggaggctttcacatgaattttaattattctcggcataattttgaggatgtattttagagtcgttttgggacgcgacaaacctaccccccttaaacggaatctcgaccccgagattcggaagaactggcgaagagatcgggatgggctgccttcagctcgtcttcacactcccaagtagcttcttcttcggcatggttgctccactggaccttgcaaaaacggattacccggttcctggtcctgcgctccatggtgtccaggattttcactggcctctccacgtatgtcaaatcttcgcgaacttcaatttgctctgagtcggcctgctcggatggcactcgaagacatttcttgagttgcgacacatgaaacacatcatgcacgttgcccaaggaggcgggcagctccaactggtaagcgacttctccacgccgagcattgatacggaaaggacccacataccgaggtgcgagcttcccctttgtctgaaacctgtgtacacctcgcaatggcgtgacccgaagatacacaaagtcatccactgcgaattccaggtcatggcgtcggttatctgcataacttttctgccgggactgtgccacctttagattatcccgaatgattctgactttagcttcagcttctctcaggatatcagtcccgaacacttggctttctccaacttggtcccacaatagtggtgtccggcatttgcgcccgtacaacgcttcataaggtgccatttgtatgctggcttgataactgttattgtaggagaactcggcataggggagactcttatcccaggtcttcccaaaatctagtacacatgcgcggagcatatcttctaggatctgatttagacgctcggtctgtccatctgtctgcgggtgataggcggtgctgaaatttaatcgggtacccagctcttcttggagcttcttccaaaagtgagaggtgaattggcttcccctatcagatacgattttcttgggaacgccatggagactcacgatcctagcgaagtagagctcggctagcttgttccctccataggtggtcttcacaggaataaatcgagctaccttggttaatcgacccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccagtatttctccttcaagtctaagtacatctttgtactgcccgggtgaatggaataagggctctcgtgagcttcctgaagtatcagctgtttaagttctctgttatctggaacgcatacccgctttccgttccatagggttccgtgttcatcctctgtgaaaccagcggctttaccctgtttcatattcttgaggagtccatgcatgtccggatcattcttctgagcctcgcggatttgatcgagcaaggtaggcttggcttctaacgcagccaagaatccgcgaccaactatgcttaggttcagggcttccatctgttgattaagttcgggtggaatgccacggacgttaagagtgttgcaatggctctttcgacttagagcgtcggcaaccacgttggccttaccaggatgatagtgaattcccacatcatagtccttgatgagttctaaccatctcctttgccgaagattcagatccgactgggtgaagatgtatttcaaactcttatgatcggtatatatttcacagcgattcccaatgagatagtgccgccagatttttagagcatgaaccaccgcggctaactccaagtcatgtgtagggtagttgccttcatgaggtcgtagctgacgtgaggcataggctaccacatgaccgtcctgcatgaacacgcaccccaatccttggcgcgaagcgtcacaatacaccatgaaatccttgcgagtatccggcaagattaacaccggcgaggaaacagcttttccttgagggtttgcaacgcc

SEQ ID NO: 92494 - DNA, 1061 bp, Oryza sativa
ggttgtataaaaagaaaaaccctaaaagtcttctttccccccctcccttcttgggccggctcggcccaactccctccctctctctcgtctcccccgcggcccatcggccttcccccgcgcgcgcgccgctgacgggcgggcccgcccgccaccctcgctgacgggtggggcccacccgtcatcccctaccttccgccgctcccgccgcccgcccgtgccctagcgccgccgccgccgccgaatccgccgcatcccgccgtccccgcgcgccataaagagggggaaatcactccccgtgattccctccctcttttcccccacttttccctctctctctccctcggattcgttcggatttactcccgcgaacttcgccggcgcatcaatggagcccgagatcgccgcgccgatttccttcccctccggccgccctctctcactcccaaccctatttaaacgctccccgtgcctccctcctccgtttccgccactcgccgctttctctccccgtcggaatcgagcccgcgccgtcgtcctctctctccgccgtcgctgccgagctccggttcgccgccgtcgtcgccccggacctcctcccgcttcggcatcgcctccttcggcttcgccgcgttctcgtcgacctcgtccactcctccgtttcgcccgccgaccgccggagcaccgccgtcctcgtcgacccgagccgcgccgccgcctctctctgcttcggtcgccgttcccgtcgtcgccgtcgacccggggtgagccgaggaccgccatttcgtttcccccttccctcccctctctcggccgccgctccgccgtgcctatggccgccgccggcgaccataggggcgcgggcgcgccgcctcccgtcggccgtgccggcgaggccgccttcgggcgcgccccgcggctgccaggtggggcccggccgtcagccgcccgcgccctcgggtgcggctgacgcgtgggacccacggcgccggccggtgcaagccgcgtgcacccggtccaccgtggaccgtgaggctgccgcgtgggccccactcccggggacc

SEQ ID NO: 92495 - DNA, 1934 bp, Oryza sativa
gagagcttcctggctctcgtccctagctggagccggcgtgctgactcctggagttggtatgtcagtcccggtcagattcattccaggcttcagcgcaagtatggcaaggaagtcgctggccattaaatgaaggttgaaatgggcgtccacgggaaaagcgggcgagcggggcaggaggcgtgtgctctgcttgtcagaagtcatttccggctgtagactagccctcattgtaaaaagcatgtttcctttcttaggcagcgagaggcccatgtggtgacccctgaccagataaaaaggaggcccaggcctagagggaggaaaaaagaagaggagggaaaaaggagcaggaaggggggttgtgggactctggcgaacgggttctagagcctgaactctctctcgctctccggctctctgtattccttcagacacagatccaccagaacacaggagtagggtgttacgcatctcagcggcccgaacctgtctacgtcgcccgtgtcttgtgcgcttcctctctcgctgacgttcctcagatcgagggcgaagaacctcacttagcgcccccggccgaaccggcaaaggggggcctgcgcggtctcccggtgaggagccccacgctccgtcagagctgaagctattgctagaccattattccactgctgtttttttttcttttataagtatgtaacgttattattatgatggatttgtatattaaattgtcagtttgtgtacctcggctgattcctggacgaggattttatgcacaaataagttcggaaattactagtgaatttccgggcgtgacagattatgtggtacagatttctggggattcagttatggctaaagggaatttggatttttgaatagaagggattgaaatggtttcttagcacaagagaaattattctggaaatattattcttgtgccagaaagaatcaaaccttgggtatcaaactggcggtttgatttatagatagaagaatttggataatggaatatctagaggaatttgtggaaggtgttgtatgaaagagaacaaggatttctaaagataggtctagatcaagggtttgatccagaataaatttcagcaaaaaggaaattatactggtttagccccaaggataaaatggttaatggaatataacaaagagtcgggtcaatcagggaattattggcccaagctaaatagtagactttgaaatcttgagtggataatttagatgaacgagattttaaagggaaatatttgtgggagtatagaactggattcagaagtatatatggatgggaatttctacagatggaattggtggtagattgataaactctaagggatgggtatgttaacttaaagggggattgaagagtatattttatggactctgggaatattgagatgaaaaggaaaggtattaactctgaggaaattggaaattgtctatgtactctagggaggttagagaatgacatttcatatactctggagatagttgagtgaagatcaaaaggaaagtattggttctggagaaaataagaattgatatttcgtgtgtttgggtagagatcaaaggggaagtattttgtggaagataaaactggatttggtggtagtggtaatctctaaatgaaaaggtattaactctagagagattgatatctcatatgctctagagatggttgaacggcaattgaaagggtatttgttggaggtgttcgggaatggattcaaaggaaatataattttgagtcaaagttaaagattaaagaaaataaataaataggtttttataaaattaaaaagggatttaaaagagagcttttaatttagtaaataaaatctagatccaagttaaagaaaaggttaaaagcaagattattccaatggaagaatcgaaagagcataacttaaaatatttcgcaa

SEQ ID NO: 92496 - DNA, 1470 bp, Oryza sativa
cggaccggctcggtcacaatgtcgcaggtgtagtctctggcatccccgtctcactcccagaagcatatcggtagagtggtggaagcctggctgttcaccgccaccagcgtgcaccacagcatgtagaacggctcgtccgccgccctcatccgcgctcaaggattccgcccgctgccggcccgccctaatccgagatcaccgattccgcccaccgccggcccaaagaagggaagagagaaaggatataagagaggagaataaggagaaaagagaacgaaaaaggatgtgcatatgatatatccctgatggagggaccccttgtagtcacggttagtaaccccccattagtcccggttttcagtccgggagtacctatccgggactaaagatcgagctgaccatttttttttttgcatggccctgttgctgcatggtttatatatatatatagtttatatatatatatatatatataaaccatgcatatatatgtttcaatacatatatatgcatacatatatatatatgtatatatatatatatatattatattatattatatgtatatacatgcataatatatatgtatttatacacatatatatgttatgcaaattaatgcatatgtatatagatatatatatatgaccaaaatatatttacattatagaaaatgtgtacacatgcatatagaaacatatgtagtcatgtattaattacaatccattatatgtcctagctagctagctatcatttcgacgtagtagtactcgctgctagctcagaagctaaggaccggtgaattgtgtttccgtcgtagtagaattcacccttgggattaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacataatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtgg

SEQ ID NO: 92497 - DNA, 2875 bp, Oryza sativa
ataaaatagaagttaatgcattaacattatttaaagtactaaagattaatgacaattacttcgaaaaattatttttgtctgtaataaattaagtggataaatcgtaataagcaaatatatgacttataattaataaaaattccaatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatataaaattgccacttgcgtgatttaaaacttttaaaaatcctctagtcaattataattagcatatgaatgctagtaaattaaatgttaaaaactctaattaacgtacatatgaaattgccacctgtgatttaaaacttttaaaaattgtaagtatcacatataactagcatatacatgatttgaacttgttgaaacctctaataatcgtgcgtaattaacatatgccatacatcaattgatttatatggataatcaatacatccaaaatagtttacatcgtgtacacaataattacagcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatacatcggacttaccgatgttcctggcgcgaactagagccaagtgctcctcgatgtaaggagctaccaatgaagagtgttgcagaacagtgaaatgggctttacggaataaattgttgtctaccgtcataattgctttccttccgagagttccctttccccgtagtctcccttcatggcgtgattccggtaccccgattgggcgaaggtcttcgataaattctacgcaaaattcgatgacctcctctgttccataacccttggcgatgcttgcctctggacgagcacggttacgaacatacttcttcagaacgcccatgtacttctcgaaaggaaacatgttgtgtaggtacataggcccgagaatacggatctctttcacaaggtgacaaagcagatgtgtcattatattgaaaaatgaaggtggaaatatcaactcaaaactgacgagacattgcaccacttcattctgaagggcatctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaaca

SEQ ID NO: 92498 - DNA, 662 bp, Oryza sativa
cattgcgggctccacacaaatttctcttctttcttcaacaactgtgtcatgggtcgagcgattttggagaagttctcgatgaatctccggtagtatcctgccaaacctaagaaactgcggacttgagtaactgtcttgggttgcttccaatcggtgacggcggtcactgtttcggggtccacagcaactcctttagcagatatcacgtgccctaagaatttgatttcggacaaccagaactcacatttgctaagcttggcatacaattgatgttcccgcaactttcccaacaccagacggagatggtgctgatggtcttcctctgattgtgagtatatcagaatgtcatcaatgaaaaccacaacaaacttatccaagtattccatgaacactttgttcattaagttcatgaagaaggcaggtgcattggttagaccgaatgacatcaccgtgaattcatacagcccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctctt

SEQ ID NO: 92499 - DNA, 644 bp, Oryza sativa
aggttctcgtactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgatttccttcaaatccaacaaattgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactct

SEQ ID NO: 92500 - DNA, 703 bp, Oryza sativa
agattcctgcacccttatcttctaaaatagagttatatagaattatatgccatgaatagaaagagtaagttcagtaatcacgtaccatatttcagatacaccatttctgatgcagggcaactgaagccaagagcaaccggagttcagttcaccgatgagaatggaggactccaccaggcattcctcaacagcaactgtgatagtgaaatcattgtctctgctggcgcaattggcagcccccagctgctattgctcagtgggattggacccaagaatgaccttaggagccataaaattcctgtagttctccataacaagtatgtgggtaaagggatggctgataaccccatgaactccatattcataccgacgaaaagcccccctcgccagtccctgattgagactgttggaataactgaagctggtgtgttcattgaggccagtagtggttttggccagtcaccagaaagcatccattgccaccatggaatcatgtccgctgaggtatgtcatcaatcttacttgcatcatgagaagctttttgtgcataaaataggtctaaagcagtatcacaaacatcaggaaaaagctgctgcttagatctgcagacttcaaaaaggaaaacagattctaaagtctaaactatcaaaactcacattttgcaacattgcaaacacaacttagaccaattcattaattacag

SEQ ID NO: 92501 - DNA, 13826 bp, Oryza sativa
tgctgtggatacgacggcggtggcaggttggcggtggcctcaggcggatccggcggtggtggcggcagcagcgggcggctccctccaccccccctctcgcctccctcccgtggcagatccggtggtggtggcagcatcagcggaagccgtgggtggatctggtggcggtggcggcgcccgagagcggatccggcagcaacactccctccgccccctcttgcctccctctcacagcaaatctggcggtagtggtggcatcgatggcagccgcgggtggatccggcgatgctggtgtctgctgagggtggatccggcagcggcggctccctctgccgcctctcttctcccttcggcggcggggaagtgaagtttcgtgatgtatgttgttgttgttgtagttcttggatgattattatgtgattttgtgataattgtggttgattttggtggcaaagagtggttgattatttggagaagcagggtggatgtgctcgttgcatcggctcgaatatagccgatgcatcaagctgtttttttttggatcgtggaacctcgaatgtgtcggttccaaaactgacacctttgagaacaccacaaatgtgtcgactaataggtgccagttgcgaaaatcggcagctatagctatttctgtagtagtggcatatcaacatcgacctccctcggcacactcagcgtgatgccctctccatcgagcatatgaacggcttgtatgtcactgttgtctggctccacccaacccaaaggattatgagtgggcggacacccctgaggagaggggccaccgccaccaccaacaaccacaactatagaatatatttttgcatttggccaaaattgattttcgtaggaaaaaatcgcccttcaactctaccatcgctgccagctatcgtcgtcacccctcccggggctagggtggcggatccgctaccttcaagctcagtcgtcattgcccaccattgtggtcgcccctaccgtggtggagagcggtgccgtcggatccctcgttctggtcgctccagccggatcctacagccaagggcactgccaccacttcctgagcccgccactgcctctcccggcggcctctacactagatcccccgtcaccgagcttcccgccaatcctacccaatgctggtcgctcctaccaaccgccggttgccgaccaaccagctgctctagccacacgcatgagagggagagggagagtgagagtgagagataagaagggggagaagacgataagaaaggagaggtggaggagtggagaggattttgcttttatatttagtttgcagtgatttgtccaaacagacctcttaatgaggcgtatgcgaagatcttatttttgcatgcaaccgctcaagaggcccgtctgaaaaaatgcattttcgcatgcgaccttttaaactgaccttggaggaataatttttgcacgtaggagcagctatgatctgcctgcaatcaaaagagtagtgaagatagcgacacccgatgctgtggcagagaactcatctacaaggacgttgtcggaaccctctgcctgcctctagtgtaatcgatccaatgcatcgcgcgcgaactccaacccagtgcccgggccaccgtcgtcgttgttcatgctcacgtacaagagcggaggcctgggtgccgctattgttaacgatcagagttgtggaggcgaagagctctaatggaaaaatcgtttttcttgaggcagacgagcgtggtccagtcatcgtctatagggcataccatgggggatatccggaacataatacctgtgtataggcaccaatgatttttgggtatgtacatgcatttatttcgtcttattcaatcgtcatgtgcacatctgaataaaacataagcatgcttaaagtccctctaatgatacaacagaccacaataaaataaataataattaagtattttaaataaggtgtatctctaaaattttaaatgtgtcgtacattacaaaccgctgtagaggttgatagataaaacaatagaccaacttctaagtggtgaaaaatgagaatattaatattatattttggattatattgtttcagtgggacaacgctacagtcccctataggtttcccaccttctctccctccgtctgtctcacatgaaggtgggtggtgcagcagctaccggtttacatagaagacacaccaattatactgacaatatcttataaaattaaaaattaaatgggtaccgcgcacgttactacggaagaatcatgtgataaaatagtatatatgagttacagattcttctttctaactattctactgtattttcttttatgcgcttacacatctctcccgtcctaaaatataaggaattttaggtggatctgacgtatcttactactatgaatgcgtcccaaaatccccatacgttgcatgtgatttaaaatactctatacaataattactagtgggtgatgacgtggcatacttacatctaatttaaaatactctatatattaattgttagcgggtgatgattcgacatcttgcatattgagctttacgaggtctgcgagcacacgattagttcataaagtggctgaacaaatcatgcgtgggggcaattcgatcaaagtgaagaatttttttaaagaaaacgtcagatagaacctccctaactagtttgtctcccccaggtatattcttacacgatgaacctcccctcgccctagtttgctggatttcttttatcaggaatgtcagttttgttcgttcttttttttttcagagttcggttcgttattttctttatcagaaaagtcagctaaaagtcatagttttctatttgtcttcctctcgttgtgcggcactccggtagtattcaaacattatcatgtggtattgtggtcttcacattacggaaccaactggtactatatgaaaatatgaactatattacggagtatgaaattaagcaccttcgtgccattgaagtacttgcatacataatcaaagacaggaagcttttagcaaatcagagatggttgcatgtatcccgacgtcaatgtggtctaggttcgtgatagcagagtgcacgcatatctgaagcagatagaaatttcaatagctcgctcgcactagtctcgaataaagtcgaactaactgaatcacatgaattaggtggtgttcttttccgactaggataccgattttatcttgactttttttgctagcacgtatttaaactgttaaatggtttattccgtgaaaagctttctatatattagtgttgctttgaatattaagtaaatctattttttaaatttataataattatgcgctaatagttttttttacacaccctacctttatcttttatgttcagtaaaaaactaccaccttaatggtgttatcgcctataactaactacgcgcgcgctgagtaagctagcataagctgatcaagtcatatccgtagaggttaattaatctatgtgtagggattgagcaggttttacttccacgagggaatgtccggccagtcctcggactcccctcaatcgtgtttataaatctgaaatatcaattaaatagtaatatactccctccatcttaaaatgtttgatgttgttaactcttttaaaaatgtttgaccgttcgtcttattcaaaaaatttaagtaattattagttcttttcctatcatttgatttattattaaatatatttttatgtatatatatatatagttttacacatttcacaaaagtttttgaataagacgaacagtctaacatgtttaaaaaagtcaacggcgtcacacgagacggcatgtgctccattccatacgtgccgcgttgcacgctgttgtatcttcttttgtacaacagcaagtatgggtcctgatgagcacatgattccattgcatacaaacgttactccgcaagttgttttgcaacatccaatcactagaaactagttcaaaaaatatatttaccagaccggccaaaagtggtttttgtgtgcgtaactacagtccgtctgcccggaaggctgtgcgaaaattgctcattttccatataggtagcgcacccatacgcgaaaatccaattttcgcgaatgggtgtttatgtcgtccgcgtgcaaaaataaaaatccgaaaaaaataaaaatcgcaaaaaagaaaccctagctaccgccagagggctcctaccgccgccaccagatccgggcggcgccgccacccaccgcctaccggattcacgagacagagctgttgtcgccttcttcgatgcgcaggggagcctgccaccatgcttcgtcgctgccacacgccatcgtcacgaggcaagcgtggcagatccagccgtcaaggatccgtcaagggcccggtggatgcagatccgcctgccatcgagccaccggccaagccctccacctgtcgctaaccgtgcctgcggcccactgctcgtcctgtccagtgaggtgagagaggggaaagtgagagaggagaggagaagaggaggtgaacgagtggcgaggaaataatgaggagaggaggtaagagagataagtggataaggaggaaaaattttaaagtgttaagagggaaatgaggagctaactcagactttagacagatcctcaagaggccctaatgcgaaaatatattttctcttgtggcccctcaagagttccgcctgcaaaaatagacttatttttgcgtgcggccccttaagaggttcacctgcaaaaatcattttgcaagcagtcctcttaaggaggcgtatgtgaaaatggaggatgattttacagatgcgataagttacggtctgtctgcaacctaaagagttatcgtctagaaaaaatcatttctgtagtagtgagagctcaagcccgacaattaaatttataggtgagcttgttcctaagtacttctttatgtacttttgaggatagattgttacctaatgattaggaactatggagtggaccatggagcacttggagagagacgttcaagtcgagatggagatctaaatcatatcaagttcaagtctactttgggccccaagagaaatccacactaaattcgttgtgtaggatgcattcggactttgatttcgacattctacatatgtatggaaagctaacgagaccacctttcctatggatctagtcccatgtcaaaattccacccaagtcaatggggattgttgaaacaagaaggtgttaagaatcagtccgagtgttgcgtcactgtctttgggcccgttgggccatgtaccgtattggagtccaatagggatgcatccagaggactaaggtcgaccccagaacctatatattccatagccgcctttgagttagggttaggttttgcttagattaattcttgtatcgcagtttcatctctagattggtttgtggaacccaagtttgagttcttgattaatcattcatctgcaattgagtttggtctcttttcctttacatatgcaaatacctctgcaaatgagaacacatgaaactcatagtgcaaaaatgtttgttcaaatatataacacgtgaatctctcatagaaagcatgcagctttggtttatgaatatgtaatgtagacatggtcatatacgaattagtgatctcattatgtctttgattaatcattcatctagaattgagttcctgtttttcttgttcttgcttgtgttcttcgattcacatgtaaggattaccgttctcgtgaggtcaatcaggtttcggcatggttgataaccaaaggagacattgtgttgcgattgtagggtttgcatcgtcttgatcagaagccagatcttgtgtgtcaagtttccaccaaatcgatagttatcttcacctgacaaaagatcgggcatccagttgccatcaagtggtataagagctttaggtactgtactgttaggttcgtcttcgccctagtattatttttgcttttatccaatagtccacgagaaagtaaaaaaaaaagtagtttgcataattctgtttttccctgtcccagaaccacgtttagccatttgcataattatgtttcagagtccgtagtgttgagtttctgtccaaggtcaagttagtttagaatcgcgttcgtagttctagatctacatgttgctttgtgcgagagcctgccatgagagatcgagttctacttggtttcggattgctagccaccttgtgttaataacccgcttttgcaagccctcttagataggttgcaaaccaccttctgtgaatcaccttgctttgccagccccaatgttagcccgcataacctattctgcaatttgcactctagccagagcttcaacagggtgtgcgtgaaaccctaacttgtgcacatatttgaaaacaacaactcaattgcagttaaatgatcaatctagaactcgaagttggggttccacgaaccgctctagttgcgaaactacaatggcagaattaatctaagcaaaacccaaccctaactaaataatggctactgaatatatagattctagggttgaccttagactcctggacaagtcccttttggactccaatatgatacacggcccaacgggtccaaagacggcgatgcaatactcgaacagattccaaacgccttcttgtttcgatgattcctgttgacttggtaggaatttggacatgtgactagattcattggaaaggtgctctcgttagctttccatacatatgcagaatgtcgaaataggactccgaatgcaacctgggcaacgaatttagtgtggactgctcctggaacctaaggtggactcgaacttgatatgagttgtacctccatcttgatttgaacgtctctttccaagtgctccatgttcctctccatagttcctaatcataattaaatcattaggcagcaattattctcaaaagaagtatttatttcaaccttgcaaaacaacttgtggagtagcgtgtgttccaaaggagtgatgtcctcattaggtcccacaggccaccgcatctctagtacagtgtgcataggttgatgcttgtattagcctggcattaggcatatatgtatatatgtatcggacatcataccccacggcccatgggtatcagccctgataccatattgttgtcgaaatgacaaccgcatacgtcgaaagacgtggttactcaacagtggttggaaaagaagtaaagtgtattaatttgagaatttttacttgggatccccctattacatggccctatggggctatttatagcccccattacaggtcttactactagggctttggttatgcaagggaatttacatggttggccttatgaaagggacatttacatgggtacatagcgtaattgcggtccatgggcccttagcgggccgacaggttattgtcgacccaattaacccctgggcttgatgggccaggatagcttcttcggctctccaagagtcaaacctactacggcgaagtcgttccccttcggcgtacgctcttccccttgcgcccttcgcccagggggcctctagcttggctgcgattccctgcctctcgccgtcctcgctccatagtcttcgacatgggaagggttcgcctggcccaaatcctcatcggtcgcatgctttcggcaggtttggtcgaagggcctcatgcgatatcgccaacaagcccctcacgggcaagagtgagataggagcttcggccgagaccgtgcaaaccatgtgatatggtatgtggcgccccctttcgaccggtgctcctgccgaaacctacatcattcctgcaagtaaaatttgtttgtttctacgcttagagaaaatttctttgagaagaaactcctcttcgcattcgctacaaagcatcgaagggggggttatttagtctcttttattactatgaatagtaatgggccctgtgggcttttccttttccgtttttgggcttttactgttcggcatcgtcccgatggaaatttaccgtttcgtctgccctttgacacgtgtcagaactcgattggttggtaggcgaatggtctcgctacggggttatatatacccccaaaccggcctgccattttttactctccccgtgctctccccttttttaccgcttgacacactccgtgctctcttcgctcttctgtttcttcaacttttttgccatcgccgtgctcctagcctttcggctttttgcctctcttttatgtgctacgagcctaatggctcaccgcaagcctaccaaggccgggtcaactggcgaagatcctggaagccttggcgaaggatggtcatgcttccttggcaaatcacttgtcaaagaggccgacttgggcgtactggtatcatccggttctctcacagagggccaaggatcgtgcgggggtgaggccgttgttccctcgcctggggatgggcgaacggttgtcttcgccgcatacttcgctgctggtcttcgcctcccgtgcgataacttcttgccttcggtgctttcgatgtatgaggttaggcttccccagcttagcccgtcggcgttcccgaagctggcggttttcgcttggatgtgccggacctgtgggttcgcccctatcaccgagcttttcgccgctatgtttattgcatgcgcctcgaccaaagacgtgcagatgccggcgggcccgaggaaaaccgttttcggctgcgtgaacttcatgctgcggccggagcgttcagatgcttggccagtgcccgcatcgatggcgaaataggacaggaactggatgcagaaatggttctacattagcaacccttactccgccgaagatgctcaggcgagctggctgctttttgagcgttctgccgtctccatcaacgcgaagccgaacgtggagatcgacgggactctcgagtcccggcttattctccttcgcaaggttgcctggcggctgagcacctgggatctttgcgaggagttttgtctccttcggatttcccctctcgcccgtgtgtgggatgtttccgtgaacgagggcgaagaagttcttgggcttccccgcctagttgtccccgccggggccgatagtaaggttttttgtttttgacttaggccgtgtacttccttcatgaaagcgctttttaggctaagcggttgtgttcctctctttttcgcaatgcggactttggacgacgctgaaattgaggcatcgaagatgatcggggctctaaccacagccgagttcgcccgcttgctctagcgccaagccgacggccgggtgaatcgtgtctatactggcgaattgccgagccaatcgaacccctctcgtgctggtgatgacgaggctgggacttcaaaaaagcgcaagcgtgcggtcgcgaaaggtggccaagtccgaactcgccatagcgcgaaggccgccgtcgaaagtgatggggaggaggaagatgaggaggatgctgatgctggttcggaggaggatggctctcgtggttatacccccagccctacccctgcgaaatccggggcaggctcccatgtttcgcctacgcgaccacaagaaaccgtcgtggcgaacacccttctggtgatctccagcacagccgcgaaaccggtgatggatgtcagaaggaagaagaagaaggggaaggttgtgcaggtcggccatggcttttcggacagcgaagggtccgacgggacccctacttcgccggtgttgcggcgcgcaacttcccgtggcaggcgcatgtctccgccacccactagcgatgccgaagcggcgacgggcggtagtgcctcggccccggccgctagggcgaacgtcgctgaagacgaacgggtcgaagtggtcccttcacctattcgtcaacgagaggggaaggccccggcggttgaagcgagtgtttcggacgtgacgattaccgccccacatttcgtccccgccgactttgccacgcgaccggagatcattccgttcgtggacggggtgtgccaggtcatagcgtcgaccgatggccttgggcttttcaccgaactgaacgagttcggcgaaagctatgtggctgtggagagcctatttgtgcgggtatgacttatttttgcttgctaaattttgctctttcgctagctctctaacgtaatgtgtatatatatatatatatatatatattaccagggcctcgccgcgcatctaagtgccaagaagtccgcgttagagcgaggagagcctatttgtgcgggtatgacttattttttcttgctaaattttgctctttcgctagctctctaacgtaatgtgtatatatatatatgtatatatatatatatatatatatatatatatatattaccagggcgtcgccgcgcatctaagtgccaagaagtccgcgttagagcgactagatgggtaccgccttcgccttcgcaagtcctaagaagatcttcgccacaaggaagacgaaaggcgtgtggtggtggtgactttgaagaaggcgaatgctgagaacagatagcatttcctctggccatttgcccttcgctgcctcctcaagccttttttttagtgcttctaggattttgccatttgtacgttcggcgccccatttgactcgggtgcgcgaccgacgcgaacctaatttccaggttaagcctttcgcacatttctctgaacttgtcagagtcgaactgcttgccgttgtcagtgatgaactcttttggtgctccgaaacggcaaacagtgtttttccgtacaaatttttgcactactgccgaaatgatcgctccgaggggttcggcctcaatccatcgagagaaatattcaacagccacaattgcgaacttgtacccgtttcgtgccatcgggaacggcccaatgatgtctagtccccatctggcgaagggccagattggcgcaatgggctgcagctcatactggggcacggtttggcttcggccataacgctggcaactttcgcacttcttaatttgctcgacacaggctttcaacatagtgggccagtaaactccttgtctaaacactttggaggcaactgttcttgcggcttggtgcgcgccacatagcccctggtgtatctccttcgccatttcctcgccttcggcgaatgagatgcagcaaagcaagggttgaagtaccccaaagcgatagagctggcctgagaccatcttgtactttgtggctctgagttgcaagcgttttgcttctgcttcgtcttccggaagccatccagtttcaaggtgtttcacaaacggggttcgccaatcgtatgggtcttcacccagttccacttggtcaattgtcatgacttccaagctgtccatgggcacacatggtgtgtataagacttcaaaaaagatgccaggcgaatgtgagccaccacaagcagcagacttcgccaaggcgttagcttcctcgttctggcctctaggtaaatgttcgactgttatgccggtgaagcatttttccatggaccgaacagcctccaaatacttcttcattccatcttcctttgcctcgaaggatttgtcaacatggcctgctaccaacttggagtcggttcggattagcaagcgtcgaacccccaatgctttcacctttcttaggcctagaagaatggcttcgtattctgttgcgttgttggttgtgtcaaactgcagccttgcagcatatcgaattggcacgccattcggcgaagtgagtactgccgcaatgcctgtgccccaatgcgaccaagaaccgtcagagtacatcacccagggctgttcgataggctcgggctcgggggcgaatgctggtgtccatttggctacgaagtcagctagcacttgagacttgacggcagtgcgggcaacaaaatgcaagtcgaaaggggatagctctgccgctcacttgctaagccggccagtaacttctttaccccggagtatttcgcccaaagggtactgtgatggcactatgactttgtgggcctgaaagtaatgcttaatcttgcgtgaagccatcaccagggcgtaagcgagcttttccatttcaatgtatcttgtcttcgctccttgcaatgcttcggagatgaaatagaccggtttttggcctgaatccgtttcttggacaagagcagcactgactgccactagcgaagctgccaggtatagtagcagttcgcttcttgatgctgggctgatcagagctggcgggctttgcaggtattgttttagctcgtcgaacgctgcttggcattcgggagtccagttgaactttcccgcgccccggagggttttaaagaagggaaaacctctttcggctacctttgagaggaatcgactgagtgccgcaattcggccctgagcttttgtacttcacgtacgctcgacggaggcttcatttgctgaatggcatcgattttctcgggattcgcctcgatgcctctttcagaaacaaggaaacccaacagcttgcctgcgcgaacgccgaaaacacacttctcaggattcagtttcatacccgctgcacgcaagttgtcgaaggtctcctgtaggtcggatgcgtgatcgaaagccttgcggctttttatgacaatgtcgtcgacataagcttccacgtttcgccccaactgcttgtaaaggatcttgtacaccaacctggtgaaagttgctctggcattccttagaccgaaaggcatcctgagttgacaaaaggtgctgaacggtgtgatggaggctgtcttggggatgtcggctgggttcatgcgaatctgatgatagccggaatatgcatctaggaagctcatgggttcgcagccggctgtcgaatccatgagctggtcgatccgtggcaagggaaaatcatccttcggacatgctttgtttaagtctgtgaaatcgacacacatgcgccatttgccatttgacttccgcaccagcactggatttgccagccactcaggatgatcgatctcttgaatgacccttgccttgagcaatttttggacttcggcttttgcggcctcctggcgatcaatagacatcttgcgtagcttctgtttccttggcttggcatccggcttgactgccaagcgatgcattattagatctgccgaaactcctccgacttcatcagggccccaggcgaagatatgaatgttctttttgagtacctctaggatgttcttagcttcttcttcgcccatgtcgctccccagtgatacgagcttcgtggggtcggcatcatcaatctgcatcttgactatcttgccgtgaggggcgagctttggcgcgtgcttcgcccggtcatgcggttcggcctcaacattgtgcactgctctattgattatggccaaatcaccttttgaagcaaccgaaggctgaagccccttgaccacgatcactcctgccgggccgggcatcttgagcttgagataattgtgatgggaaatgacttcgaacttgttcaaggttgcacggtcgaagatggcgttgtagttgtatgggatgtcgacaacgtaaaacaatacttgctcttcgcgtctgttttcccctgtgccgaaggctactatcaactgtgcttggccaagaacttgaactgcttctccgccgaatcctcggagcgatgtcggtgctggggtaagggcttgggtagtcaaccccatcttggcatatgcttcggcaaagatgtgttaacagtgaaatttggcaagcccggagtagtcatcggcttagagtcagcatcggcttcgaagtcctgagattagccgatgagagttgtcaagtcgtcagttgtcggattcttgctatattcggttaaggaaattgatctactaaagg

SEQ ID NO: 92502 - DNA, 569 bp, Oryza sativa
ttccaattcctgatggcccagtatgctctatgctcaagttctacgggtagtcaacatgacttcccgtagactatctgatatggggacattccaatgggtgtcttgtatgctgtccggtaagcccacagtgcgtccggcaatctatccttccatcctgttcccattttgttgactgtcttttgcagaatattcttgatttgtttgttcgatgtttctgcttgaccactggtctgtggatggtaaggagtggccacgttgtgtttggctcccatttctcgtagaaggtctctgaaggttttgtcaatgaagtgagaacctccgtcacttatgaccattccggggtaccaaatcttgggaagataatttctgtgaacatcttcttggcatgcttcgcatccgtggcggtgcacggtatagcctcaacccacttggagacatagtcgactgccaccagaatgtactcgcagttgcgagacttagggaaaggtcccatgaagtctatacctcacacatcaaatatctcgatttgcaaattgtatgtgaggggcattgcatcgcgagcagtgatt

SEQ ID NO: 92503 - DNA, 2735 bp, Oryza sativa
taaagtagatattaattgcttagacgtggtgtttaggtaattattatccagtaattgatgcgtgtcccacagtacgttgaggtaggtgtagaggtggtgacagccctcgagatcacttaagtccttcctgtccgggtacgtagtagagcgacatctgggaacagcgggttgccagtgcctgaagtattgtgttaggattaaagttaagctttccctagacactaattctcactagtaaatcctctctatccaagcctatcctttgcttggtgtccatggatgaaccggaggaagatctgaccatacacgttcccttggattcgatacccttgtaatactccataggggaagtgctacattggtatatccgtgcgcttgcgcattttatctgtaatcgtattaaataccaacagtggtcgaagtggagccacccaagacagacagcctggtgaaattcatgcaaattttcctggagaaggaaacatcgatgcccaggaaccgttattggaagacgccggtaaaaccacccatatcgccaagaagttagagcagccggctcagaagaagccgccgtccgcaccaaagccaaggaaggtgtggagggaaaagccaaagacgcccgctccatcacctccagagacgggtggaaaatctacgaactgaatcagaaggaggtacggtcttgcacgtcggactttaaatgacgcgaccttcgccaacaggtaaattggtatgtatctacatttttgctttcaacaatttggatttttgcatcagcacatggttgaatttcaaagttgcatttaggatttttgaattttgaggaaattcttccaatgaatttttcagagcaaaccaaaataaaacttccaacaaaaattcgcagtgccacgactacactgaccgttggaatccaacggtcgaaagtggggccgattgggcccaccaggggttcggccgaacacctggttcggccgaaccggccaggcaacggtcggctgcctccctctttgaggcaatggctagtgggccccacaggtcggttttgaccgttgtgggtgcactacttaagccaaccggccgggagagggaactccaccccatttcaacaaattttcattccctctccaaagtttgctctcaagttcattcaagctttgatagtttccctcaaattcaaatacttagttgcatatatacaagctgctttggtgaaactaatcggcgggtgaaattttttttattcctaacccccgccgagttagtccgttcttgctccattgtgcagaatgaggaggcgattgtctcgtctgttcaaggggtccagctcttcatcaagtcatcatgatgagtctagtactcgttcattagctaatgtctcgatggaagacgccgaagctccgcgatgactcctaaacgacaccgaccttgaccttgtcagtgatcgggaaagacaagcctactacatgttgagcgaccgggagtatgctcacacacgagaatactctccggagctgctaaaaaagataggtatggatgttgaatttcgttctatttggaaagtggttggttggcaaagatttgctgtggtagatgagcctggttctcgtttgcttactttgcaatttctgtgcactttgaaagaaatagaagatggaatttcctttcgctttttccataaggagtacacacttacatagaaaggcttaagtacacttcttggttttcacgattcctgtaaaatatatcttcagaaaggaatttctgggttcgagaaaaataggttttgggaagatatttctggtgctccaatttgcaagaaacctatgacgaatgatatccataatcctacacttaggctcatgcataaatggattgctatgactttgtttcctagaggtgatcttagacccattaggagggatgaattgattatcatgtttgccatggttagaaagatcaaaattgctcctgtgaaatgtatgataaggcaatggttagaaagtataaagttctctgctcctgttgagttcacttctcttattactcgaatagcaaaagggctaagggtcgttagcgactaaattgcttttatctcagccgctcgtccgtgtattgatgagacctatctagtgcaagggcatattctgaagcatggagtagatggatctttgatttactttttccccggttgtacaaatgaaatcccgttgccaaatgcggggtatcatttgtacaactgccatgaactaaccatttccctgcaaaccatagaagaatttcgtgtaggtggagcatacagggagacgcgcaacatgacaaggaatgaacgagagagttcatcatcctcaacacccgtacagatgtatgaagcaggttgggcaccagctggggatgcacccggatggacccaagctctacgccacagcatcggagtcttaacctgggcgagtgccagtgaggaccggtggcgtgcgcctcatgacatccaatggggggacaaccaaccttccagatcaagtggtgtgcctccattccttgatatgcagatgggggagatccagtacaacctcatggaacacatagctcaaacgcaagaatggcaacaatctgctgatgctcagttcgccaacttcaacaacatgatgctgcaacagcacgatgaccttcaagcgtacttccgttttcaggggttcaatccttatcaaggatcctgagcgaaagcaagcttgggg

SEQ ID NO: 92504 - DNA, 653 bp, Oryza sativa
ccccagttgagttttgcctgtggagtggagctgaagccccgcaaggatcgcctttttccgctgctgtcgttctgttttggtctgaggactaagtgcctcttctgtaagtattttacgctttatttacgtttagaactgtatattacttgtcgttttgtgtaccctggctggtcctggacaggtatttaatacgcaaaatagtctggaaatttgggttaaatttctgggcgtgacataagccgaacaatagagcattgtattcagcttgattatttgtacaataatattccaagcgaaccgatgcttcataacacatgccattaggtgaaaacaaaactactcctatgccttgaccttctttgcaaaaagaaccatcaaaataaatcttccaaggtataacttcaactaagcaaacctctccctcataagcaatatctatatgatggtctactataaaatcacatacaatttggcctttcatagattttaatggttcataagccaaatcatattctatcaaagcatatgcccacttaccaattctcccacttagaattggcctttgcaacatgtgtttaataacatcggcttgacaagtaactatgcatgtactagataacaaataatgcctcaatttggtacaagcatagtat

SEQ ID NO: 92505 - DNA, 1659 bp, Oryza sativa
tcgatcgccataaccgcgggcacggctattcgaatagttttactctggccagaggtgcacaactgtacccacaagacacaacccaccgacatgtcaccgcgtcatcatgtgcccatgatgctcacgtcaccatgtcgagtgattgtgacgagacccttcgcataaccctcccctaaccatccacaccacgctaaggtttcacccccactcctcaaaaggcagtgggcggtcccctcttgcgccgcggtgaatccggcagctagacaaccggacaccccggccgacccaactccatcacgcccaccctcgccaccggtgcctaggaaagggtcgagctatacttcagatcaagcggttacccactcccgcttgtggcaagcgctgtaagacttccagggtttcccgtgaaccggtccttaattgccatgggtgcgactcacaaaaccatgcacccacagcccaccattcagtcgcattttagttggataattacgaccatgaaacatggccagatgtctcgagcacgcagctcaacaagatactagaatgtctaatactgcaattatcccatcgactgagctagtggtaattaagcatggctaagcatatagttctagctaggtcatcaaagtaacacaagctaggcgatttattacccacggttgacaaaggacagatatcaagtaaacatggcacaagcgagcagataggtaaaaccctaaccccatgtaattagcaaaacatgcatgtttatttgcaaacagtaaaacatttataaattaggatcaacatgctcaaggggaatgtgtgacttgccttgcttcttcacttggatcttctgaactcttatcctcgcgaccgcgaacttccgaaacgacagattctacacgctggcacgcaaaacgaggaaaaactctaataaaaaccaaggaaacagtacataaaaactaaacaaacatgtagagctcaattttagatgaattttgcaagttgaatggctcaattcagagttcgaatgaattagatatgaattttagaagttttgagccatttaaatgagtttctagaattattaacgaattatgacgcaattattatttatttttccaaaggaaaagagggttgctgacgtcatcaaaggggaggggccgcgccggcaagcgggccccaccggtcagcgtcacaagggcgccggtccaccgtggaccgggaccaccgaggcggtccaccgccggtccacgggaaccgacggcccggattggcccaagccgatcggacggccacggggcgcgcggctggggcacggtcacggctcaaagccggccagccgagtgatggcgcacggcagcgcggccaccggcgacgacggccgacgacggcgcggggagcggcagcgcatgcgggcggtggcggcgcacgctagggagcggcggcgcggcgcggtaaggtgaggcggcagccggctgcccggcacagccggcagcggcgcggagcgcggcggcggcgacccggtcggatggccaccggcgacggcggcgcgtcccgagcaggcacaggaggtggccgaccaaggggaggaaggggagagggaggggagtgctcaccgagcggcacgaccgcaaacgggcggccgacggcaaggaacggcggcggcggggc

SEQ ID NO: 92506 - DNA, 2664 bp, Oryza sativa
aagaacaaatccgagatgaactcgaatccaactctttccaaagtgatttagccaaagattccaaaggagaaaaggtagaggagatcccggagattgtttcccctctattgattcggccggagaaggaaaggaacggccggatttggaagggaaacggcggcggcgcgaaactagggtttcgggcggcggcggccgaaggtagacgacgactgacaggtgggccccacctgtcagcgacagcgagggcgcgcgcagctgcggcggactgggccggctgggccaaggagagagaagagaggttttgggccgactttcggcccaaagccaaaagaagactttttaaaacctttttcaattaaaattatttcttaaatgcaattccatttattaaaaatactttcttagctcaaataaatcccagaaaaatctaggaattatagaattaagcaaagtatttaaggaaattttatctgggcccattttatattggaatttattaattaaaaaattagatcttcttttcaagactttttaaaattatttctaaaaattccaattaaacaacaatttacatattttgaattttcagggtgtgacagctaatatggttttgggaattgtaagttttggatagtgctatatggttttcagtgtggtttttaatatgcatgactttgagacactatgccagctgaaatcttgtgatcgtattctagagggtatgggtgtagtgctgcttaatttcctgagctacacaattttatttgtaccgacgttagttatatgcaggttcttcgagtagactgttaaaaaagagaaaaaaaataagctgctttggggtgctatatggttttctttttaattcaattttgtagagctctagcataacctgttctaaattctaatgattagaaaaatttgctaccattatgcattctaccaacatatattagctagtatctgccatttttcctgagattgattggagaagttgtcaatttatctacttattgcagtgactagattgtgatggcaaatgaatgtgattcctttgtgtgcatgatgtccgaagagacccatgttgaggcatattccttgccaatgcaaaatgaagaccttcatacttcaacaaatggtgcaaaaaggaagagccaaaagatcaagcaactttaatcgtaaggaggacattcaactgtgcatttcatggcaaagcattagctcggatcctattattggcaatgagcaaccagggaaggcatattggcaaaggattgcagagcactaccatgctaaccgtgattttgagtctgataggaatgcaaactctcttgagcatcattggggtaacattcaaaaggaagtaagcaagtttcagggctgctacgagcaaattgagcgtcgacatccaagtggcataccacatcaagagcttgtaagttaaattgttattcattattattaataacaatcttgtatgtatgtgaactaacacttgaattttgcttcaagttcttgaagccgaggcattgtattcatccaatgcaccgaagaatagggcatttcagtttaatcattgttggctcaagttgaggaattctccaaagtttcaaactctagaatcccacaagaggccaaggtctaggaagtcttcgaccctaattgagagtgctggtgaagaagatgaagaaggagatgatgctaggaagagtacaactcctgatttattacagccaagtgctaaaaaaagaccaatgggtaggaagcaagcaaaggagaagatgaagaatggagaagatggaccatacaaggaggcgatgaaagatttgcttgacgccaaagagaaagaagctaaagtgaaagaagagagatggaaggaaactaaggagattcaagagcgcaagctcttatttgctgagcgtaagttagtgtgggatcaagaatagaagatcatgttttgtgatgtttccatcttggaactagatgtgagaacatatgtgttggctatgaggacacaaattgcagcttcaaaggtggctgccctcaatggtggatttgatggtagtagtggctttggaggtgagtttggtggcagtaatggagaagtttgagcacttcaatggaataagttggatcgttttggatgatccatgtgtcctttgctagtaggatatgtcatttccacgattggttcttggagtccttttgtgttaatttctgcaattatctaagtgtcatttgctagtaggatatatactacttttagatttgctatttttatgaacgaaccattcattcttgtagggtgtgttatttttaaattatataatgcatctccgcaaaaaaaataatgcatcactgggttcacatagcctattgtggtgatatggagacagccaatgacatgttggtgagaaatttttgttttcattggtgaactataaattttggttgcatgttgttgtatatggcattctgcccacaccatatttacatgtttgaaaattttgattttggttctgaattgtggcgtttgaaattgtaaatttaactatgtttcaattatacgcgttagaaatatttatgtttaattattgtggtgttaaacatagtgtaaacaaggattgcatgttaaaataaaagagaaacatgagtaggggctaaaaa

SEQ ID NO: 92507 - DNA, 1197 bp, Oryza sativa
atcctaggtgccaaatttgggtgtaaacacatgcccccctgcctttttgatgaacaacgtgaatctaaaagcatagcatatgtttttggtcttaggacgataatctaattaccggccatagtacctcctaagtgtcttgccaaacgctcgggaagtatttcttcaagtacttcccgttgattgctcgctgaaaacgctccccttggagtgtctccaaaaaatacgcgttccctcgaacaatgccgcatacttgataaggaccctcccaactaggagaccacttaccgaactccttggatcgagtacccaaaggcaaaattgtcttccaaaccaagtctccaatttgaaacaactttgctttcacccttttgttgtatgccttggccaccctcttcttctctttctctatctcctccaatgccctcaagcgctcgtcgatgactccatcaagattatctcccatcaacgtcttgtaatcttcacttgacaaatcatcttgcttgatataacgaagagaactaagatttacctctaccggtaaaacgacttcttgaccataaaccaactcaaaaggagtgactttagtggcaccatgtttagatatcctatgagcccacaatgcttcggaaagcacctcataccacctctttgggtgttcctcaatcttcttttttactagcttcaacaatgtcttattactcgactcggtttgtccattagcctgagcgtagtaaggagaagaactcaacaatttaatactataagattcggtaaaactcttcacttccttagacataaaaaagcaccttggtccgtagttaatgtttgcggaataccgaatctatgaataatatacttcaaaataaagtcaattaccttcgtatgagtcatattcttcaaaggcacggcttcggcccacttggtgaagtaatccgtagcaactagcacgaacctatgcccccttgatgacgaaggataaatttgaccaacgaaatctaaagcccaccctcggaacggccatggtttgattatgggattcaacacggtggcaggcaccaattgaacattgccgaaccgttgacaagcctcacatcccctataatatttgaagcaatcattaatcatcttcggccaatagaatcctgccctcctaagcaaccaatttatcttgtgggccgattgatgagttccacaaat

SEQ ID NO: 92508 - DNA, 1836 bp, Oryza sativa
agaggattctgagatatctaaagcatacagttaagcttggtttaaagattagtaaatctaactccttgcttgttagtgcgttttctgatgcagattgggcaggatgtttggatgacaggctatcaactggaggctttgctgtgtttataggacccaatcttgtgtcatggagtgcacgtaagcaagctactgtgtctagttcaagtacagaagcagaatataaggcattggctaatgcaactgctaagattatgtggatatagaccttacttcatgagttgggagttcaagcgcctaaaacagctaaggtatggtgtgacaacattggtgcaacatatatgacagctaatcctatgtttcgtgctcgtacaaagcatattgaagtggactatcattttgttcgagaacgagttgcacggaagttgttacaggtagaatacatatccacaaatgatcaagttgcagatggattcaccaagactctaactgttaaacagttagagatgtttaggaaaaatctaaaccttacaggataagattgagggggagtgttagagttcggatatattgcatgtacatgtgataatgctcccgtatggctgaggatagagtttgttgtgttagttagacaagataggatcaatttctgaaatttagctgtacacaacaaactctcactgaagctatttatctcttgtatcctgttgcctggtttgtggcattattatcaacacgtaacctcctctctgtaggagttcctcgcttccacactcggcgttgccacagcgatgtacacgcgtcgagcgcgcctgagaggtgtcggcgccgatatctccctctcacgttctctcttgtctgctggtcggttggaggagttgcacagagaggaagcgagccacagccactgatgagtgggcccaaaacgatgagaccaaggttagggagaaagggaagggtagaaacataggtagacttgatttttggacgattttccaggatatatttctcttcccttctttgttaattcattcattaatttgtgtcgcagatcaattcatgtggattttagtggaggtagataaagatacctcagattccatttattagattccattttctttggttgcactaaaaatatatggatagattactcacagaaattagcagacgatgggctcgttggaaactagttagaatttttagaagagctaaacaaaggaaataaattctggaaaaattatatttactcatgataattgaactagtatttgaataaattattttctctatacacttccatgcagttaaatgcacttttaaataaagtatggtttttgccgattaggaatagtctattattcgactggtttgattgatttatttgaggtatcaaatttagttattaaattgtatcaaaattactgtgtgttgtatatgttaagtgagcgtacatgaattttcccatgattttatcttgcacaaattattttagataattagcaagacttatctcttatatgtgtttccctttcctaaatgtatgtaaatgtttataaaagttatatttggactcttcttaacctgagatgatgttgatatgttagaattacagtttaccttacacatgtcataagcttcttacctatttatgtataagtttactttagtataaattaagagaatgcttatagagacgattaagatagaatttaccctatatgagttaatttatttattcactttcatgttcatgacttgtctttagatggatgaccaaattagttttgtggggcttgacatcggccttgttgatatattgtaaggtgtactatggtt

SEQ ID NO: 92509 - DNA, 2630 bp, Oryza sativa
ccacgacgacacgcggcgatggcggctgcggcaaatgcggcgtgtggtgtatacgctttcgccgcgtggggtggcagtggcggaggatgaggacgacaaccaggaggctgtggcgaagggtgaggacgacgacgaggaggcgacggcggacggccccgagatcaagatcctggcgcgcggcggtggcagtggtggcggtggcgatggcagtggtggcagtggcgcttagttgcagcggcaattgcgacggctttgatggcggcggtggcgctgcgtcggcatggcgacggtgaatgtggcagcggcggcggcgacgacgacgacggcacgaaaacggacagcggtgacggccggccggaggagatcgagagagatcggagagggtggtaggtcgcgatggggatcaggcggagatggaagagctggcatgtgggcccaagggcatttttggcatttcacgcgatttcaatctcctcctcaactggaaattattattttagtcggcgcaatgtccaccggcaaaatatcatgtttatggagtgttttccctcaaaagtgagtttgagcagtgtcctagggctaaaatcacacaatagaagtgtcatgtagcaaaatttttcaaattggacagaggcaatgaatagtgaatataatgccctcatgaaaaataaaacttggcatctagtacctcctagcagaggattaaatgtgatagactataaatgggtttacaaaattaagaggaaaactgatggtagtctagacagatataaagtcaggcttgtagcaaaggggtttaaacaaaggtatggcatagattattagtcctgtagtcaaggttgctactatcagaactgtactgtctatagcagcttctagagggtggatgcttcgtcagctagatgtatagaatgcttttcttcatggaatcctagaggaagaagtatacatgaggcaaccaccaggatatgaacaaggtaactaggtgtgcaaacttgataaggctttgtatggtttaaaacaggctcctagagcatggtactctaggctaagcacaaagttacatgagctagggttcaagtcatctaaatcagatacatccttgttcttttatagtaagggagatattacaatgtttatgttagtgtatgtagatgacattataatagctagctcctcaaataatgctactgatgttctgcttaagagtcttaatcaagagtttgcactaaaggatctaggtgagttgcattactttctagggattgaagtgaagaaggtaaatgatggtatagttttaacgcaagagaagtatgctaaggatgtgttaaaacgagttaatatgagtgactgtaaagcagttaatactccactgtctatctcagaaaagttgagtgcttatgaaggaacacctcttggaccagttgatagtacatggtacagaagtcttgttggtgccctgcattatttgactttgactagacctgatttatccttctcagtaaacaaagtttgtcagtatctgcatgctccaacaacagaacactgggctgctgccaagaggattctgagatatctaaaacatacagttaagcttggtttgaagattggtaaatctaattccttgcttgttagtgctttttctgatgcagattgggcaggatgtctggatgacaggcgttcaactggaggttttgccgtgtttataggacccaatcttgtatcatggagtgcacgtaaacaagctactgtgtctagatccagtacagaagcagaatataaagcactggaaaatgctactgctgagattatgtggatacaaactttgcttcatgaactggggattcaggtgcctaaaactgctaaggtatggtgtgacaatattggtgcaacttatatgatagctaaccctgtgttttatgctcgtacaaagcatattgaggtagactatcactttgttcgagaacgagttgcgcagaagctgttgcaggttgaatatatatctactaatgatcaagttgtagatggatttaccaaaactctgactgtcaaacaggtagagatgttcagaaataatctaaaccttacaggataagattgagggggagtgttagagtccggatattctttgtacatgtgataatgctccatatagctgccggatagagtttgttgtgttagttagaagagatagaacttatacctgtaatctaggttctcacaacaaactctgaaccgaagctatatacctcattgtaatcctggcgcccgttttgtggcaattatcaacacgtaatctcctcaccgtaggagttcctcgcttccacacactggtccccatccgcacgccgctcgcccctacactggtcgcccgtccacgcgccagccagccttcacaccgcccagtcactcaccgatcgatttttctggagaactcagaagtagttttgtggtaggaatactagttcatcttttctgaaagcacttcttgatcggagtacttgtggtactgtggttgtcctggtggatctttactttttttaatacgttttgagaattgtgctagactttgtagaccgtagaggagaacctgaattctgacctgtatcactagggatgaaaatggatcg

SEQ ID NO: 92510 - DNA, 753 bp, Oryza sativa
cacaggactgaggaagatataagaaccagatcagctttacaagaacaatcaccttaaaacttacaaagaacctaagtataaacatgtgatgaacaatgcgtgcaaccgtgcaagggagaaaaaccaagtatattcaacattcttcgtgtcctgaatatccggttatacagcagaagaattatacagtgctcgtgtgctagtacattttgggggtggaaacgtaccttctacctcgagcctgcttaaataattgttacaaaatgagaagtatgagaagacatcgacacaagattaccatttacacccaactcagcttttctaaggcagatcccagcagccaatttgcaaacaacaaagcaaatgggatatacagagtagagacatgcgaaagttatatgcccttcgtccaaaagaccatgcgtaaacagaagcagcagcaatacagttgtcaaggtctgccggcgatcctcttggctcctgcaatgtgccgatatttcaaagttgcatttaatgctgaataacagtaaggattcacaaaggagtacttgtgtaacaaaaagacctaagtgaatagtacgggagaaaatccattaatccatttatgctggtataaatatctctcaaataaaaaaatggaggtggtttcaaaatctcagaatctaagcccattactaacatcaaaatgttcttgagaaggacatcagaaaagataagccccttacaggctagtggttgattaattgatacagtaac

SEQ ID NO: 92511 - DNA, 695 bp, Oryza sativa
cagcaagagtacccgcaagagcatgcccatctaaactgtcatccattgagtgcacaaccggaatgcatctttctgctcctctacattctggatatcttttgtcaactcctctctttcagccaaagcagctgcaacagatgttggaaggaagtcttttccacgatatattacaatgtagtacttatttcgaagaagcaaggtgccccctgttagattgtgaaataatgttaaaaagataaggcttcactgattcagaaatcctatacaggttaaatcaaatatagtgcatgaacagttgaacacagttgattcatggaaacacacctttggaactctatgaaagttcgacaaggaatagaactaaactatatgaagctgtctccatcatgatcttggtaaagcatgattgtctatgatggtgtttagacaaataaaagcattacattaagcaagttatattcattagagcaagcagtgcagcacaattttgttattattttccgaaaccctggtgttgctttggatgattaacaaatcatggattttgtaatattcacaggacaaatatggacttcatcaaaacctactgctgagtaagtgagtactgagtattccttatagttgccccttttttatcaggatttttagttgaatttcttcatgcctcaaattcgactagatatatgggctgcagg

SEQ ID NO: 92512 - DNA, 705 bp, Oryza sativa
agacagaagcttcacacgagtttcagaagcagaaaaggttttcttttcttttttccagggagtagtggatgggtgcggaattgcagatgcagcctgaaatttgtccgttcaaaatggatgcaggaacggcggtggtatttggagtgtcgtctgctttagttttgtcctgtttcagttgagtgtgatgccatgtagtgtagctgctatggtcacgactcacaacttacaaaaacaatgctgaaaaataaattataacaaaaaagaacatcagcatcaattctaaacgagttttatagtttaatgacatattttgaatcgcaataatggaaaagcatataaaaaaacacaggattctaacagtaattcaagtgtaaaataaatgattgtagaacacataaaaaaacataagaatgtttgtctgatttaaccacatgaaaaacatataaatttgagtagacataaagactcgacggaaagctttctagagattatacctcatgttaaatttactttaaaacttgtatggaatgagatattctgtaggattccataatattcattcttctgattttaaaatccatataagaaaattcctatagaaacgaaattcttataatttttcagtgaatcgaagagggcctaaatttccgctagctgaaaaacaattagtgttgtcccgtgttgaattgagtgtgatgccatgta

SEQ ID NO: 92513 - DNA, 3271 bp, Oryza sativa
ttgagagtttgtaaacatggttaggatttttaggatcttcaaaatcgggaggttgttcaacaaagacaagttcggcaatttcaccatttaaaaaagtacttttcacatccatttgaaatagttttatgtcaaagcatgatgcaaatgcaagaaggatgagaacagcctcaagtcttgccacgggggcaaaagtttcaccaaagtccaaaccttcaacttgtgtgaaaccttgtgccaccaaccttgccttgtttctcaccaccaacccgttctcatcttgtttgttcctaaagacccactttgtccctatgacattgtggtctctaggtctttcaaccaaagtccacaccttgtttcttgcaaagttgttgagctcttcgtgcatagccttcatccattccggatcacaaagtgcttcatctacatgttttggctcaagacaagaaacaaacgagtaatgttcacaaatcgaaacgacacgagatcgagtttgaacacccttactaatgtcacccaacacttgatcaattgggtgatccttggaaagagcggtgtgtatccttggtggcataggtggatcttgtgccttctcctcctccacttcaacttgagcttgacttggcgtagcggaagtagatggctcatcttgagtggaggtggatggcttgtcttccacttcaataggcttgacatctccaatagacatgttcttcatagctctcatcaagccttcatcacctacatcatccaaattctcgtgcccctcttgggagccattagtttcatcaaattgaacaacggcggtttcttccacaatacctttgttcttgttgtagacccggtatgtctcgctatttgaggcataacctagaagaaacccttcatcacactgactattaaatttggttagtctaacacccttttggtaaatataacacttgcaaccaaaaactcgaaaataggcaacattaggcttcctcccaacgattagctcataggaagtctttttcaagagaggatgcaaataaagtatattggttgcatggcaagcggtgtttatggcttccgcccaaaaggaatcagaaacaccatattcatcaagcatagtccttgccatctcaatcaatgtacgatttttcctctccactacaccattttgttgagatgagtaggtagcggaaagttcgtgtttaataccaagatcatcacaatagtcctcgatattggtattcttaaactcggaaccattgtcacttctaattttcacaagagtgcaactaaattcatttttggccctttttgcaaactttttgaaaagctcggcaacaatagacttatcatgcaaaaagaacacccaagtatatcaacaatcacaagacaatgactattaccaccaatgctcttataggttgttgggccaaacaaatccatatgcaagagctccaatggtctagatgtggacatgatactcttagtaggatgagaacatgcaactagcttgccggcttgacaagcactacaaagcttatctttctcaaacttcacatctttcaagtccacaactagatcacgttttgaaagtttgttcaattgattcatgccaacatgggatagccttctatgccaaagccaacccaaagaagtttttgcaactaaacaagttttcaaatttgcttcactagaattgaaatcaaccaaataaagatttccatatctaaaacctttgaacacacaagacttgtcaagaaggctagaaacaataacttcttgcgggaagaaagcacatgacaagccaagatcacaaatttgagcaaccgaaagcaaattgaaatttagagatttaacaagagagacattatcaattgaaaaatcattggagatagcaattttacctaacccaattacctttcctttgctattgtctccaaatgtcactttctcttgttcattccctcctacttcaaatgtggtgaacatagccctatcaccggtcatgtgttgagtgcatccactatcaagcacccaatggctcccaccggtgtggtagttcacctacaaaagaagatcaagctcttttaggtacccaaacttgttcgggtccttggaggttagagaccaaagctttgggcacccaaatgacattctttttaccaccgagtataagggaacccacatatctagcaacaatgctaccatcatgagccttcctaagcatataatgagaattaaacatgcatatgttaggaggcttaccaccggggcaatcatttaccaaatgtccaatctcatgacacttggagcaatacttaccattgctcttgacaaaacgagtggcacggtgagaaggtttcttacccttctttggaatgaatccaagtccctccttattaaggatgcaccgttgctcactcaaaatcttgtcaagagtgttcttacccttgaagcacctctccagctcttgttgagcttagccacttgctccttaagctcattgttctcaacaacaagtgaggcatcacaaatagaaacacaggagctagagctagagctagacatatccacaagatcatcacaagaggtagaaatgctagatgatgcaacatgagcaatatagcaagtagcactatcatcaagcaaatcacaagatatgccaacatcaatgagagctccatgttgagtagtggaaaggaggttgtcatgagcttccttaagcttctcatgagaaatggtgagtctcgcatgataagtctttagctcctcatacaagacctccaaagaagcatgatccttctttagggccttgaacttgacaatctccttctcactataagcatgaagctcctcaaacatactcacaagctcatcataggaaacatcatcacaatcatcatcactctcactatcactaagagatgttaccttagaggagccctttgccatgagacaaagtggagcgaagagtgatggagcctccttgatggcaacaacggtcatcttcttggagcttgcatcatcaccatcttcttcctcggacccggatgaggcggagctctcctcatttgagtcccattccccgatgaaggcctcaatcttcttgccttccttcttaagcttcttcatgagcttgtagcctccactctttttcttggatgacttgtctccatcatcatccttggaagggcacttggaagcaaagtgtcccttctcaccacactcaaagcacctcaagttggagagagtcttgttgggtcttctatttcttctcctatta

SEQ ID NO: 92514 - DNA, 2158 bp, Oryza sativa
aacctacatccacaatactccaaatatggaacctcatagctttgaggtgagtagacattttaattttccaagtggaatagtttgtgccattaaacatgggagccttccctacatggttcacctcgttcgacatcttctctctaggcggtgaagcccaatcaagagagaccaagctctgataccacttgtaggaacgagatgtcaactagagggggggtgaataggcgatttaaaactaaatgacacctaatcaaaactaacctaagttgctaggcttggtgaggatcaactctaactaagcaactaagttatgttttgcaaacctagggtgatagtggctcaattatatctctaggaaagtaaatcactactatgtcaatgtttagcaatcctagggtgatatgatctcaagtttgtctctagaaaagtaaattgcacaaatgtaaatgcgacaatcaaatgagagaaggagacaagagatttttcaccgaggttcggaaactcgccggtttcctactccccgttgaggcgagcccaactccaacgctcaaccatgaagccaccgcacgcccccttcgtcaaggggtgggcaaggcgggagccggcccacggagaggactacccaagcctcgatcactagggtagttcttccttcactctgaaggtggtgaactccaaaccactcacaaacaggtaccgggcctcctccacaatcttctcggagagatcaccgggcaacttctccacaaaccgtctaggaggcggcaacctccaagagtaacaagcaatgacccggcgtggagatgatcaagtgccacactagctctacaatggaagcaaatgcacttgactcttggctaatcaaccctctaacacactagatggatgaacacaaagctcaagtgagtgtgagagaggtgcaaggggtgtatgcaattgaattgggtgccaagagagcccccttgctgctggtgggggagtatttatactcacccaccaaaactagccgttgggggcgaaatcccccaactttgtgctctgccggtctgaccggaggtatgtggccagtcagaccgtgctactctgcaacggctagaaaactagccgttgaaatgctgtcagagggccccatcggcctggccggtcagaccggcgtagagtgggcggtcagaccggcctcggctcggtttgaccgactacggctccgttggctctgtatcggccatcccgagcagcatcatctcagcctctagggggccggtctgaccgctcatgtgccgccggtcagactggccctatgcgacgatcagaccgccatcttgcggcctgtcagaccggccatggcacgccagtcagaccgccactatgtggccggtctgaccgtccctggtcaggccgaacccagtgaatttgcaagtgaatgtgtgtgtgatgaaaaagagagcacaaatgaaaatgcaatgacctaatgtggcaattcaatcatctctttgctaggtcattacccctcttaatagtacggcgaaactagaaaataaactagcaattttgatcgccctacacctcgatcaattctaaattaaagcactagttttaccgtcttctttctctttgctttgcgccgtcaattttaatccatcgataatcatccattcgcacatatgacatggacctaacttaaaatgtatagctcaaagacaacggttagtccacaattagcgcttgtcattaattaccaaaattaacaacgggggtctagatgcttcaggcgccctccccccgcgagcggcggcgtcagtggcgcggtgccctccccccgcaagcggcggcggcgcggcgccctccaccccgcaagcggcggcgcgctcccaccccccctcactctctccacttctccccctttctctctgtgtggcggcggcgggagggccagcgacgccctgccctccgctagatcggggggaggggaggtgcggcggcgggtcggacggcgtggaggcggccggctggacctcgcgtccgccagatccggcggcgctgcggccaggacggcgtggaggcggcgggctgggcctcgcctcctctagatctggcggcatggaggcggctgtggcccggcggggcgggaggggcggcggcccggacggtgtggaggcgg

SEQ ID NO: 92515 - DNA, 2539 bp, Oryza sativa
cttgaagctccggcgagaaacgtgagcacacgctcccccatcgacggtggcaatggtggccccaggctcttggaaacctaggtcatcatcgccgtcatcgatgtcctcgtcgggggccttctgcttggcctcacttcgccgattaccggaaggaaccgccggggatttgccctctcggcgctcctgcctcctctcctcctcccacttcctcgtccgctcagccaaacttttgactgcacggcagtccgcaaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtttggggctccttggaggcgatcttttcaagcatgcggttgtgccgcacaccccccctgaacgcgtaaatcaccgcgtgcgcagggatgcatggtatggtgttgcggacttgacagaccgctgaatgtacagcgaagtgactcatcatcccttcgctgtactgcgtgcaagtccgcttcctcacctgggcgcggatatgtgccttgaaagttcatggtgaactgttggcacaaatcctcccaagagtggacaaacgcgggtggcaagttcattagccaaccccgcgcttgtcctttcagggccatgggaaagaaattcgccatgaccctgtcgtcaccccgggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaactgggggcacggagggctgatccccgcgtccgtggtgaggtgacactccggacgaggaggcgccctccgttgcgtggggagcacgtcggccattacgccggcgctcgatactgatgcgagcatccggttccccacgcagatctttccgggtcggaggcgttgacgaaagagtggcggccgaatggcgaacagcggctgccgctcgccgcgccctccgtcttgacgatgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggtgtcgaagtcacggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagccccctacctggcgcgccagatgacggagcgtggggctcctcaccgggagaccgcgcaggcccccctttgccggttcggccgggggccctgggtgaggttctaagctcttggtctgtggaaagttcgcgagagtgaaatcacacaagacacgggcgatgtatacaggttcgggccgctgagaagcgtaataccctactcctgtgttttgggagatctgtgtatgaaggagctacaaagtatcagccagcctctcccttgttttgggtttctaatctggaaaagtccaatcccccctctcagtgggcaaggtcctccttttatatcttaaggggataccacatgcaccatttctctctttttttgtggggacttacccccccttttcataaatggacggagatttgtatagttgccgtccgagtcaccttctgatgagacggcccacaactacctccactttcgccgggagcaggtgcgacgtggaatcgtggctgtctgctgacgacatgaccagtatcagactagtcacgtcggtcattcttgtccaccacgtgtcagcttagcaatctacatgctcgcccttcttcacacaacatcttgcctataatggtttaggatgaagcctggcatatatctgaccaggactaacgtgccatctctgggaggtaacacgctagctccagctggggacgagcgcctagaagccctcgtcctgacgggatggggcgaggcgtgcatcagatcgcctgtcgccacctaacccacgatct

SEQ ID NO: 92516 - DNA, 721 bp, Oryza sativa
tatgaaaggaaaagaacatatgggatgtcatctaaagaaatcgatttatggactaaagcaagcatcaaggcagtggtatctaaagtttgaccaaatcataagacaatttggttttaaagaaaataaaaaggatgactgtatatacactaagtttaaggagagtaagttcatcttcctaatattatatgtcgatgacatactcttagccagtaatgataaaaatatgctactggaaacaaagaaatttctggcctctaagtttgaaatgaaagatctcggtgaagccaattatgtgttgggtatagagatttaccgaggcagatcaaatggtgttttggggctatctcagaaagcatatatagaaaaggtactgaaaaagtataatatgcataattgttcagcctcgcctgctcctataatgaagggtgataagtatggaaaattccaatgtcctaagaatgagtatgaagctgcgcagatgaagtcaatatcatatgcttcagctgtcggaagcataatgtatgcacaagtgtgcactcgccctgatttagcttttgttaccgggatgcttggcagatatcaatctaatccaggtctagaacactggcaattagctaagaagaccttgcgttatcttcaaggcactaaagacctcatgctcacatatagaaagtctgaaaaccttgaagttgttggttattcggactccgatcttgcaggg

SEQ ID NO: 92517 - DNA, 1808 bp, Oryza sativa
gctgttcttggggttcttgttactaagagtggagctgctgattttcaagaacaaccagcttgcgttcctttctcctgtggacatcttgaaggtatcaggtaccctttccgtttacaaggtgatccacttggctgtggtgatgaagcttatgagctagtctgtagagatggcagagctatattcacatcaacacaggaaaatattttgtgaaagacatctcctataacgagtctagattttgggttgtgatgctaatttagacaacagcagttgccctcttccactgtggaataatcttccctacttcaatgacatgggcactaagctgtacacttctgcagttcggtgggctacatttctaaattgctcacgggcgataaacaatggcatgtacatgcctgttgcttgcttgagtgggaatacttcttttgtttatgtcttgactacatcgagctcttactatgttcaaaacatcgagccttcttgtggatacttggctgtgattcctgtggatgatcgtacaaagaatgtaccagactatgcaagctatgcagatgttgtgaaattcatgaggaatggttttcctgtttcgtttcctcgagttgaatccccaagtcattctccagtcatcaaagcctgtgcgagagatacattccagtgagttttagctctgtatctttctcttgcttgtttgatcatcttataaaaaatatatatatcctcttttgcaattctgcagaaactttaaggagcaaatgtatagtaggaacattcaaaactggacttctgccattattgggaccgagctacaatttttaggatgtgtaattaattattactctagtgccacgcaagtttgggttactctcgttctggtatttgccgtagagattgttaagtgcattataggtactccagatatgccttaatctaaactattataattacacccaatttatccatagattcttattcacttcatgttgcagtactatgcaggttcatcttggcgccgttgactgttttgaccttcctcggttacaaataccccggaacaaggatatctatcgacgcagtagagaagtttctccgaatgcagcaagctcatggtccaaagaggtatgcgtacacagaaatcactgcaatcacaggccatttcagggagaagctaggccaggggggctatggttctgtgtacaaaggtttccttcctggcgatggtcatgttgctatcaagatgctgagcaactccatgtgcaatggagaagaattcatcagcgaggtttccaccattagcaggatacaccatgtgaatgtggtgcgccttgttggattttgctcggaggaacttaggagggctcttgtatatgagtacatgccctgtggatctctagacaagtacattttctcacccgagaagagtctatcttgggacaagctcaatgagattgctctaggaattgctagagggatcgactacttgcatcatggttgtgatatgcagatcatgcactttgacatcaagccacacaacatccttctggatagcaacttcactccaaaagtcgccgactttgggctggccaagctatacccaagggacgacagcttggtgccggtgagtgctgcacggggaacgatagggtacatcgctcctgagatgatatctcgaagctttggcaccatttcatgcaaggctgatgtttacagctttgggatgttattgctggacattgctggtggtaggaggaacagggagcagcatacatccaactcagcccatctttattcccaagctttggtgtatg

SEQ ID NO: 92518 - DNA, 3875 bp, Oryza sativa
cttggatcaaagtggtcagggaatgagagaatttatggcagaggttcagacaatcggcagcattcaccatatcaatctagtgaggctgattggcttctgtgcagagaaatcacaaaggcttttggtttatgagcatatgcccaaaggatccttggacaggtggctctatcaccagcaaggttctcctgctcctgctctagattggtggacacgatacaagattattactcaagtagccaagggtctctcttatcttcatgaggagtgcatgatgagaattgctcacttagatgtaaaaccacaaaatatcctcctagacgacaacttcaatgctaaactttctgattttggtctatgcaagcttattgatcgagataagagtcaagtgattaccagaatgagaggcacacctggatatttagctccagaatggctgacatcgcagatcacagaaaaggcagatgtctatagctttggcatagtagtcatggaaatgatcagtgggagaaagaaccttgacacttccaggtctgaacagagtatccatctaattaccttactgcaagaaaaggtgaagggtgatcagttggcagatttgattgacaagcacagcaatgatatgcaagtacaccggcaagaaataattgagatgatgaaactcgcaatgtggtgtttgcagattgattgcaaaagaaggcctcaaatgtctgaggttgtcaaagttttggaaggcaccacaagtattgagactgacatagaccatgacttcgtcgcaacaaatccagtaagctttggtgttgctggaattgtggactccgacccccctgtagcatctaatttatcaggccccaggtgaatgaggtgattgtagtggcatgatatcttgcaatgatttaaattgttggatactgcagaacatattcgatcgacaatagatgagaactccaaagttcattttgttatgctttcctttttagcacgaaactgatcctggttgttatagatgaaccccataccatgctttaatttggtcgtagctcttctagagaaggacaacacgcattggaaacaaattgggaatttgggagactgattcatgcaaattgcatatttctatgcagattttcctactatgacttattagtaaccaggtggcttttagttcctctacaaaggtgattttcagatgcattaaattttcagtattttcctctggcatatagataatagtgatgtaaatatggttcctaagttgagaggtaacaaaattacagccttcaagaaaacccctgaaccaaacggaccctaaaactccacaaaatcaggtcaatgccgcgatggattgaatagtgatggtagcgtgaaaaacaaaatcaagcaggtaatattcagattcaagcagaactagtatgcagttgtggtaatatagagaggcacagtattatttagatgaagaaatcttactctacactagcggtcagaatacacttcgctttgaacaagccaactccacggcagcagatctcgaatagtgatagctcccggaggtgaccctcatcggagcaatccgatttgagatgtggcgtacctgcactcacgcagtggcgcatgggaacagtttcaccgccactctataagatcttcttcggcgggtcgattcagaccatttttccgccgccgccgccacctgcggccggatcaacggcggaggttgccatggtggacgacggagtggagagcgaagaagaggaagaggacgctcccgtacgcgtctcggcccacacgtaatccggcgcggctgcgtccataccggcccagaattagacctctcagttgggctttactgattcggcccacaagcttaggcacactgcatttgaggtgggctattactgtgggccttcattaagcgacgctactccactatcacaacgtacttataactgtcaaaaacacggcgatgagttagacgacgaaacctccaaaaaaaaatagtcagacgacgaaactgttcatcatgtcatagtacgagaaaagctgcctgctttggatgcgaaaaacgataccatttctacaaatttctgcacgcatgcataaaaacatcaaaaggcgacatcgcaagtcatcaacatactgaccacgctgtttgtctggctgatcgattagtcaaaacctaaccagcgcttgttctcatagtaagaatttttatttttttgttttttttttttttgcggggaagaatttttgtttgtttgacactggaactaactgatagtcagatttgcaccattgacaaattggattacagctcccagcgataatcggctgtcctaatcgtcacattttcagcaaaaacagctccatatcttgtaccatcgcccaattttcatacacagtaaatatgaaacggtgacatccccatcacaaatttaggacaaatcaaagatttttcagtcaaaagatgacccagttagtcaaggaaggcagctgcctcctgcccccatgcacacttacaacctccagacaaactccagaatgcagactctcaggttgcagtgatccgaatgccacgacaaagcagagagcaaaaaatttaagtactagcactttcagccataattcagtactactttctcatggtagaaaataattttttgtgataggaaacttaaatcgtataccacaagatcacgttttcttgctcatgctttatactctgttattccctagaacaagataacctccaaatttcaacaatgccaagagcacatatccctcagcgtttgtcaacttactgaccacctttcctatttggcatcaaagcacatgcacaagcttcactcatcctcctctgagatttcagttagttcagaggagaaacggcaagaatccactagcagtggcaggggttcatcatcgcagaagaatggccttgaaggcagctgcagaccaccaacatcaccttcaagcatttctatgacctcactcatcgttggacgatcatgagacttcatttgaatgcaatgtagaccaacaacacacaacttcttttccagctcatgcatattgaaggcattggcaatctcacccatcttttgttgaaccagctgattatacacccaagatggataatatgactggcttgagctcgacatgttctgcttagaattccttcgccctccagccatctccaacagaagcattccaaagctataaacatcagatttgctagatatgataccaaagctccgagatatcatctcaggagcaatataacctactgttcctcgtgcagcgctaactggcataaaactgttatcccgtgggtacagtttggcaaggccaaaatcggcaacttttgggacaaaattgctatcaagaaggatgttgtgcggcttgatatcaaaatgtagaatctgcatatcacacccctgatgtaagtagtttattcctctagcaatgcccaatgcgatctcattgagcttgtcccaagagagactcttgtcaggagagaagatgaacctgtcaagagatccatggggcatgtactcatacacaagtgcactcctcatttcctctgcacaataccccactagacgtactacattgacatgatggatactgccaatggtggatacctcgctgatgaattcttctccattacaattgtagttggatagcattttgatggcaacatggacatcaccaggcagtatcactcccttgaacacggagccatagccaccctggcccaacttgtctctaaaatggcttgtcattgcaatgatgtctgtgtaggcgtaccttgttggaccaagcatcagctgcatttgtaaaaacttctcaactgcgtcgatttttattctagttttcca

SEQ ID NO: 92519 - DNA, 1428 bp, Oryza sativa
gaggtctccaccattggtagtatccatcatgttaatgttgtgtcgttggtgggcttttgtgccgaggaaacaaggagagcacttgtgtacgagtacatgcccaatggatctctggagaagtacatcttctcgcctgagaagagtttctcttgggaaaagctcaatgagattgcactgggaattgctagaggaataaactatttgcaccgagggtgtgagatgcaaattctacattttgatatcaagccgcacaacatccttcttgacagcaagttcattccaaaagttgctgattttggccttgccaaactgtacccacaggataatagttttgtgcctgttagtgctgcacgaggaacaataggttatattgctcctgagatgatatcttggagctttggtgtcatatctagcaaatctgacgtgtatagctttggaatgcttctgttggagatggttggagggcgaaggaactctaagcaggatatgtcgagctcaagccaagcgtattatccatcatgggtgtataatcagctggctcaacaagagttgggtgaggtggttactagtgcctttaatatgcatgagctggaaaagaagttgtgtattgttgggctgcattgcattcagatgaattcctatgatcggccgacgatgagtgaggtcatagagatgcttgaaggtgatgttgatggtctgcgattgccttctaggccattcttctgcgatgatgaacctatgccacatctggtggatgttggatttgatagaatcgatttggcacaaagtggaactataaattaaaatgggattggatcataccttgatctcctggagttcccattctctctgtctttgttcttctttcttctcttctagtttggaagcacgaagagaatcgtgtcttgattcttccctgtgtttcagtgggttgtttgatcgggtagcgagagaaatctcttagggtttaacacttaggtattgatctctatttatagccactgcacacagggggaaccgacactagggtatggcggttatcccccgatcagggatgttcatgagagatcgatcactatagcgatcgccctaaacaaaatatctctttgccgactttaggtttagccgcaagatcatattttgcgttcacactaacattctcccccttgatcgtgaggctaaacttataagtccatctttcaataaaatagtataccaagacaaaagattatagtgaccaatataaagcatcaaagaatccagtgactatagcataccattatattttaaaataaacttctttaatcttacgagctctttgaacttattacattaggcttatacaaacttatggactcacttttcaacaaaacagtacatcaagacactagattacagtagccaattaagtactactgaaccaagtga

SEQ ID NO: 92520 - DNA, 560 bp, Oryza sativa
aggtatactttctctgaagtaaagaagatagcaagatgcttcaaggaaaaagtaggccaaggtggatttggaactgtatacaaaggaaagctaccaaatggagtgcctgtggcagtcaagatgctagagaaccctacaggggatggagaagagttcattaatgaagttgcaaccattggaacgatccaccatacaaacattgtccgtctcctaggtttctgctctgaaggaacaagacgtgctcttgtttatgaattgatgcctaacgagtcattggagaaatatatattcttgcgtgatcctaatactcaagagctcctgtcaccagacaagatgctagatattgctttaggcattgcccgaggaatggagtacctgcatcaaggatgcaaccagcgcatcctccactttgatatcaagcctcataatatcttgctggactataacttcagtccaaagatttcggactttggtcttgcaaagctgtgcccaagggaccaaagcattattaccttgagcacagcaagaggcacaatgggatacattgcaccggagctata

SEQ ID NO: 92521 - DNA, 820 bp, Oryza sativa
gcaattcgctgcaggtagagaaaaggaatcaaggggggagccagggagtacacaatacatatacgagtataagacatatctaatggatcccaaatcaactcaccttatcgaatccattaggcactcgttgatactcccggccccatatatgcgcggaaatctaatggcgaatccttccctcatgaactttttgacatcttcatagctcgcattcctaggcactgtcgtgctccaatcacccagaagagtcatggccaggtatccacaagaaggctccaggctttcgatgtaaccagggttgtctgaatcacttgataataacacatagataaaagaatagttggagcttgcgcaagtgacaggcctgtatataccattgtccttcacctcccgtgagcatctaacaaagtaagcatgattatatgcaccaggagccaactcgatctcaatcctgtggcctgagactttgcgcttgtactgatcaagaagatgattccactgcggaagagggcaagtgctaccggctatgttggcgtcgacgacccaaaagcgtctgtagtcgtagttgatttcattcacatggtatgttgcattgtcaatgagaattgtagcattggtatcactgcagaccagctcgtaagatttgctgccgcacccaggtggatcagctgcccgacggaatggagccgatacacccttaagatggccgcaagagaaaagaaggacactgtgatgccttccttcaacatgatccagtacaagactcacaaccacaaataagataccactagctaaagcttgagtattctatagtgtcacc

SEQ ID NO: 92522 - DNA, 3318 bp, Oryza sativa
gcatcctaatagcatttggcatggggattgtcaagtgcatagctggtatgccagagtttatagaaccacatatacaggaatatccaatgagagtgttatatagtccgaaccattacatccatccctaaaagagtgtctttttagcaaaccacccttttagggatggatgtagtagctcctttttcctaattaattgtttcagcctctctcggttactacttactccagtacgttgtatgtattatgcagtgctatgcaggttcgtgttggtgccgctagcgatattgaccttccttgcccacaagtattggaaaacaaggttagcaattgatgcagttgagaagttcctacagatgcagcaggttctgggtccgacgaggtacgcgtacacagatctcactgcagttacaagccatttcagagataagctagggcaaggaggctatggatctgtatataaaggtgtgctactctccggggatgtccatgttgccgtgaagatgttgaatggcgcctccacctacgatggggaagagttcatcagtgaggtatctacaattggtaggatccaccatgttaacgttgtgcgtctagtggggttctgctccgaagaattgagaagggcccttgtttacgaatacatgcctcaaggatctctagataagtacatcttttcatccgaaaaaagtttctcgtgggaccaggttaatgagattgctataggcattggtagggggatcaaccacctgcaccaagggtgtcatatgcagattttgcacgttgacattaagccgcacaacatccttcttgatgataactttgttccaaaggtcgcagattttggcctcgctaaattgtacccgaggaacaaaagttttgtatcagacagggcattacgaggaacagtgggttatatagctccagagatggtgtcgcgaagctttggcgtcatatctagcaagtgtgatgtttatagctttggaatgctgctacttgagatggctggaggaagaagaaacgctgatccaaatacaaatccaaatgcaagtcagtcatactacccatcatgggtgtatgggcagctaacaggtgaacaagttggtgagacatcaggtgctgctgacatgcatgagctgcagaagaagctgtgccttgttggattatggtgtattcagatgaaatcacacgatcggccgacaatgagcgagaccatagagatgctcgaaggggatgtcaatgcgctgcaagtgcctcctaggccattcttttgtgatggggattttatgcctaatgtgatggattcataccttcattcctcagagctgactgccatctcggaggacgatggcgcaattgaattcgctagtaactaggttataatcgaagtgttcatttgctattttgctgtgtggtgatcctgggatgtctttgtctgtttttctgagaacggtgcttggggctgtgtaggaaatctgtaggtctatgaggaaacattgcttggtcctatcctgcacgtgttttgtgcctgtaagacttacggtgcctagctcttgtgaagggtgggatggcacctgacacaatctagatagctggtcaaagtaaaaaagaagaagaagaaaagtgaggccaagaactgagattagctctgctttgttttttttttctctttcttgtctgtaaggtttacatttctattaatggaaataggtgcaagaaagctagatagctgttactatatcagaacattgatcttatatagttttttttaagacctatgttaagctttattaataccacacaataattgtatggtctatatcttcctttgcaacaaactctctcaatacctaaatttagcacctaaagtaaaaataggaaaatacagtcaattttggaaagaatctgggcatgctacgcgaggccggtttgactggtgccatagggtcagtcagaccgcaggggggcggtctgaccggaggtatctagccgctcagatcggtagagttcgactccgagtccgattctcgggttttcttgccaaggcctgagattttagtattaattggtttttacacctaaatgaacgtggaaaaaaccctaggaagtaagtccatccctcctgtaaaatgtaggaggccattgtcgattgaaaaaataatcgatcaatcatcaaaatcaatctattatacgaactctctatattctacatcttctaccttcttgttatctgtcccaactactattctcatacaatcccctaatcgctcaatgtctattgtctctacggctttagaggatgttctagctagcctaccgagcctaggataagccagcatgcattcatcttgatgggggtccctcctgggtgttcgtttggtggtatgtaccaaacggggtgttctattgtccctacggcggtacattttctgggtgctgctgcgagttgcacataatgtgctcaatgtatgaagtcacgattcggtgtcaacattctctacacaatttggtttgccttaggaagattaatagcccacctcaacagcaaaggaagcccaccaggacatagctccagattcttcttaggccttattcggtttggaaaagattgaagatgatttgagggaattaagggggaacaatttcacaccatgatagacgtggatttaaatcatatttggggagcttaagattatgaaaacctgctggttggtaaccagtttttacaactacaaattttcaaaatttggatgacaatctgaaccattggaggagctaaattctgtgagaagctcccaaacaggtcccctccaggaaatgctactgggcgagcgatcgccctcgctcgctcagggcgatcggttcccacccccctccctccacctggtttccctttttggcaacgcattacttttctattttagtaaatttatgcacctaaagtttatacacctcaagtttacacatctaaagtttagagaccaaaagtttatatatctgattcaaatttgaatttgaattcaaatatttttttatatatagtatttctatacatttaaagtttatacacctaaagtttatagacctaaagtttatagatctaaagtttatatattcgattcaaatttaaatttgaattcaaatatcatattcaaatttgaatttgaattcaaatatttttcatatatagtatttctatacatctaaagtttatacacctaaagtttatagatctaaagtttattagtcaaaagtttacatacccgattcaatttgaatttgaattatatccgattcaaatttgaatttgaattcaaatat

SEQ ID NO: 92523 - DNA, 822 bp, Oryza sativa
tcccaccgaatacctataagtttaagccaaaacccacataatattagatgaagtccaagaatgcattttagataatttctggtatcaatacaataataagagggaagaaaaaggctatatgctatcaatattaaacagtcttgctgaatatttccatctaatgaatgatataatgccaacatcagaaaataatgaagtaatacagcaaaaacccatatatgttgtttttgacggaaagcttcctggagtgtacatatcttttgaagagatagtagcccaaaaaatagatgcaaaattaatgggtggattgtcatggaaaaaatatatagattttgatgaagctttaactcaggccagaaaaatattaggaataaactactacttggaaccagcagcaaaagaatatatacaaaaatgcaaaaaagccaaaaataagaaagctccagagaacccatattgttcaaatattaagaatgaaggatcatcccaaaaacctacgtataaggaatgcttgactaagggagtagatcctttggatggcgaatatatcgattggaaaataattgaaaaatttgaagaagcatcccccaaattaaaaaagaattgaaagaagaaatacttaaagaattaaagaaagaaatgaatgataaatttgaagaaatgaaaaaagcatatgatgaaaaatttgaagtctccttttctgatgtagatactatggatttaggtggtcatgggcagcctgaccaataaagcaatataatataaattgataataaatatccattctttgggcgtgggaagactatatttgcgaatgaccaa

SEQ ID NO: 92524 - DNA, 623 bp, Oryza sativa
tatgggaaaatgaacagcaaatccattcctcatggatctgacgatgtctgaaaagcttgcattatgtggcaatggcgagtcccaaccacccaagggaatcatggcaaggtagcgacatgaagtctcaaggtttccgatgattggaaaaacagatggaggcattatccaggaaccaaacacataaacaaacgaagagcttgtgctcaggcaatcaacaggaacgtacacactattattccttactgcctgtgaacaattcacaaagctaacccatgtagctccaggtccagggtcaagggccaggtcccagccgccatgtgatccctggataccccccgaaacgaaaggaagctgatccgagcgaggaagagggcagctgctgtttgtatcttttaggctggcatccacaacccagaagacagaagtagtgtagttgatgctggttacatagtatgtccctgtgttgatcctaatggtagccttgctatctctgcagtctaactcatatgacggaacaccgcatctttgtggatcacctcgccggcggaaaggatgagaaatgttctggagatgtccacaggagaaaggatagcacccttggcgcccctcgacatctcctgcaa

SEQ ID NO: 92525 - DNA, 515 bp, Oryza sativa
aaaaggaaggtagcaagaaagctcactagcaccagttgcactgtggcttgtagctgttgatgctaggggaactgaaaaaacaggttctgcaatcttgacttgtccagccaatatgtgcactgttccttgtcccaaatgcgcctcttagaacagtggaagaaagagcattttttcttcctaaaagacacaaaaataataataattatagatgatcttgaaggtaaagtctggtatgacagctgatgtattggagctgccaagtacccaacacatactaggatactggctagtaccgcagtcaatgtttcaaaatattgagataataattggcagagtcgaatttaactaaaacaaaatttctaaattgaaataccagttttgtaacaaactagtcaagagaactacaaccctaaaggtacttggcaggtttgctcctaatccgagtctcattatttcagtagcttaaatgacttactgtcttcaaaatgttgaaaagcaaccctagcagcattcat

SEQ ID NO: 92526 - DNA, 525 bp, Oryza sativa
aatatttggtgttaaagacagcaactaagtgataaccaatgtttcatgcaggatgaccccaagtatggttgcttgcggcgctgtaaggcaatttctatccttgagaaacttcatgcaaaggggtaagcaggccttttgaattttctattagcctctggatttcactgttcatgttttatttttggaacattttaccaggttcgttcatggagatgttaaaccagaaaattttctacttggccaacctggatcacctgatgagaagaaactttttttgattgatcttggcttaggtatgcaatggaaaccttatgtgattgatactggttgcaaaaattgagcacataacccatctcaataagatttaacattccctaatcagaattgcggatgttcttttgtaatgctgtttgtacctaatatcattgtaaaatgtgagttcacaagtgctcatgctaccatttacaatttcagcatctaaatggaaggaaacgccaaatggacagcatgttgattatgatcaaa

SEQ ID NO: 92527 - DNA, 665 bp, Oryza sativa
tcatctggggggtttgcatgtttacacccaaacatgagttcgcactaatattctcttctaacatccagctatcaatttcctatcactatcaataccaatacagctacactccttccatgtatgaataattatacattcttgctcactggtcctaaaactaaaaaattaaaacgctggatatgagaggaggggctctcatatcagatattattaagaatgaggctcgaaattaaaggaagatgcctgagccttcctcaactatcatgttttgttactacaaaattatagaactacaaaaatgcttccgtttgcaaaattggggcaatgtaactgcaatggttcacaaataagggcagcagaacttttttagtcaaagctttgttagtaacagcaaactgaattatgcaaagaaaataccttccaagacatcgaataacttccggagaggaattaaacctttcattctgtggagcctccagaaataggttgacaacaatcggcacaagcttttctatgaacataataccccagccacagcccactgcattatccatttttgtgctgctgttattgagatgactccgttcaactgtaaccataataaaatcacagagagtaaatcaagaagatattgtatttcattatattatgaaaagttggatatc

SEQ ID NO: 92528 - DNA, 2311 bp, Oryza sativa
accctatgggtataatgacatcagaatcgaaggcaaaggcaatgtatattaagatttcctcactcagatattcatggagcgaacatacttcaaaattggattatcttttgtctatcttccttgcccataagtattttccagcacaggaatgggaggcccataaattctataacaacgatcactaagtgagctcactaaccgggaaacaacttccttgaagaacatggaagcaacctgaaatgaaaagcttcagactaaggactgataaatcacagttaaatgaatgcgcttcatgtgcacgatcgtaacggatgattttacctgacgatatagtggcgactgaaacttaaaatcaaccaagaagtaaaggtcacatgttccaggaacaggaccaggcttgaactcccaaacatttatcaaatgatcaaaaagtccactttcagatgctgtcgtctgcaatcgagtaaataccagtcagaagtaaaacaacgcatctgttctaacatggaaaaaaagggtaaaagtaggaagtgaatggtcacagtgaattatacgccatttccccacttgttcggtacaaataaaacaaaaatatgcaacagaagttttactcagaaggggcaacagattttaaagatttatggcacttataaatagttgcaacataagtacatttctcacgaaataatgaacacaatcttcaagcaatcatctaaatactaaagttagcacggcgtctgttcaacaactatcttagttaaataaaatagagcatcccagttaaatagaagaagtttatatcaagatctgcagtgatattcaatcattagaacctggagcatgagttagcacagcatctgttcaacagttatcttagccaaaacagggtgcattttatcatgagcagcaaatccaagttgctccaaagaactgagattgagaactggttaacagaaatcatctgtgcatacacacacacacacacacacacaaactcccacctatgcatcaaatcttctattcaagaaaaagttatcgtaacaaatctaacttgactactcccaagtcaaagtgttagaaagtttccaggtttcatgcagcaataatcgcatcagccttcctacatcacaagaaaattttgttgcatgccttattaaaaagggataggtgaagctactccatcagtcagcagcatgatgacggttttacagtatatataatttgatgtatggtttaaggatgatctcagaaaaaaactactttgccaatttgccattgacaactgcagttcatgttagcgctaaaaccaaaaccaatattcattcagaaagcaggcaaaataaatagaaacattacttttgtccgggttgatacagccaaatgatgtactatatcttctcgaattaactaatgcaactgttacttcgtatttcagatattctaagttatagccaacattgcaagcaattcaatgtgttcactactagtcggcacaagtaacatcatatctgactgtttcaagaaatttggcccacatagccgcattgaagaaagaaaaatgaaaggcacgtcctcgacgacagaatttttacatgtttggatagactacaagtaatcctagaagaagtaaacctttagcagatagttgtgaagcaatgtgctaaggaattacaacacaaaagaaaaacgcatgactaaggtgacccatgtgacaaaacttaactaatgcggcttcaacaattaatttgtcgctttcagaaccatttagttattctagatatgcttgtgttccatggtatgttatgtactaaccaataaagtatggtgatagtaccatgatgaagttctcaccttgatatattttggcttctccatctccacatgagaaacataactctcgacaaggaacttgaatccaatttcgagttcagcatcaaacgagccattctcgtgtcgcctgataatcctagacctctgacaccacggcacaaaatcctcatagaggtctactgccgcgacaacagcgaacatctgctccggcgagtacctgcacccaccaacgcaccaacaatcagcaccaataatttccgtttccaaacaatcagagaaggtaaaattatgagctgcaaaacaatcggtccaatccaccgtaccccatgacgcgcctctcctcgtagaccttggagagcacgctcccctcatccccgtcgccgcatccaaggaaggacctcgtctgcgtgcccgcgcgccacaccccgcccgccctctccgcctccccgcgcgggggacccgtcggatcggcccaccgccc

SEQ ID NO: 92529 - DNA, 632 bp, Oryza sativa
  unsure (1)..(632): unsure at all n locations
agaagctacaaagagctggagagcaagagagctcttactctagaaaccctcttctcccttttttcctctcgtgggatctactctccagttcctctctcctttcttcttttggtccatcgttcttttttccgtccccccttgctaagtgggagaggtcctcctttatatctcaaggggataccacaggcaccatctctcttttttgtgtggggactaatcctctcttttctcaaacttgacttgccttctcttcataaatggacggagatttgtaatggttgccgtccgaatgaccttctgatgggagggcccatacctacctccacttccgccggaagcaggtgcgacgtgggaacatggctgtctgccgacgacatgaccagtgtcagaccggtcacaaatcggtcattcttgtccaccacgtgtcagtttaccaatctgcatgttggcctgtggtggagggggggctagcttgtaatggttgggataagctggcatatatctgacggggtccaanntgccacctccagaacctaacacgccggttccggctagggacaagtgcttgaaggctcttatcctgacgggatggggcaaggcgtggttaaaaccacctgccgccacctaaccca

SEQ ID NO: 92530 - DNA, 3258 bp, Oryza sativa
tcactactcaggatggcattaatctaagaaaaaatgtccatggtgtcgagtaagttaatctgctactctgcttatatgtatgttgctttccggagcgtactttaaagtcatgcatggttcttgtatatagcagctaattcacgtgcatcccaagaaaaacgaagatttaaatacagcatttgcccatgcaaacatgtcttgggccttattcactagtcttataacttctcttttttttcctccatcgcacactgttatgtttgtacacctctagacaagttcttgtgaatcatggatcatacatagggtcttaagacttatatactgatagcttcttttaatttgaaatcatgcataccaagttactgactattgtgtttctaagggacttctctattacaaggatgaaaggaggttatcgtcgggtgatccagcgacctattgattttgaatggtaagtgcaaccaagtgtttcatgccatgctgttcacctttttaggttccaatttatttgttgtacagtaaagtaaattttagacaaataaattccatgcacctctgtgtacggttgttggatatctgctgatattcatttaatttgttgttttatgtagggatctcatcacttatacagatgagaaaatacctttagtagaaacggatttagatgttttgtctaaaacgaagccattagaagtaaatgaactactatcagatgggatttccagctgtacatcacatgattctgggctggaagcttcattggatgcctctgaatcaataaatggagctagcctagtagtagcagaagccaaatctattggcagctcggatatgttggagaaactggccataaaattagcatttactctaccagcatcatcttatgctacaatggctattagggagttgatgaagacttcaacttcggtatttctccaattctctgatcatttctttgatttttccaaactaaaacttagttatgagcaaatttcatctgttttctgtgtcgttaatatatttttatctttttggctgcacacaggttgctcatcagaaaacattaaacatctgaaccttcggccatttgcattatttatgaaactaatctctgatctaaaggacatggatgtttagcatgcatgttatgttacgtgagtaaatattctctcattttactgattagtttttgtctagtccttaatcgtaatgctattttttggggggagttagtaatccgctgtttctttgtgcttgcaatgtcactcttgtactgcaatgggagaaaaatctaagtctgatccttcaaaaaagaaagagagagaaggaaaggccactgaagcgtcgtgactcgtaaacatgcttagctcatctggtgtgtaacaccagaattacatattaccgatttgtccatgtaaccgctcgtgcatattactacagtcacgtactgggaattgcctgtagtgaactagtgatatgtactaatgtttggttatcaactactccgctttatcgcagtttgacatgcataaggtttgtcaacttcaattatactggcagcctgttagctgtagccacaattttaacaagattcttttttaataaactaggttccacacaccattgtgtaaaaaaattgtaataaaatttccttacgctgcgtttttttctcccattttccaactcactctctcgttttcccacgcacgtttttcaaactgctaaacagtgcattttttacaaaagttttttatatgaaagttgctttaaaaaaaccatattaatccatttcaagttttttagctaatacttaattaatctaaactataatcgcgtgctttgttttccgtgtcaggtgcctccctaacacagccttaagcttgctaagatgtgaccaagaattcgttcgtctcaacttatgtgcaatatttgttggcaaatgatgataaagtataactagaaatcaaacacaacctaaatctaatctaaccttttatgttcttttttttttcgaaatttatgtaggcaagatatctgttgtatctaactctaactctagaacggagagaacgaagcggcctagaggtgtggtgatgagcgggttgttcattttgttcgattttctctcttgtccattgaatattgccactttcccctattttttctctcttctcaagtacaaatcatgattttacagaaaatatacagctgcggctttaaatttagatttgaactattcatgctcgttacaccttatacaggctgattgctctagagcggttatcaccgggattccaataccagagagcaaggataatagtatagttcatttcctactattagctcatcttaaaaccaatatatataatagattagctataagattggctacaattttcttctcctctctctatctatcacttacacatttaatgtatttatcttggatattgtgctaagttagctcttgtataagagccaaccttttgatttttttgttacctctcctccacgtaagtttacagtaggcttatagttcactattatacttgctctgattagaatcgagctcctgcatttttgtttcgaaccgcgagccagcacgtactaactgtgccacaacgctaaacgtatcgacccgtcctctccgcttttctagctattacctgttccttgcctcaaagcgattcaacccggagggggaaaaatgggttagtttgatccatagttatttagataaatatcattataattcgtgtattcatagatgtgattaaaattttacgaaattgaaaccgtgatgatgattttgcttaaaatgtttctctgaatcaaatactataatatcgtgcaagctctccgcttaagtctgaatgtatcttgtcatcttgtggaaagcgggttcagataacaacgaatgatcatgtcccctataccttaaaaagaaaaaataatcaaggttgaagggctagtttaatattggaaccttttagaccttgttcgattaattccttcgataaaatgattaggagaaatttagagaggatatattccacatgtattatgatataaaattattcttcctcaaatcttttcattttttttattaaacgaacaggccttaggttgctttttttttataagaaagtttttgtttggcctatcacggagggtcggaggccctcgcgcctcgttgatgcggcgcgtcacgcgtgctctggaagctggtgcctctctactgatagggtgtttggg

SEQ ID NO: 92531 - DNA, 1245 bp, Oryza sativa
tgtcttgcttctgatgaggttgtttgaaatagaagaataatgattagtgaagccttcttctgacactattgagttaaagctaccattatggcattgtcatctgcaaagttgtggctatgcgcacctcaattataattttttgtgttgttttgtaggtagtgtattgagtggtggtggaagtgtccctgctccccaggctactcctgcagtttgggtgaacatggtaaatgaattccagaaaggcgccttgtcaacacgtctaggaatacctatgatctacggcattgatgcagttcatggtaataacaatgtctacaatgccaccctatttcctcacaacattgggcttggagctacaaggcatgtgttctaatatctatactttcgtgtattcattttgttgtgtgagtgcgtgtcaaacattatctttctttgtattagggatcctgacctcgtaaggaggatcggcgaagcaactgctcttgaagtacgggcaacaggcattccgtacacctttgctccatgtattgcagtaagcacacgcacgctgtagtattgttgctgttatgcattggatcttcagtggagcatgttgcaattgcatgagtatatggctatatgtaccattcttgattcattaagagctttgttgaccaaaaatgcttcatacaatttggttcaggtttgtcgagatccacgatggggccgatgttatgagagctacagtgaagaccacagggtagtccagcagatgacagacattatacttggtctacaaggagatatcccaataaatcataccaagggagttccttatattgctgggaagtaagatattttttctcattggtgctataaatgatattgtagatgtaggccattgtatggagcatgtgcatgttgacctaaataagtaaagcttatcggcctaaatgagcaccttttattaacaatatactttttacatacatacgtatgtaatagttagtggcacatctacattgcaaaagctataggaaaataatcaatgtcaatgtcaagttgcaatgtgaaggttttctgtcttatgtctcagcttatggcttttaacagggataaagttgctgcttgtgctaagcactttgttggtgatggtggaactcataatggaatcaatgagaacaacacgatcactgatgaacatgggcttctaggcattcacatgcccccatattatgactctattattaagggtgttgctactgt

SEQ ID NO: 92532 - DNA, 1368 bp, Oryza sativa
ggatgatcaaatattggggactgaattacagcaaaaggcaatgactaaattgatgggtttgcaatattcttttcaatacaagagaggggttgataatattgttgctgatgctttatctagaatgccttcctcctctcaattttgtgctctttctgtggtccaaccgatctggattcaggaggtgatcaattcttatacagtggatcctcaagctcagcagctactagctgagttggctgtgcattctcctaattctcaagggtattcattgacacaagggattattagattccagaataagatttggattggatccaatgcaggactgcatactaagttgattcaagcttttcatgcttctgcacttggtggccattctgggattgctgctacttatcatcggattaagaaattatttgcttggcctggtctcaagttggatgttgaaaattttgtgaagcaatgtcaggtttgccaacaggccaaacatgaacactgtcagcttcctggactgttagctcctctcccaattccaaaagaggcctggcaagacatctccatggattttattgaaggtttaccgccctttgatggttataatgcaatttttggtggtgggggatcgttttactaagtatgcaaatttcattcctttgcgtcatccattcactgcatcacaagtggctcatttggtggacaaaactgtatttaaaactcatggcatccctcgttctattgtgtctgatcgtgatcatctctttactagcaagttctggacaactctttttgctacttgggacactcaattacagatgagcacagcatatcacccgcaaacagatagccaaacagagcgtgtcaatcaatgtttggaaatgtatttacgatgcatgactcaggctaaccctaagaagtggagccattggattcatttggcagaattttggtgcaatacaaattatcatacatctcttggctgttctcctcataaggctctttttggggtggatcctcattattctcaagttcctgatctgacattggctactctgcctgatgtggtggatgtttagactgaaaggcagcacttgtctgaatttttacagcagcagttaactcgagcccagctgcgtatgaagaacaaggctgataaaggtcgttctgaccgtgtttttgctgtgggtgatgctgttttcttgaagttacagccttatgctcagtcctcagtagttaatagaccatatcctaagttggcttataagttctttggcccttttactgttttggagcgcattggagtggcggcttatcgtttggatctacctgccaacaacactgtgcatccggtgtttcatgtttctcaactca

SEQ ID NO: 92533 - DNA, 1697 bp, Oryza sativa
ataacaaagatatagtatttttcaaaatattagagtgacaacttaattcgccatactgaattacattaccatatatttgaagcctgaccatttgaagaacagattttgatttagcgttctacaggtgcaaagactcgtgatctttaaagcaataatgctcaagatcgagacaatcatcatttgaaaggctagcatgatttatttcacttatatacaacaaccacccacttggccaatcaacaagaagaaaaactaagtgtttctttcatgtgggtagaaacatatcattagatgcataattaaatatgatttaggcccgtgaatttacatacaacattccaaaccaaaacattgctccgtcctatgctgctcagatggattccaaagcaaagatttttctttggtgtattcttctgactacatagttttgtagcaggtctggttgccgcagacgtgaaagtagacaaatgaacgctatgtaaaagctatgggcagggataatacagaagcacatctaaattaattcctatagggattagggttagaatagatatggattaaaactcttatctgcccttaagtaatagtatatttacaatctttcaccaaaataaagcagggaagtaggaataataggtgaatgagcatcattcaaatgcaatatacttcttttgtttcaaacttaaaatggatgatatagtcacagaagaatatattcgcgtttctgcaattttagccaaacctctaagattgaatacgacattttctcccactggcataaaaatttcacaatgaaccaaagtttaaccctatcatgttatgtggggggagcgcatttttgtgttttctttcaaagttttttaaccaaaaattttcccctttacagctaataactatatggcactgacccgaaataataggagcaggtcccaaaagaaattgtttagcgtgcttgagagtcactcatgcatgtgtgttgtattatcccagaagacacgccacctgctcagttggagcgcttcaagcaaaaccaccacaaaatttgattgggggaaagaatgcgtttctggtatagatgagtcattgaagaaaaatgtattacctgattgtggtgaggtgtgttgtccgttgagactgctgtcacttactgcagatgcttcttggtgagactccccagactttgttggtgacgagtcaccatcagagttcctctgaactaactgtttcattggatagttattcctggcaagaaaatcctattcacatagaagtgaattggtaagttcattatcttcagtttaatagctatgattcagtatcacactgtgtggaatatgtacttacatagttggtcttggccatgcattggacaggatgattctccatttcttgcaacagcattatcattattagaaggcattactcaagatccacaaacattttctgtcctattttgaagttcagaaaattttcaggtcagactgacagtggcacataaagaaagccaagttactagataaattagtacttgaattcggtttgtatagtatccacatacaatgattagggattaggttgtcaaacatccaaactcagctggatgaacagttgaaaatgatcgaagcataaaataaatcaaagaactattgtacggcctctacaatatcattaacaaacaatactatgtcaactttatg

SEQ ID NO: 92534 - DNA, 4088 bp, Oryza sativa
attagctcctgatgcttcaactaacagagagtttaatgcccattcttcttcaaggtgattttgctgcatcttctctttgatataatcttgcatcataactattgttgaagtgttcagatttctactatgaagttatccttgtgtccaaattaaatctgagacatgccacatgtaattattcgttgattgcagtttgacgcattatactcttgcagatcaactgatgatgtgcctcctactgaccagacggatcttgttggctcttgtgtcatgcttccgaaatcagattcctttgtttcagtttccgaatatcagcacccattgactgaggacatggaggtcttgagtccaggtgtttttggagagcataggacaaatgatatgatttcaacccaggtctcacattcttcacctcaaccccagcatcaggacaattcagcagtgcatgactttaaggtgaatagaatatattaagtggatagaatatattaagtggatggcagtgtttcttattcgtggttcagcttagtggttttacctgacattcattcattcattctttttctcgtgtaccaggaatatgagccagattctaggtatgagatgccatttatcactaaagctgttgatagtgaggcgacccaaaatataccttatccgtctgaggaataccaccatgccacctttatgttcaagtccggttattatgatctggtgtctgcctgtctgctatacgtcgctttcgattttacattcataaagcacacttaagcaaacagcctttatattcaagtctggattcctctagatttatttgcagattgtgaatgcaacggtttttgagaacctggttatttgaccttgtattagaagtttcagaagcatcagagatctgcatttgtctatgtgaacatctgttacagctccaaagaagctaaaagggaatccaagctgttaacgcagcttgcttttccatactacctgctagtattttatcttttggttttgcacttttggcctgaaattatgttttatcaatggttggactaatcttgactgatggctccagcatttacttgtagttatagtactggatgtttagctttttcttcttaaggcttatccactgtccaagatcaatgtttccttagcagctgtgacattgtgtgaaactctgttgataggggatgggcttgcatgctgcaaatttcaatcagttatctgttactgcagcaactcacacccagtgcctcaaatgtaccacatgcatgtatcgcaatatccaaactgcttgccatatcgacatgttttctctccatactatgtgcctccagtggctgttcaaaactattcaagcaatccagcatttacacaattgccaagtgccagcagctatttggtaatgccaaacggaacgtcacagctagcacccaatggcatgaaatatggaccaccttatcagtgtaagcaaatgttcccttgtggccctgcttgataccgtggttttacaaattaaaattgttacccaatccattcttgtgtaattggtggcacttgttatggtcaaaaatgccatttctgttaattttagggccaccattctttccccactcagccctcaggtaattatatatttcatccttagaccaagccttttctgatcataattttgacacatgctgtaccttaacatgaataatatttgtgcttggttgcaggctgaaacagcagatgtgtggattcaggctcctacagatattcccgtcatgccgtcaacaccattctacaacatgatgggccaaccaatgtctccccatacagcatacttgccaccgcacaatggtcatgcccctttcagcccagttcaacaccctgctcacctgcagttcccagccatgccccacggactgcagccgacaacgatgaccatggtgcagaacccacaacccatggtgcatcagccagcctgtccgccgttggctggaaatatcggcattgatatggcagccatggcttctggagctcaggttggagcatttcagcaaaaccaactcagccatctcggctgggctcctcccagttttttatgatgatttggatggcagtgctctcatgagacgacaagtgagctggtttcgtatcgacaagaaaaagaaaagaaaagaactgattgaagagctatgctctaatgcaagtaactcatgatacttgccaccttttgtttatgatgcagggaaaaacatgttagtattccagttcatcttgcaccgcccaaagcgtgtcctgcattggaaacaccaattttgactgccagtttgctatcttatttatttctggttttatagtatacatcagttcgatcttaacttttctgatcgatgaaatgtgtgctccgaaatgctttatgagttcaactcaaatcgcatgataattccgctgttccctggagattttgtcgagtacccgagttgttgctctggatacacctgaatgctgcagtgctgcatcagatatgctaggacagttcactagtgaggtttaaattaaacacagtaataaaaggttcagggtgaaagataccatcaaccatgattcgacgtaacaaattgttaaatcaacgtcacatggttatgcgttaggtgtaaggtgcatctcaaaattttaagacgacagattggaaggtggaaagtggttgtggataaacaagattatagttcgtggaaagcgatcgtgcttaacacaaatactatgatagaaccctacttttctgctgttgatagagctagctcaatagtttaatggcggtagcaataacgctcatagggatcaatcaaacaagtcggctcgtgtgtgaaagcacgcctcatcttttcacttgtacttatgctcatcagctaaaatttaaattttcagtcttaaatttgaagttgattttaggttttttttcatcaaaatttatttttcaatctttgtttttaaatcgctaagaacatgtatataaaagttttattcacaaattatttttcgtttgcaaatatatcgtttggcttattccacaaataagcgaaacaacggggccgtctactccttattggtagggcacctataatgttaatatgttattatcttcatcccatattgatctccctataatgtttatacatcaagaccaaggataattttaacgccatgcacaatatgtacacattctcccgtaataaatgcatcgattaaaaacaatgcataatcgcatcctttagcatgcacacattctcccgtgctgtattaattgtactccgatgaaatccatgtccatgcggttatacgatgatcaatttgagaaattttagttttcattatatgataatcaatttaggaatgagggagtatataaaactaactagtaagcattaaatgtccctacttactactttctccatcccagtttgatcatcacgtaagcaaataacaccaagaccaaggacaccaaaatatttatcattctcaaattaaaccttatcggctaaagtgcttcattgcttcatcttcactactaccttaagtaaggaaataaaatatgacatgtacacaatgttttttgacagcaaaattaaaaaaagcagcggcattgggtggtggggttggaggggaatgtggcgtcggtttcaaggacggagtggattgcagcgtcgatgttaggggtggagcggattgcagcgttgggtggtggcgacggacaagtttgcggctcccggcagggacggagcggattgcggcattgggcggggacggagcggattgcggtgttgggcgggaacatagcagaatgcgacactgggtcacagcgaaggagaatgtggtgccggtggaaagagtgagaagaagttgagaggaattagggattgatcctgagctcatccatagggtttccatgagcgatgattttttaaatcctgtggaccccaccttaatgccgtctcgagcaaataagaattatggaggatgtctgctcctactaccacccatagcacggtcccacattaatactgagctcattaacggaaagggattctctgacttaactgctg

SEQ ID NO: 92535 - DNA, 687 bp, Oryza sativa
ttgttgatgaattattggatgagctctcaggtactaaattcttctctaaactggacttgaaagctgggtatcatcaaattcgaatggtggaaactgatgaaccaagacagcctttaagacacatcatgggccatttcagtttagggttatgccatttggtctcacgaatgcacccttcaccttttaatgccttatgaactcaatctttgcactatttataaaggaagttggggttgtggttaatggccaaattttaagttattacccttaaccttaatagcaattgccttaatcttcaccaagttttggtaattttaaggcacaaccagttatttgctaaaaggtctaaatgctcttttgctggcattcaactggaatacttaggacatatcatttctgacaaaggagttagtactgatcctgagaagacagcaccaatgctggcttggcctgtgcctacttctgttactgaattgaggggattttggggactgacaggctattacagaaaatttgttcagggttatagtatcataccatgaccattgacactcttgttgaagaagaaggcctttctttggactgatgctgcttagcttgcttttgatcagttgaagcagctatgagtaacactccagtgttagctttgcccaattttaagcttccttttacttttgagactgatgc

SEQ ID NO: 92536 - DNA, 506 bp, Oryza sativa
cctttccgaacactactttaagatctttaaccatagcaaacactgttttcccgctgcgatgtttaggcttcgtacggtggtccgccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacacttccttcttcccaactgtttaaggaatccctttttttttttccccccggacaaaccccccccaaaagggctttggtcttaggtacacgttgatgtcgttaccaggttgctaggggccttgaataataatcagcatcattatgtacttcctcttcatgcatagcc

SEQ ID NO: 92537 - DNA, 820 bp, Oryza sativa
ccggggaaaaggaatcccctgaatttctatagggacggcagggctataatactttgctgtcataacccctccaggggtggtgatgagcagagggtttctaagcctttctacccccactgatttttccccacgaatggcacagatataaacgagtgggaagctccagagtcgaacaaaattgtagcagggatggaatggacgaggaacgtaccaacggtgacgtcgggagttgtcagcacgtcctcggccgtcacatgattcacacggccccgaatgacatccttcccgccgttgttggagcggggaggcgcttggccttgctgacgccttggctttgggcatttatccgcaaagtgtccgggctcgaagcagttgaagcacagccgctgcggacctgaagcgtccctgcggccttgaacgggctgcacagctggcgtaggaggacgggatgcacgagtcccttgctgattctgctgctgcggctgtgggacgcgcaccacgaattgaggtcggggcgctgggcgaggttgctgctgctgttgttgctgttgcgaggaggatccccctggatagggattggtgtagcggaccctctggttagcaccctgctgattgcggaagttcgccaagcggcgcttgtgcgattccagctccttgtgcttggcctccaagcggatgctcttgtccaccagtcgttgaaaatccggatagtccccagagactagacgaacagacagctcggggtccattcctgccaagaacttctcttgcttctcctcatcttcccgcacatcctcaggggcgtaacgggccaagttgt

SEQ ID NO: 92538 - DNA, 1067 bp, Oryza sativa
attcctgcagcccagacgctcttagcaggaaaggctattgcaatgctacggagggacgacagttgccattggagttatgcaaggaatttgaaagaataaatttgggaatggtcagaagaggtttcgttgcagccttagaagcaaagcccactctaattgatcaagttagagaagcccaaattaatgatcctgatattcaagaaatcaagaagaatatgagaagaggaaaagctatcggtttcttggaggatgagcaaggaactgtatggttgggtgagagaatctgcgtccccgacaacaaagatttaaaagatgcaattctgaaagaagctcatgatactttatactccattcaccctggtagtaccaaaatgtaccaggatcttaaggaaagattttggtgggcaagtatgaagcgtgaaatcgcggaacacgtagcagtatgtgatgtttgtcagcgagtcaaggcagaacatcagaaacccgccggtttgctgcagcctttgaagattcccgaatggaagtgggaggaaatcggtatggatttcatcactggtctacccagaacgtcatcaggtcatgactctatttgggtgatagtcgacagacttaccaaagtggctcatttcatcccagtaaagacaacttattctggaagtcggttggcggaattgtatatggcaaggattgtgtgtttgcatggcgtccctaagaaaatagtgtctgatcgaggcagtcagtttacttgaaaattttggaagaagcttcaggaagagatgggttctaagctgaactttagtactgcttatcatccgcagacagacggacaaaccaaaagggtaaatcagattttggaagacatgttgagagcttgtgctttagacttcggtggaagttgggataagaatctaccttatgcagaattttcgtacaacaacagttatcaagctagtcttcagatggctccttacgaagtactgtatggtcggaagtgccgcactccgcttttgtgggatcaaacgggagaacgtcaggttttcgggatggatatcctgagggaagcagaa

SEQ ID NO: 92539 - DNA, 1307 bp, Oryza sativa
gctcacggaaacgaacgaccgagatcgatcctatccaaaacggacggctgagatcgaacggtccatgaccggccacggcaaacggccacgatgacgtcagcggtgacgtcacctccggcggcggctcgggcgcgcatgctcgccggcgaacgacggcgcgaggacgcgaacggagggcaccagcacgtagagagcgacgcggcgaactcaccgatgaccaaaacagcggcggaagatgaacggacggcggcggcatcgaggaaaaggcggcaaagtccttcggcttgacgacgacggcgatgctccggcggtcttcagcgacagcgaaggggcggacgaggacggcgacgcgacggcgaccacgatggcgaccttcccgagcgacggcgacgactggaacaacggcgaagcacggctggagcgacggcgacgactgcggcacaaggtctcacgagactaggactctaccggcgacgagagacgaaggcgagggtggcgacgggtagcggcgggcttggggatccttttataggggttggaaggctgcggcgaaggcccacggcgaccggcgacgagaaggaaagttaaggctcagaggaaagagaccaatccgaatcgaactcgaatccacggatttccaaaccgatttagaggatgattccaaaagagaaaaggtagaggagatctcggggaacatttcccctcaattgatttcaccggagaaggaaaggcgcggccgaatttggaagtagacgacggcgcggttcggctagggttcgggcggcggcggccggaggaagacgacgagtccgacaggtgggacccacctgtcaacgacagcgagcgctcgcgcgggcggctgcggctgcggactgggccgacttgggccggggagagagagagaaggttttgggcagactttcgccccaaagccaaaagagacttttaaaaaaaactttttcaattaaattattcatgaaatgcaattccatttattaaaaatacttccttagctcaaataaatcccagaaaaatctaggaattatagaattaagcaaagtatttaatgaaattttatatggccccattttatattggaatttattaattaaaattagatcttctcttctagacttttaaaataaattctaataattccaattagacaacaatttatatatttaggattcttagggtgtgacaaacctaccccccttaaacagaatctcgtcctcgagattcagaagtactggcgaacagatgcggatgagctgacttcaattcatcttctcgttcgggctgcagga

SEQ ID NO: 92540 - DNA, 1229 bp, Oryza sativa
acatgtctttatttcatattactctatctatccggccaaatagatattgcatctatttgcatctaccatacaagtttatgcatagtggttgttatcagggttataggtaaggtataccctctacccttcgatatacgtcacatatcgatattgtatgcttgcgcgaatacggacggttccggcatacgttaagaaaattcatcacggagttcacagatggaaggagtcatactcggacagaactgggtcgtcattgtatcgtgtcgggttcgatgtctccgagtcctacttggagaccggttgacctgcgatataaaagggacccccgggaggacctaaggcatcgaatctcatagccaacacatccaccacagcctacggagttgaagcctacagaagccaagtcgccgtgagatctaattgaacctgttcgattacaatctcgtcggtatcatcgagttccgcaattccctttctaatctgtggtttccatcatataatctcatatcaactggattagggctattacctatcaaggggcttgaaccagtataatctttgtttttttatctgcttgatgtcgtactacatagatcctcgtaccagcataccctagtaccctctatatccggtctacgggtattccccatcgatagtggcgcgccaggtagggggacttggtgctcagggttctacaactatgtcatccagcttcgtcgacaacagcgtcaacaccaacctcaaccaaggagttcctgcttcaacaatgctggtgtggaatcaagtcggcgaaatcgtcttcccggtttacgccacgatgccgatctcggctggtccatcaatgatcgaaagcgagaacgcagtggctacaacccaggacgactccatgtcgaaggatcctcccgccaaagcggagaactgaacgtcgacaacatccgagcccgagaaggatcctagtgcggccaaaccttgtctttctgacaagaatcacgagccgacgaggatcacttccgaggtgacaaggtcctggtgtcctatccacaaaaccagaaaacacaccttgcaagcctgctgggtctttctcaatgtccacgctgaaattcgtgcctgcaaagagcgtggaattcagcatacttctccaactcgtgatgtctactgtcctattcactagacaaagaatcacgacctctcaagctgcaaggtctttctcagcgccgtgaagacgtcac

SEQ ID NO: 92541 - DNA, 2891 bp, Oryza sativa
agaaatacaatccccgaaatcaccgacgcttctgtaatctgcgccttcaagtccggtgtcagagatcgctatactacccaggagttggcaacgaggtgtgtcacgactactcggagattattcgaaattgtcgatcgatgtgctcacgcggacgacgcactgagacgcaagaacgacaaaccaaagaccggaggagagaagaaaccagccaaggacgcacctgagtcaagcaagaagaaaaatcgcaagagtgggaaaaggaaagctcaagcggaagttctcgcaacagaatacgcggaccctcccaagcgcccagacccacaaagcagcgacacgaagaaaacatggtgccctatacacaagtcggacagacactctctagaagattgcctcatcttcaaaaagtcgctcgcaaaacacatggcattggaaaaaggcaagcgagtacgtgtggccgagaaggacgctaaggcggctactcaggaatcggactcagcatacccagactctgatctccatgtctcgcacatcttcggaggttccacagcatactcctcaaagcgagaatacaagaaagtggaacgtgaagtctgttcaacatggcagggagctgcgcccaagataaagtggtctgagcagaagatagaattctcagaagaggaccaccccaagactgctgtcatcccagggcgatatccgatcgtggtcgaacccactattcggaatatcaaggtcgcgcgagttctgatcgacggcggcagctcaatcaaccttctcttcgctagcactttggacgcgatggggatcccacgaagcgagttgacacccaccgatcaacctttccatggaatcactcctcagtcatcgtccaaaccattgggcaaaattacgttgcctatgacttttggccaagcaaataacttccgaacggagcagatcacctttgatgtcgctgaattcgatacagcatacaatgctatcattgggagaattgcacttgcgaagttcatggccgcatctcactacgcgtatcaagtgctcaagatgccgggaccgaagggaacaatcactattcaagggaatgctaagctggcagtgcaatgcgacaagcggagcctcgacatggtcgagcacacgcccagcccacccaccacagctgagccacccaagaaagtgagcaaaacaaacaagacggcgaaaccggacggtgcaatcaaaacgttccactctccagtgccaaccctgacaagaccgtcaagatcggggcatcactaggcgagaaataggaactcgcgatcatcaccttcctccgcgacaatgctgatgtgttcgcttggcagccgtccgacatgctgggggtatccagggaggtgattgagcacaaactcatggtgcgaccggacgccaagccagtaaagcaaaaactgcgtgagatttgcaccagatcgaaaacaagccatacgagaagaactcgacaagcttctcaaagctggttttatcagagaggtactccatccagagtggctagccaacccagtcatggtgcggaaggtcaacgggaaatggagaatgtgtgtctattttaccgacctcaacaaggcgtgtcccaagaatcacttccctcttcctcgaatagaccaactggtggactgaacagccggttgtgagttgctgagctttctcgacgcttactccggctaccaccaaatcagcatggcgaaagaggacgaggagaagacggcactcattacgccgttcggggtattctgctacgttaagatgccgttcggactaataaccgcaggaaacactttccagtgcacggtccagggcgcacttagcgaccaactcggaaacaatgtcgaggccaacgtcgatgacattgttgtcaagaccaggacaagtgactcattgattgacgatctgcaggaaacgttcgacaacctcggacgatatcgcctcatgctcaatccagagaagtgcacgttcggagtaccatcgggcaagctgctcggtttcctcgtctctggcagaggaatagaagcaaatcccgagaagatcaaggcaatcgagaacatgaagtcgcctacaagactcaaggaagtacagaaactaaccggatgcatggcggcaccaagcaggttcgtcgctaggatgggagagcgaggacaacctttcttcgctctgctgaagaagcaagacaaatttgtatggacacaggaagccgaagaggcattcattgcactcaagcgctacctatcaaatccccctgtacttgttgccccccaacctaatgaagaattattcctctatattgccgccacgccatattccgttagcactgtcattgttgtcgagagagagaaggtgcaacgatcagtctactacgtcagcgaagccctccacgacgcaaacacaagatatccatagatccaaaaactgctctacgcggtaatcatgacatcaagaaagttacgccactacttccaagcccacagggtcacagttgtatcctccttccctctcggtgaagtcgtgagaaacaaagacgttgttggccgcattgcgaaatgggtagtcgagctaagccagtttgatgtccactttgtgccacgaacagccatcaagtcccaggtactcgctgacttcgtagctgattggactatgcctgataacaggtcagacaaccaaatcgacaacgaaacgtggataatggcgttcgacggcgcgctcaacagccaaggagcaggggcatgattcatcttgacatcaccttcggaagatcaattcaagcatgcaattcacctcaacttcagggcgactaataacacagccgagtacgaaggactactcgccgggataagagctgcagctgcacttggagtcaagcg

SEQ ID NO: 92542 - DNA, 738 bp, Oryza sativa
gaaggagtaagagacaaaggacggctaagtcctttggcgatgatttcactgtgtacctcgtggatgatactcctaagtcaatttcagaagcatatgcatctcctgatgcagactactggaaggaggctgtccgtagtgaaatggattccattatcgctaacgggacttgggaggtgacagagtgaccctatgggtgtaaacctgtggggtgcaagtgggtgttcaaaaagaagcttaggcctaacggtactattgaaaagtacaaggctcggcttgttgctaagggctacactcagaaagaaggcgaagatttctttgacacttactcacctgttgctagattgaccacaatttgtgtgctactttccttagcagcctcacatggtcttctcgttcatcaaatggacattaagacaacttttcttaatggagagctggatgagatctatatggatcaacctgatgggtttgtagttgaaggtcaagaaggcaaagtgtgcaagttgatgaagtctttgtatggtctgaaacaagctcctaagcaatagcatgagaaatttgacaaaacattgacatctgcaggctttgcagtcaatgaggtagataaatgtgtgtactatcgccatggtgggggtgagggagttattctgtgcttgtatgttgatgacatactaatatttgggacaaaccttgaggtgataaataaggttaaatcattcttgtctcaaaattttgata

SEQ ID NO: 92543 - DNA, 758 bp, Oryza sativa
ccggatagcagagaacttaaacagctgatacttcaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcagagcaccagcgaccggccggacttctccaacctctccaagtgccggaatggaaatgggatgaaattgggatggatttcatcaccggccttccaaaaacccaaggtggatatgattctatatgggtaattgtggaccgattaaccaaggtagctcgattcattcctgtgaagaccacctatggagggaataaactagcggagctctacttcgctaggatcgtgagtctccatggcattcccaagaaaatcgtatctgataggggaagccaattcacctctcacttttggaagaagctccaagaagagctgggtactcgattgaatttcagcaccgcctatcacccgcagacagatggacagaccgagcgtctaaatcagatcctagaagatatgctccgcgcatgtctagatttcgggaagacttgggataagagtctcccctatgccgagttctcctacaataacagctaccaagccagcatacaaatggcaccctatgaagcgttgtacgggcgcaaatgccggacaccgctactctgggaccaagtcggagaaagtcaagtgttcgggactgatag

SEQ ID NO: 92544 - DNA, 710 bp, Oryza sativa
attcctgcagccctgattctcaactggtgatatcctgatcgaagatctatcttggagaaaacggtggcacctttaagctgatcaaacaaatcatcaattctgggcaacggatacttattcttgatagtcacatcatttagtgcacgatagtccacacacatcctctgggtatggtctttcttttccacaaaaataactggagctccccatggagatgaactcggtctgatgtatcctttctgaagcaaatcgtctacttgcctcttgacttctgccaactcattggctgccattctataaggtctcttatggatcggagttgttcctggtaccaaatctattctgaactctatatcccttttaggcggcataccaggtaaatcgtctgggaacacatcgggatactcccggactacaggaatctcttccaaagttatttggttcagtcttgaccttaaagactcagaagacaatgcatgaacagttacaactcgaccatcattgctggtgagagttacttttctgttggcacagtctatcacacctttatatctggctaaccagtctatccctaagatgacatcaatgtctttggattctaacaggataagattggccagaaatggtactccctgaatttctattctgacagaggggctacgttgcaaagagagtgcctgattacttggggtactaaccatcaaaggatg

SEQ ID NO: 92545 - DNA, 732 bp, Oryza sativa
attcctgcagccctgatgttcccgcaactttcccaacaccagacggagatggtgctgatggtcttcctctgtttgtgagtatatcagaatgtcgtcgatgaaaaccacaacgaacttatccaagtattccatgaacactttgttcattaagttcatgaagaaggcaggagcattggttaaaccgaacgacatcaccgtgaattcatacagtccgtatcgcgtggtgaatgcggtcttcgggatatcttcttcacgaatacgtaattggtgatatccggaacgaagatcaatcttggagaatacagtggcatctttaagctggtcgaacagatcatcgatccggggaagagggtacttgtttttgatggtgacttcattgagagctctgtagtcaacgcacatcctcttcgttttgtctttcttctccacaaaaatcacaggagcaccccaaggggaagtactcggacgtatataccccttttctttcaactcttccaactgtttcttaacttcggccagttcatttgctgccatacggtagggtcgcttgtacagaggagtggttcctggagcaagatctatccggaactcaatctctcgcttgggcggcataccaggtagttcttccggaaacacgtctccgaactctctgactatggggatttctgacagacctatctgatgcagttctgaacttctgacagaggttgggggtgcaaagaaaccaaccgg

SEQ ID NO: 92546 - DNA, 1375 bp, Oryza sativa
gaatcagatccgagggaaaaggaatcccctggatttctataggaacggcagggctataatactttgctgtcataaccccgccaggggtggtgatgagcagagggtttctaagcctttctacccccaactgatttctccccacgaatggcacagatataaacgagtgggaagctccagagtcgaacaaaattgtagcagggatggaatggacgaggaacgtaccaacgatgacgtcgggagttgtcagcacgtcctcggccgtcacgtgattcacacgaccacggatgacgtccttgccaccgttgttggagcggggaggcgcttggccttgctgacgccttggctttgggcatttatccgcaaagtgcccgggctcgaagcagttgaagcacagacgctgctgaccttgagcgtccctgcggccttgaacgggctgcacagctggcgtaggaggacggggtgcacgagtcccttgttgattctgctgctgctgcggctgtgggacgcgcaccacaaattgaggtcggggcgctgggcgaggttgctgctgctgttgctgctgctgcgaggaggatccccctggatagggattggtgtagcggaccctctggttagcaccctgttgattgcggaaattcgccaagcggcgcttgtgcgattccagctccttgtgcttggcttccaagcggatgctcttgtccaccagacgttggaagtccgggtagtctccagagactagacgaacagacagctcggggtccattcctgccaagaacttctcttgcttctcctcatcctcccgcacatcctccggagcgtaacgggccaggttgttgaactcatgcaagtactccatcacggagcggttgccttgcttcaactcccgaaattcccttttcttaagagccacgactccggcgggcacatgggttttccggaaagcggcggtgaagcgagtccaagtaataggttgcccttctggctgcgtggcctggaaatggtcccaccatagagatgcgggcccctgcagctggtgggcggcgaagatgactttctcctcatcactgcactgcaccgtgtctaacttcttccccacggcatgcaaccaatccaacgcatccacggggttgttggagctagagaaggtaggtggacggatgcggaggaattcggcgagtttggagtgttggggaggtggtggtggagcattctgttgtggcggattttggaggtggtggaggaaagcattcatcatgttggcttgctgggcgaggatttgggtgagaatggcgttggtgtctggtggtggtggtggaggtgggtttcccttgggggttggggttgctgccctcgggttggttgccttcaccggtgc

SEQ ID NO: 92547 - DNA, 1671 bp, Oryza sativa
ctattcaactattgcatttatttttcgaatgtcattgggtggaattaacctattgtttgttatagccctttttgttcttgattactttattccttgataccttgggttattacaacttgactagttgggctatatatgtattggttcagctagatattagatatgattgcttagccatgcttagaaacattagcacacttttgggttaacttatgattcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttctgttgtgaaacattaaccgtgccaaccacaagccagcgtgggcaacggctttaccttttgtatagcatggttcattgcggagcaccaatctgagaagtggcggagataagcccacgggagtcgctggggagtccatgccttgtttataagagggtgattatgatccaggaaaggtgccctgtggtggattgtgttgtgcgaggggtattgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacctctcatcataataaaagatgctataactggtaataatttgtttagctcctggtttggaatggtatattcctggtttggagatagatctgtacagccgggtatggttgttcagaatggttgggcctatacaacagggtatgttgtatagcgttggattaatattgtttaattattacttaactattttattaaattctgaaatgtttattaaatgctgtttatgcaaatgaaaccctactatgccatcctttgttatcctgtgcacttgcatatttgctgcgtgacttgctgagtatgtcatatactcaccttgcaatcattcatcagaggaagagttctacagtgaagctgatggtgtggaggattaggtgtagccctggtcaagctgcctgtggagtggagccgtctgcgccgtttatttttttttccgctgcttagatttttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccggccgtgacaatctagtgccgtcaactctgcttccatggttgacctcgtcaaaatggtatgtttgcaagacctccacgaaacagcaccaccacctagttagaatcactataaccatctagtaccgcaggatacctagtatagtgaagcctcaattccatagtacctttcagatagtgcattactcgctcaagcgcacgcaatgatcatctcccggattagaggtaaaccgggtcaacttgctcacagcaaaggagatatcaagcctatttgcactaaccaagtacattagcgagccaatgatttgggagt

SEQ ID NO: 92548 - DNA, 700 bp, Oryza sativa
acttgcctagtatggtgtcatctgatggttgcctgaactgtaagatgcatactgatgatgaaaaactcatcaaagaggtgactgtctttgagataaaaagaagggaatcgggagctgctattgtctgttctgatggtttgtcacaaaagcgtcagccacgagatatgtcagttgattggtttgaggaagaaactaaaagtggagatatcatcaaatcaggtgattcatctccaactgtactgtcaactttttcatctgaatttcatgatttctctgacaacaatgaagtggtagggttggccacggattttcttgatgtaaacaatcaaaataaagcagtattgctagatagttcatctcatcgtggtatcatggacaatcattgcaaatgtggtgaggaattttcttctgataaggaggctccagcttaccatttatttgaaaattatgattttgttgacaagcatgaaacaaaagaggtggtacttggtgatacagtagtcttgacctttgtagatgatttagccaatgatgactctgaatatagggaggatatttcagaacaaaaggatccaaataatttatcaggattgcttgataacgttgcagatattttttaccagcagcaagaaatacataaggtggttgtttctgacgacaacaagccacctgaagttttgttcctcagtggaaagcaaac

SEQ ID NO: 92549 - DNA, 595 bp, Oryza sativa
cccccaccatgccttaggtagtcccgcggggtccaacatggcattcaccaagtcagtcagtgtgcggttcttcctttcagcaatcccattagactcgggagaatagggaggcgtcctctcatgtatgatgccatgttcctcacaaaataagtcaaacttgtttgagaaaagctctccaccatgatcagacctaagtcattttatctttctgtaaagttgattttcaacttctgttttataaattttaaaatagtctagagcctcgtctttcgttttcaacaagtacacatagcaaaatctagtagcatcatcaatcaacgtcatgaaatatcgttttccacctttcgtcaacaacccattcatttcacaaagatctgaatgtaggagttctagtggtgccaagtttctctcctcggcagccttgtgaggcttgcgatgttgcttcgattgcacacaactatggcacttagaacctttgacaatggaaaacttaggaattaaacacatgctggaaagccgagacatcaagccaaaattaatatgacataaacgtgagtgccaaacattagcctcatcatccacacttaggggtagg

SEQ ID NO: 92550 - DNA, 2312 bp, Oryza sativa
ccggcccaagagggaagggggggggggaaacagacttcttttagggttttctttttataaacctttttaactttgtcatttcttttctattattatttgtgctctgaaaattccactaaaatttatttaagcattttaggcttttaggaaatatacaaaaatcctccaagcctcatttgacttttatctttgcacattttaattgttggaggctttcacattgatttttaattattctttggaaaatttcgaggatagattttagagtcgatttgggacgcgacaaacctacccccttaaacggaatctcgaccccgagattcggaagaactggcgaagagaccgggatgggctgccttcagctcgtcttcgcgctcccaagtagcttcttcttcggcgtggttgctccactgaaccttgcaaaaacgggttactcggttcctggtcctgcgctccatggtgtccaggattttcactggcctctccacataggtcaagtcttcgcgaacttcaatttgctctgaatcggcctgctcggatggcattcgaagacatttcttgagttgcgacacatggaacacatcatgcacgttacccaaggaggcgggcaactccagttggtaagcaacttctccacgtcgagcgatgatacggaagggacccacataccgaggtgcgagcttcccttttgtctgaaacctgtgcacacctcgcaatggcgtgacccgaagatacacaaagtcatccactgggaattccagatcacggcgacggttatctgcataacttttctgccgagactgtgccacctttagattatcccgaatgattctgactttagcttcagcttctctcaggatatcagtcccgaacacttggctttctccaacttggtcccacaatagcggtgttcggcatttgcgcccatacaacgcttcataaggtgccatttgtatgctggcttgatagctgttattgtaggagaactcggcataggggagactcttatcccaagtcttcccgaagtccaggacacatgcgcgaagcatatcttctaagatctgatttagacgctcggtctgtccatctgtctgcgggtgatacgcggtgctgaaatttagtcgggtaccaagctcttcttggagcttcttccaaaagtgagaggtgaattggcttcccctatcagatacgattttcttgggaacgccatggagactcacgatcctagcgaagtagagctcggctagcttgtgtcctccataggtggtcttcacaggaatgaatcgagctaccttggttaatcgatccactattacccatatagaatcatatccaccttgggtttttggaagtccggtgatgaaatccatcccaatttcatcccatttccattctggtacttggagaggttggagaagtccagccggtcgctagtgctctgccttgacacgctggcacacatcacatagggccacaaactctgcaatttcccgcttcatgctgacccaccagtatttctccttcaagtctaagtacatcttggtactgcccgggtgaatggaataaggactttcgtgagcttcctgaagtatcagctgtttaagttctctgctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttctaacgcagccaagaatccacgaccaactatgtttaggttcagggcttccatctgttgattaagctcgggtggaatgcctcgaacgttgagagtattgcaatggctcttccgacttagagcgtcggcaaccacgttagccttaccagggtgatagtgtattcccacgtcataatccttgatgagttctaaccatctcctttgccgaagattcagatccgactgggtgaatatgtatttcaagctcttgtgatcagtatatatttcacagcggttcccaatgagatagtgccgccagatttttagagcatgaaccaccgctgctaactccaagtcatgcgtagggtagttgccctcatgaggtcgtagctgacgtgaagcataggctaccacatgaccgtcctgcatgagcacgcaccccaatccttggcgcgaagcatcacaatacaccatgaaatccttgcgagtatccggcaagattaacactggcgaggaaaccagcttttctttgagagtttggaacgccttctcgcattgcgggct

SEQ ID NO: 92551 - DNA, 733 bp, Oryza sativa
caagggatattttgcatattcggattgcctcaccgtatcataacggacaacggctcccagttcatcagtgccgatttccaggattactacatcaggctgggagtcaagatctgcttcgcctcagtttctcaccctcagagcaatggataggtcgagagagcaaacggcatagtactacaaggaatcaagacccgcgtctacgacaggctcatgtcacatgacaagaagtgggtcgaagaactcccatcagtactatgggccgtgcgtaccacaccgacaacgtctaacaaggagacacccttcttcctcgtgtacggttcagaggccatgctccccaccaagctacgacatcaaagtaaacgagtacagaagtactccgatgaggatcaggaggagcagcgaaatgatgatgtgaatctactcgaggaacatcgcgaacgagttgctgttggagcagccagctaccaacaggcccttcgccgttatcacgagaagcgcatccgagcacgcacgctttcgatcggcgattacgtcctccgactggttcaaatccaagcagggcgaaacaagctctcacccaaatgggaaggaccgtacacgatcacacaagttttgcggccaggcgcattcaagattgcagacggcgatggtcgtgagttggcatattcttggaacattgatcaattatgtaaattctatgtataagtcaatagtatccatacttgtaagacat

SEQ ID NO: 92552 - DNA, 759 bp, Oryza sativa
tccccttggggagccccagtgcttctggttaagaaaaaggatggctcggagagaatggtaatcgactatagagccctgaatgaagtaactataaagaacaagtacccgttgccacggattgacgatttattcgatcaacttaaaggagcaagagttttctcaaaaattgacttgaggtcaggttaccaccaactgaaaatcagatctgaagatatcccgaagaccgctttctcaacgcgttatggtctatatgagttcacagttatgtccttcggactcaccaatgctccagcattcttcatgaacttaatgaacaaaatctttatggaatacctagaccagtttgtcgtggtgttcatcgatgacatcctgatatactccaagaacgaggaagaacatgctgaacacctgaggctgataatggaaaagctcagagatcatcgactattcgctaaattctcgaaatgcgaattctggttggaccgagtagcatttcttggacacatgatttcctccaacggtgtcgaagtagatcccagcaaggttgaagctgtacttgcttggaacccgcccaagaacgtgtcagagatccgcagcttccttggcttagctggatattatcgaagattcattgaaggattctctaagctagctagacctatgaccgagctgttaaagaaggaaaagaaatttcaatggtctgcagcctgtgaagacagcttccaagaattgaccaaaccgttgaccactgccccagtt

SEQ ID NO: 92553 - DNA, 1312 bp, Oryza sativa
gtacggagtcgacagagaacatacccatcacagcgtctggagcatcctgagcggtttcagcttgaatgtgattcacacggcctcgaccaaagtggttggaagcacgagaaccttgtctacttgcctgagagctaggacgagactgagctgccgctggagtaggagttctggcggtgctgccattagcatgccctgagttggtgttggtaggattctgagggcactgtctagcatagtgacccatctggttgcaccggaaacactgaactgctgacggtccctgtggtgacttgaaagaggtaacactgtttggcgcagtgttgccactaggggcacactgctgtggcggaggtgccggacggttcatctgagggcgaggggtgtagcctggctggcggttagcctgggtgaccgactggtggtattgcatgggttgaccatagcgagggcgaggtgtgcctcgggaagaatttccctgatggttagacttgcgtttcttgtattcttcggtagcctcttttctggcatcctcaagcagaagtgccttgttgatcatatgttgaaaagtggggaagtcatgagcaagcaactggagtctcattccaactgcgattcccttcaagaatttcctgatcttcttcttatctgtgtctacttcctcaggggcgtaccgagccaacttgttgaactgacttaggtactcattgacactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctcttagttggtgaaaggcgtagagcatcttctcaacaggagtacactgcactaagttgagttttctatcaacatctttcaaccaatcgtcagcctcgacgggctcgacggtctgagagaactctggcggacgagacctcagaaagtctgtcagcttggatctgttgttgcccatgtgaggatggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggctgctgcggcggggttgctcaacctctgtgttgcgggaaacagt

SEQ ID NO: 92554 - DNA, 1484 bp, Oryza sativa
ccgtagagcacctccggggaatccgagccgttggctgttctcccctggtcccgggcaaccgcccggtgtgctcgctttgcctgtatcaccgtggttcgttccgccgcttgccggccgccacccgccgtccattcgcggccgggtcgtcgtctacctcccaccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccgcagaccgcgcgcatgcaccgcgtcccttccccgcccgcgcgtgtgcgtcgcgtgctctctccgcacggtgagccgagccgctgacaagcaggtcccacccgggaccgcgcggggtgagcccggtccaccggctctctctctcctccctcccgcgcgcgcgcgagtttgggccgccttgggccggccggcccatttagctcggccggaccgctccatttctcttgggccgcgccctagccgtccgagaaaagtctatattccctccctcccttcttttctttttcttttccaaaaaggatttaattaaatccttttcctttagataaaaaattcaataatcttagaaattcaatatcttcccaaccgtaaatccgtttgactccgttcaacttccaaaattcctcacatctcgagatctaatctcgagatctatctaatagggcttaattttcgccgtttgttgagttgttccgtttcgcgtgtagttccggagcccgaagacccgcagtgcgaggatttcgaggatcaagctccagatctcgagcaaggcaagccacctttgaacatcttgagcctatatttgaaatttaattatgttgcttgcaaaatattatgcattgataggatcgcacttaatctgtttgtcccgtctgcaaggcagattggcggacctacctaatttgtcgcatttgatccttcctttgttaattgctataccatgtccccttgtaaccacccagttgcgcctcgatactcgtgcactctgtgcaagtatcgacggtcgccctcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaaatttcatccgaacataagacaagtacgaccacatgggtggaatgggacgcccctggctgagtaaattgctaatcgggggagccttgatgccgagagacatgtggatttcccggggtggggtcggggaggacccctaggtttcctggcacagtatggcctgggacctaacctgttgttggtctgggacccctctcgtcggcatatggtaaacctg

SEQ ID NO: 92555 - DNA, 943 bp, Oryza sativa
ggctcaccgtgcggagggagtacttggctcatgcacgcgggcggggaaaggacgcggtgcacgcgcgcggtccgtggtgaacgcaggtgcggtgggcccacgcgcagcctcacggctcgcggtggaacgcgcgcacggagagggactgaccggggtcggctcgatccggtctaggttgagctggcgccgacgtggcgcctacgtggcggccacgtgggctggcgggaggtagacggattcgccggaggttgctcgacggcagcggattgcggcggcggcaaccggcggcgggagaagagggaaacggcgacgaggtcacgagaggtcgattcccggcggtgagagcatctatgcggcttcgggaactcgacgctagcgtcggattgggcggaactacgccgagcgaggccggcgacgagcgggtgctacggagctcgagcggcgacggtggcgaacacacggcgagcgacggcaacggtccgggcagcgccggctaactacggggaggctactcaagctactaccgaaagctaggggggggagatggagcgaggaggaagaacggagagaggcactaccgtgcgggtcggggcgctgtgacgagaggccgacggcgcgggagtaatctctccggcctcgggccgaggaagaggaagaagagggcgcggccgaagtccccttccgcgtcctcgaacgcaccggctctcccggcgcttggcgaaggacggcggaggcgagacagagcacgggggcggcggcaacggtgaggaggcgaatgggagaggaaaggaagggagggggaagacgggtttaaaagggcggcaatgtcggtttgagagaggggaaccgacatgggcggtcaagccggcgagctggcgctccggctagcgtccaaagcggcgacaggaagtgacgccggcgagaggggaaaaaggggagaaaa

SEQ ID NO: 92556 - DNA, 5230 bp, Oryza sativa
tcagcacatattacatgtcctttgatgcatgtaagagagggtttctgagtggatgtaggcctttgatatgtttggatggttgccacatcaagactaaatttggtggacaaatcctaacagcagtaggcattgaccctaatgattgcatatatccaattgcaatagctgtggttgagaaagagtcattgaggtcttggacatggtttctatataccctaaaggaagacctgggcattgacaatacctacccatggacaataatgactgataagcaaaaggtatacttgttctttatttttgtcttataagttttgttcttataatctgacatatttcaaattccatgtttgtttttacatgatacagggtcttataccagctgtccaacagattttccctgattcagaacatagattttgtgttagacatctgtactccaattttcaggtacatttcaaaggtgagaatctgaaaaaccagttatgggcatgtgctagatcaagttcagaggttgagtggaatgccaacatggaagaaatgaaatctcttaatcaggatgcatatgagtggcttcaaaagatgcctcctaaaacttgggtcagagcttatttcagtgaattccctaagtgtgatatcttgttgaacaataattgtgaagtattcaacaagtacatcttagaagctagggaattgccaatcctgagtatgtttgaaaagatcaaaagccaagtaatgagtaggcattacagtaagcagaaagaagtggcagagcaatggcatgggcctatatgccccaagatcaggaagaaagtactgaaaaatgcagatatggcaaacacatgttatgttttgccagccgggaaagggatttttcaggtggaagataggaatttcaagtacattgttgaccttagtgctaaacattttgactgcaggagatgggatctaacaggcatcccttgtaaccatgctatctcatgcttaaggagtgagagaattagtgccgagtcagttcttccaccctgctatagtttagaagcattctccagagcatatgcatttaacatttggccctgcaatgatatgactaagtgggctcaggtgaatgggccagaagtgaagcctccaatatatgagaaaaaggttggcagaccacataagtctaggaggaaagcaccacatgaggtacagggaaaaaatgggcctaaaatgtccaagcatggtgtggagatgcactgctcttactgcaaagagcctggacataacaagaaagggtgcccactgagaaaggctggactcaaacccaaactgaagacaagtaggaccccagctgcaagttctacagaagagttgcatgaatctgagcaagaaccagtagaggtaatgaaacaatactctatcttatcactctattatcagtaccctattaattataactctatcttaattacctttgtaaacttgtaggtgctgacccaatctcagtctgcatatgaccaattactatcacaagttcctaatcctatggttgcacagatgtttgaggaatcatcacaagtgagtcaaatggaaactacacatggtcctctcccagataaccagtacattctttcaaaccagccagctgtagtatctacccctatgaccacagcaacaaaagagggaaaatctagggccaacaaaaggaagtgtacaactgaaggagtttcaggagttgctgctactacttcaaagaacagagctcccaggaagaaagctactgctacaaacaagtgatatgtgttagaccatatgtttgatggtcctttagtgttagtagtactttgttatgcaaaaatttcaaccttgtatggatttcatgggcatgcttgcttgattttgtgctgccaaacttgtggctattttgtgatagaacatgggatttttgtgatgccagacatgtgttcactaaatgtagtactggaaatactactaaatgccagaaatttggtattgtgatgaatatgcgaaattactgcctgtaatgcatgatgcatgtttgctatttccatatgacagttttacaggacatttcatatgctagaacaaaataacagttgtctgctgaaaaaaattagagatgtcgattttcagaacaaaatctcagatttcagcttcacataatagcatttagcatacattttccatacatggttcagattcagcatacacaaaaggtcactcaagtgccttatttcagctgacacaaaacacaccagcaccaatacatccatatccatcaaactttggtatctacctaagaagcaatagtgcaaatatgactactacaaaaccaacaataactgacaacatagatcttctactctcttctaacatcttgattctataggccattttagtaactgagccacattcctctttttgtcccctgctctttgcttcatagacattgcgttcagtgacaagtccatcaatcatagctcttgagttggcaagggatgctctaatttcagagttctctgtcttcacttcacgaacagtgctgactaaatcattcaaaacctgcttcaaatacgacgttgtccctggttcataccactgccgtaatttgcatccaccattctgcacattcaaaatgaataaaccaactgacttcaacaaagtactctccaggtaccgaatgggagatggaaaggttttaccttgcctggatatttctgtcgcccaccgtgttgtgctccaactggagctcgagcctgccatcgccttcaacccagccgctccgccgccgaagcccgccgagacctgctccgccaaagaaccctgccacgacatactccgtcgccgaaccctgccgagacctgctccgccgacgaacctgccgcaacctgctccgccgccgaaacttgccctcaatcgcaaccctagtcggcgcttagattttgggcgcttcagggaagaagaagcagtggtggaaaccaaatgagaaaaagagaggggcctggatgaaaaacgacaaggcgtgggcggtgtgtcacgcacggtgtggtccagctcagctgtgcacgtggcatgccacgtcggcgcgaccgcggtcaaatggcattttggaccggcgatggtacatttagcaagtttagtggtctaattacacgatttgcaagttaatggacctggatgacatccgccctcaagtttaagggccgctactgtattttactctagtttttttaatcctaactactcctactaatgtaactaaagttaattataagtggtcaattaattgtagcaaactagccatatatgcatggatccacacttctttagtcttggcacacatacttacgttaccttcctcatactttctttagcaacttgatgtttaattttctggcctacatatccatgtcacattatctagaaaaaagcatatgtctgggattacctccgtcccaaaataaaaatatttatagactagtctaacatttttaactttaactattaataaaataataaaaaaatacatcatttaaaattgatgttactagatttatcattaaacgaactatcataatatacaactctttttagatattattaatcaaaatagcatatcgaaaactatgtcgaaataaaaaatagttatattttgggacggaggaagtagctagcaaagcatatcctttttacacacgagtgtgtccactaggaaaaaaaatcaggcaacttgtgtgcgtacaggtgatgacgctctctctcgtggcacgatcttctggtgagggggataactctcgctttgatcgagtgcgacgtttgcgatgtggctaccaaccagaacaaatccaggacgccgtgcaatcgctacaccacaaacgatgtcgtaccaaccgtgacgcgcggttgatgatccctacaatgcaaacgagagaacactgcaagaacaagataagatgcaatctaaatattgcgaatagggaattaagcacaaaggaatagttgcgattgaagtggtagatctaatcgacccggcaaatcaacacactaactattgggggctctgaatctatagtcgccgactaatcgagcaaggactagagacaaggtgaatggcacttggcaaaattcaactaaacaaaacccaattgtttttgaggatgtacaaagttatttatagaggaaaataaagctagggttaagtgctaattcgtggaggtggatgggtagtcaagccaagcttcttgaccatctcttcacttgctaaattgttgcaactcccgctatcaataatcattttgacggtatggtctttcacaagaactttgctttggaacaaattgtgacattggttttgctcttcacacttctctttagcactaagtgctagcttgacaattaggctaggatactgatctagcgactctggatgcaaatggacttcctcgatgtcatcattatcttgtcctcctgcgtggtcagtggcagctaaagcatattcatcatcacaatcactagtagaagtatactcaccatcatcattcacaaatagagctcgccgatttggacagtcacgtgcaatgtgtccaatgccatggcacttatgacatgtaatatcacgggtacgtccagtggaagctactgaagttgcactcttggctggagtctgaactgaagcgtttttgcttttttcttgagcattggatggcgtagaagtaggtgaacgaacggcagtagtagcttgacgtggtgttgactgtcgtgtggaagtagcacctgcaaaagaacttctatgcttgttgcgtccctgcacttctctttcagctttgcatgcaaaatggaataatctattcatggtattgtattctttatattcaagaatatcccgaatctctctattaagacttccatagaacctagaaattctagcatcctcagtttcttgcaaatcacatcgtgacaaagcaatcatcatctcttgatagtatgtttctacagaattggaacattgtcttaaaagttgcagtttatttaacatgtcacgagcatagtaagaaggaacaaatctagacctcattgtacgtttcatatcatcccatgttctaggtctaagtcctctaccacatatattattccaccatagagatgcaaaggaggtaaattcactactggcagctttaactttcttattatcaggaaaatcatagcaagagaatttttgctcaacagctaa

SEQ ID NO: 92557 - DNA, 968 bp, Oryza sativa
taaaatcagacagctctttatttattactacctccatattttaatgtatgacgccgttaactttttgtctaacattagactattcgtcttattcgaaacaattatgtaattatcatttattttattgtgacttgattcatcaccaaatattctttaagcatggcataaatattttatatttggataaaaattttgaataaaacgaatagtcaaacgttggttgaaaaatcaatggcgtcatacattaaaatacggagggagtaatttgtaataaaaatacacaccggatacatatatatctgtatttgtagatactcaatacgtctgcatcatgacgtacttattgcatccaacacactgatcatgcatacgcatgcagatcgatgtgcgtacatatatacatacgaacatacatagtagttcgtacatatatgcgcatatatatctactgagagcagaaagatttatacgtacaatatatactagagtagtagcaaaatatattccatagcatatacgttacgtacgtacgtatacgtatacgtatacggtagctagtacggcctctggttttggacgttgccggcggggaagtaggtgcagatgaagaagacgcctcggttggcgttgcaggcgacggcggcgcatccgacggcggtggtgtcgcgccacacgacctgcgtgtagtggccgcacatggcgccgccgacgcagctgttgctggcgtagtcgtaggagcccttctccgccacccactggtcgacggagctcgccgccgtccacgcctgcacggaggggttccacgacaggttctcgccgtactgatagttgttgcgatcggagtgccgcagcgcgcagtcgccggcgcgctggttcgcgtagccctgcgcgtacgccgccaggttgtcgtcccacgacagcgccgggacgccgacggcgctccgggcggcgttgtggatgttgacgat

SEQ ID NO: 92558 - DNA, 805 bp, Oryza sativa
cattctaccaccgaaagtgcgtcacacgatcaaacctctatgcgccttcttcaatgcaattggacagaagggtatagatccagaagatctagatgggttgccgaccgatattgtgaataccctctgtcacctggagatgtttttcccactatatttctttgatataatggttcatctccctgttcatctggtgaagcaaacaaaactatgtggcccggcttttctaagggaaatgtggccatttgaaaggtacatgggagttctgaagtcgtacgttcgtaacagagctaaacccgaggggagcatcattgaaggttacacgaccgaggaggctattgagttctgtgtcaattacatgtccgatgccgatcctatcggagttcctgcgtctcgtcacgagggaaggttgtcaggtgttggcacaatcggaaggaaaagaattaggcccgatcaagcgtcgtacgtgcaggctcattacgctgtactccaacatatggcagaagttggcccatactttgaggagcacttagagaaaatccgagatgagaacttaggacgatctaatgcatggattaacagagaacataattcttggttcaacgaatggttcaagaatcgtgtgacaatgtccacggatgtcccaaatgagacagtacagttgttggggatgggaccgtcttggaccgtagacacatggcaaggatacgatataaatggatacacattttacaccgtcaaacaagatgacaaaagcacagtgcaaaacagtggtgtccgtatagatgcattccaggatcaagttggg

SEQ ID NO: 92559 - DNA, 4949 bp, Oryza sativa
gtaaaagtttcgtccacaatgcatgaaaaacttaccgagcccatatgatatataatttttttaaaaaatcgctaaatctatcgcaggaaccaacgagctgcaccctcacagttagggtgatgccgaccttcacggttccagcagccgagggacttgcgtacaagtcgaccccagagacaagagtgcatggagcgcaactcaggggcgactgtgcaaaagttcaagtcgactcggtgaagccggaatatgagctattcccactaaagtatccaccgaacgacgaggtcctctcactaggaaatgcccgtggtaccttcatccaatggcccaaggacctcattgagatcaaatggcccaaggacctcattgagatcagggttacagcgaggccaaccactgcatcaggcagtcgtccaccaaagagacccgcctctgctccttcagcccctcctgctcaagatcgtcatgcacaatcttacgatgtgcagttgcagtacgacacggattttggggatgaccgaacggaggccgacagcaaggcgattcatgaacccccaccgatgaagaagagcgggaaggcacactcttcccctcagagaattactctcgataaacccaaagcaaaggggagaggaaggggaggaaaggtgcagtcctcgcttctagctccaagaaagctagatctgggcaagggccaggaagagactaagggcaaagaggtcaagaagaaatacgtcgctccataggggttccaactaggcatgccattggttggagatgacgtgcttgccgcaatgggcaccgcttgcaaggaccttcacgcatactacatggagaaatctaacgccaggaagccgaataaagctactgatatccttggagagcacgatggaaagtcattccttgatccaacaaattatatcgtcgtcgacttcaaggatctattcgacctctacagactccgagcggttgacacaagcctccttaagtgctactccttgtaagtattgtcgcccaactcaatctggtaataacaatcggattaactagcttacaagatcgtttatcctgtgtgtaggttaagttggcaatggtgtcagaagaatgcaccagaagttgccttccatgatccacaagtggtcactgtcacaaatctccagaatgaccgtcaaggaatgatcaactacatctacgacaccttgtggtcctgccgagacaaggagtacattatgtgcgcctataatcaatagtaagtgtgttatctaaatatacacaacagcatgacacattccttcagtacttaattaactttcactatattaatgccacagtcccattggatccttctggtcataacacctaagtggagtaaatgtcactacctaaactccagaattgataagaacgcatatgattggaccccaattcaactagcgatagatgaagcgtgggcccaatacgtgcaaagaggaggcctcaggaagacaggacatgacaccctcatccacaaaaaagacttcctggtgaagcaacaaataggtgaccagtgcggattccatgtgtgccacaacatgcgccttctgtacagagaaaaggtgaagactttggctgagtttgaggtcggtggtctcaattctgatagactaactacattttagtacttatatatgatcgatcaactaatctagaattatgataatgtagggtacaataaccaagtctctgcctaccagctttgaggaggttcgcgaggagatagccagcttcatcctccgcgaaataattaacaccaaaggaatgtttaggcttaaactaaaatgatgaacaatgttgaacttatatgtttaggcaatgatgaacacttattatgcaactgtgatgatgtaactgtgatgcttatatttatgtatatatttcatatgtttatgttaagacttgctaaataaatatttgatccaattaacttggttttgcaggtgaaatatgataaatatttgaatggatgtgaaatatgtgaatagatgtgaaatatgagatggctgtgaatgtgtggttgtgtaaaatatattgatgtctgtgtatgtgaatgcatatgtatatgaatgggtgatgctggggagctggggatattggatatctgtgtttgtttctgtcatttctgcagtgggcatggctagcaaaggcctgaggctagccaaaaaacaaaatttattttttttatggattatagtcatctgtgacgggccataactaaatgcccgattgagatgatagtcatctgtgacgggctctagtttacgcccgattgaggtcagtagtcatctgtgacgggctctagtttaggcccgattgaggtcaatagtcatctgtgatgggctctagtttaggcccgattgaggtcagtagtcatctgtgacgggctctagtttaggcccgattgagatgagtatcatctgtgacgggctctagtttaggcccgataaaggttagtagtcatctgtgacgagcactaattgtggcccgattgagataggtcatctgtgacgggctatagtttgactggtcgtatgggtcaaagctatcggtgacgggctttacttagggcccgattgagatagattcatccgtgacggccgtttgcccgattgagataactcttcacatcaatgacttctagcctgtgacggacgttgtgcccgattgagatggggcttaccgcccgattgagatgagggtatccgttctagtgtatcgcccctcccttaaacataggggagccaaggctgattaaaaggaatcaatcaaaagtgtttgcattggtcatataaacatcctctcaaaagtaagtgtttgcattggtcatataaacatcctcaaaagtgtctctacattggttgaaatgtctcaagaaaataccttttatatattaggcataaaagatgcctctataagataaagttaataaaatatgctaaaaatatctctaaagtatatatagagtaaaaatattatatgtaaattttaaattgtttgtactaagtgtctctgcacattgtaactcgtaattttagaggcaatatgaaaattgtcaaaaacaaaaatagatgatatgaaaattgccaaaaataaatatgtatcttcatggtgaagcgtagcttaactggttaagtttcttgtgacggaaccagtccacctaggtttaagtcttagatttgacacaggtgctcgcatttacagctaattattcttttggtggtaggcgacccgtcgacagcgagatgcctatgttaactttatctgtaccttaagatacgctggcccatatgggtatagtgttttttcataaaggtgagtgtacgcgtattataaatgcctgcatttgtactatatttaaagaaaatgtttttacatggggttgtttttagtgcctgcatcctccgagatatgcatcttgcacaacacttaatgtagtaatacttcaaatcttttgtattgaatgtagtggtttaatcacataatccgagatcaaccagatgtgtcattatggacaaccatcgaaacatcagttacaattctttaagaactggctacgccgctgattctgaaggctcacctcaccactgcagcatgtcttatgaagtatgaaaaatcaaacggaaataatgaggaaaaaaagacaaagacttctcacaaatgatgcagccacctgtgtttttagtgatatagagaaaatatacaaagtgttatcaacacttgctcatacaaaatgccatcgataaacatgagttgtacaatatacatgctatcagacaagtgtatatatttactttttgacatcaccattatcaaatttatcaaaaaaaattaaccaatttttttgtgaaaagtatgggtaaaagacaaaccatcacaaatactgaacttttaaaagttgtattcttttagtcatggtataccaacatggtttgttcttttgcaaactatagttacaaaaaccttccatattcgaatatctaaaggaatagaaccattcaattcagcaattttcaaaaaaaaaaaaacaaaaagaacttcccgtatatgaatttcttagaaaacttatttaaatacatttttctatcttataacagttagtttatttgtttgtgcccatgaatagttatcaaaaaccaactatctatggagcctggtttgcagtataaatcatgcatggatccaccagatccactaattctcaaacatggactcgtccgctaagacacatgcagcaagttaagtatgagtacataaagtatgattgcgagacacatgttttgctagcgaaacaacaagatacaaacttgccacacagcaaaaagttcaaagctcctttcccatataaacaaaacaattttgtccatacttatcgcataaactgacacacttgctcagtgctgcccggtcgctctgtccgggggcgacgcgggcggcgaacaagccgcgccgtccccgcccttctcttccccccccctcccagcctcgccgccgcccgagccgccgccggcaaagccaggcggctgcaagtacggcggtggcggggctctctctccctcgctcgcggtcaagacggtcgggacatcggcacggcaggagctcagggcatggcgtcggcgccgaccggcggcgtccagatccagtgccgtggtgcccggatccggtcccccagcgacgggcggcggcgtcctggtagctcggcggcaaggtttggcggtgggtttgggtggtcgacctggcgggagacgctgccggagctggctccagtacccgagcacggcggcgcggccagacgacgggtgcagcggtggaggtgccgagagaacccgtggtgacgtcggtgatgcgggaggaggcaacgacgcctctaaccaaatctgctggcggcggttgcggctgccgacggcggcaatgac

SEQ ID NO: 92560 - DNA, 4459 bp, Oryza sativa
aatgtggcgaccgtggacgtggctgtggcggagcaggtgaggatggcgacggcgaggtagctgggcgttcggcagcggtggctgcggtggcggtgaccacggtcaccggaggcatggcggcttcggacggctagctgagggcgtggcaaacggctgcttctggctggcgtggcatcatttggaggaggggtcggagactggctcggcgcgagaggcgcaggcggcagagatggaggctgggttggcgcgagagacgtagccgatggagagaggccggattggcgcgagagacgcatccggtggaggagaccggcttggcgcgagaggcgcggccgacggtggaggaggcgacctcggtgtgaggaggagctaccggtggatgtggcatgatcttcggcgcacggagcctggccggcaggggacgctggtgctggggtcccacatgtcggcagagcttgagtggtggtggagcatcggtgcgtcagccatggattcgcaggtggtgagcggcgggtgaaaacctagcctggccttagctggaccgacaacgattgttcattccccctcttgagggcgttgtcgtgctgtctcacccctcaagagtggttgccgggcgaaagcccagtcttggctcctttgagccccgacggacggcagcaacggtttttccgtcgcttctcttcttgaagacgtcgttttggcatcccctagggggcaatgttgtctgtgttcctttgttggtctagcggcagtcggttcggtgctagccttctcccgggttgtgtgttggcgctgtcggtgtgcgggtggtgctatattttttcatttttcctggttacgatccgccagggttgtaatcttgtaattttttcctgctctatcaatagaacttcgcaccgtctcgtacgagtcgttcaaaaaaaatacttatcacatcactctagctacatcgtcactctagctatgtggtgccataaatgtgcccggagatatgctcttgcttgttacttagggcttgttcgaagtagcatgttcggttagctaaatgaccatatgcaaaacgagacgaatcactagaaaataactaattaagtattaatttttataaacttaaaaaaataggtttatatttgaattttttaaaaaaacttttatataaaagttttcttttaagaaatcacaccgtttataggtttacagtaaacgaggcagttgataaaaaatctaataatcctcatcaatatgttttgtagtgaatctggtggtttattcgtgtcatcatggaaccatcggaagttcggaacatcacttacgtaaactcctttactaactggctacgtacgcgcgccggtgattcagcagcaggctcacgcacctcacccctcagagcatgcgatgaagaatcaaaaagcaaagacaaaaaatgggagaaaagacaaatttcttcccacaaaacgctcacagatcttttgccattattacttttgctgactcttttcaccgatcgagttcctctcttgctcctaacataattcctcggtttcatcggagcagagatcgaattctccccaaatcctcagctcgcgtagtctctcacagccaaattgttgctcgtacgtgaatccgtttgtttgagctgaatctcctttctgcatcatcatatcaaatcccctttcgatcttcatcttcctgaatccgtttgtttgagctgaatcccctttctgcatcatctaatcccctttcagcatcttcttgggcatcatactgttcttgtccatggctgcgcctgctgagaggagatcggagccggactggagctcgggcctcccacggaagctgctcgagttcatcgccaagaagctgccgtccgggcgcgacgccgcctccttccgcctggtctgctcgccgtggtgcgccgcgctgccgctggagacgttctacccgatgctgatgctccccttcgatccggactcaccggacggcgacgccgccgtggtcaccttctactgcgccatggacgacgacgacgaggccaccatcgacctgcgcctccccgaggtacgcggcaaggtcgcctgcggcatgtcccacgggtggctggcgctcatggacggcgccgcggccgtcacgctgctgaacccgttcaccggcgccgccgtcgcgctcccgccggccgacaggaacgtcgccatggcgtcctacaagacggtgtccatggtcgacggggcgtggattctgcactacatttctggtgccaccaagcccatcaagttgagcaacatgagggatgtcttcttccgtgagatcgtgttgtctgcgtcgccaaggaactccagaggtgtcgattgcatggccatggccgtgctcgcgagctcgacgttggtcgccttctgccggctcggggacgccagatggacactggtagattcgaagctcgagtacccagtgacgtgtgtggtgcactgccgggacaggtttgtcgcgattggctccctcggagagatctcaatctttagcgtcgataacactgatggtgtagctcctctcacggcgagcctgttgctcttgatgcctccgccggcacatatctgccagcgtagctacatggacataaatggcgagttgtacctcgtcggcgccattttacgggtcactacctggacaaggtatgagatagtggtctacaagtgtaacctcctcgatgagaatccgttgtggtccaaggttgaagattccgaggacattgcatttttcgtgtcgaagtacttcaacactggttttggtgtagcaagcacctccaacattagatggagctgtgtttacttatctgaaccgaggttctgtactcatgaagatcaaaaatgcacagttgatagttatctggaaatggtcgatattaacactaatgaatcagcattgcaagcttaccgccccagtattcagggtttaggggctctatgctggattcgtccgaatctctggagttgaggtatgttatcaaatcaaatatggacatatttgcctttatttctaaaggaaaattgctctataggaaatggatatgtttgcttcatgaatttaaattcagttgatctgcttaactaaatcaactattttagcatcatgggagcgtggacagaagaaaaatgtagaaatagaattcatcttctaggattcctgaaatattgagtttactggtgtatcacggacttctcaggcggtagggtgttttctgcccaagcccaaattaaaatcatttttttaatctagcaaaagaataattatatttatcaaaatctgttctgaaattccagaatttaaatattcttattgtttacaggaatcctcatcaaaatatttttgtggattaatttgttggtttctgattatgtgtaggtgagtgatgctgaaaacagcgaaagatcagaagagaagcatgcattcgcagtctgagacagagcacaatgaaagtccaggactgaaattatgcaatccaagggtagatcatcgctgcttcatccaaggctcggtttggagggctcagtttcttttaatcgcacatttcgtaatcccttttaataaaccaaacttttcctttttgtcatcatgagaggagtatccttgatagacaaatggtgattttcaagcatgcctgtaaacatttccagggtctatttaattttggtgccaataggatttgtaaattttgaagattgctatacaacttctttcagcaggattttgctgctagcagattccattgtgttttgtctgaaatgcatttgcttttccattgttttggaaaaatgcatattttgattgagctgtataccaaggactgcccagaatttgtgcttcacctgggcatatctcaagagcttaattaataattttactggagaagaaagaatgcacactgtcctttgtcgatgtcattttgaatgtgttccatatagagaatggctgttcattcagcggagaaagagtctcaaagatcaagtggaattttgtatggtgagcagtaagattgaatattgtatatttttgtccagagatagttgttgatattgccttttatgatacatcagatatgctactttatcacccaatgtaaaacatgcaggggagattctatgtggatttgaccctatctccggagatgaggtatgtgaccggttattccatgtggtttgcaggtcttagggtttatgcatgagcgtaatcgaatgtacacttgtttgattcatatacacaagccagcggccagctataaagtcagacatgccattttggttggatcgaccatattatacccgatttggaatttaatttattggtattcgagccaactatgaaatatgaatatatgaatatagagaacataggtgaatggttgacaaaggtttgacatttatctacccaacatggaacacaagacatattcctctataaacgttca

SEQ ID NO: 92561 - DNA, 1342 bp, Oryza sativa
tcactaaattgtcagctaccgagctaattggtttgtggcgaccttagtgaatattttataactgacatttaacaagcatattggtctatattgttggattcgatttgcttcttcaactttcggaataagagtaatccccccaaagtttagaccaaaaattggaaggctgccagagtggaatcctttaaataatctcagtagctcatgcttaatgacttcccaaaatttttggtaaaattcaactgggaaaccatgtggtccaggagctttattatgatccattgcaaagatcgcttcctttatttctttctcagaaaaggagcagtaagaaagtcattttctgcttgtgtggcctgagccatatcctcagttatgtgctcatcaagtgaaaatgagttttccgctggcggtccaaagaatttcttgtaaaaatttgtaatgtatgttttcaacgcctcaaccccctcaatttttccttcatcctgatctaggaagaagatccatcttcctatgtttgccattggcaatcaagttaaaatattttgtattattgtctccaaggagaacgtctgagacttttgagcgttggtaccatctaatctcctctgcacaaagtagtcttgcaagattatccctcgattgatcaagaagatttctttcttgatccgaaaggagtcacacctctgcagcgatatctagttcgtcaacggtccgttgtagatgagcttttttctatttaaagataccattggtatgagcagaccaacctctcagatgtcggcgtaaagcgctcatttttttattccatcgttggactgcattacgacccttgattggtttattccaaatttcgacaacacgatcatggaaatcgtcgcgcagaaaccagctaagttccatcttgaactgcttaaggtttccggcaaaggccgcttcccctgtatcaaggaacaaaggcgtgtgatctgacacccctctatctagtgcatgaaccgattccatagggtatttggattcccattccgtggaagtaagaaccctatctagcttctcatacgtcggtataaggagcgagtttgcccaagtatattgcctgcctgttagagcgatctctcttaagtcaaagctatcaatcacaacattgaagagaaaaggccagcgagcgttgtatcggtcattgtttatttccgcactacttctcaaaatgttgaaatcccccctattagagtggggagatgattatgctggcacgtgcgaactaactctgccaacaaactagatttaaaatcatcttgggccggtccatacactcccatcaaaatccatttaaagttatcctccc

SEQ ID NO: 92562 - DNA, 3317 bp, Oryza sativa
  unsure (1)..(3317): unsure at all n locations
tcctgcagccccctttggaggagttgtattttctgagttccttgccttcttatgcacctgatcatggtgaccatcccttgatgagtcatcttgatcttcttgtgtgtccccatcatgatccatctgatcaacctccataatcttagccggacgaaaactctcattttccaaagcataagtgatagggtatcccaactttccaaagacaacatccgttgtgatcggcaacactacactgctatgcatgaacaccttcattctaatcacccccgtgcgtctgtaagtgagcatatcaacctcctgtgtagccccaatgacacaacctaatgcccaaaaggccaagtaatgatgccatggggcgggcacacccgacacatgtatccacacctcatccaattcatatgccggtatcacatcatcaggagtcttccactcaattattgtcattgaaaccccgtgattctttagacggaattcaacgtcatccatcctctttaattcctcaaaagaagggaaggcgacgaggaaagagttgtcaccatgagggacagcttcccacttccagtccggccttatccgatgagctagctcggcctgaactatctctcgggacagcacgccaccgtgaatggataccaatgccatgggagcagttgagggtgattgcacattcattccaaagccactaatttggagaaaaccaaactcggttttaccgaaaccaaaaagtgagcatgtgggtttcggcaacttgagcactggacacttcgttgctagatgagaatccttcttgttgcaaatgtagcaatcaaggtccgctttgcatacctgcgccatatggccacttgttttgcacctgtgacaaacaggcggtctcggtttctttgctttagctgtctctacttgctgcgttggtatctccctctgttgttcttggtttgtcggcaccggcgctgtgggtggttgtaccggtctaacttggagggcagtccgcgactggtctccatgatcggcggcccgggattggctccctgatggaacttgctgaaagagtggtgctgcccttgagcagcccctccttgccagcgttgttgcctccaaatcttgggagatgtggacgctggaactgctgtttcctcacgacgttgcccagccatcgccgggtcgagccgccattgccgcgtacgagagtttgccctggactggttttttgggtagagattgtggtaccaaccaacgaatgcgaatccgaactatttcgatcccaccaccgagaggcaggggtcgggaagccaatttcctcccaaaagttgtcaactaatagtagagaatcggaatctcctgtttgagaggcagttttcatctcctcaccttcaaggctagctagtagccaactaccgagtaactgttctgaagcagggaaaagagacgtgctatccatggtcgaaagatgatcaagtccagacccatgttcttgatcgcacccgcttggaaaagctacaacgcccatcctcaaaaacatcagataaactatgtcgacgagaaggacgccgtgcatcacctccatcgatttgggcatcacgtgcaacaacagcgcagggcttccggcgccgacgccgatgacgagaccctctccctggactgaaacacgatctctgcctgacagggagaagaaagagccgccgaggaagacgatctctgcctgatacgttttcgtgattaggatgcagcgccgatgagggcaggaggcatctgcacagagcgtggatggcggcttgaaacagtgcccgaatcctgttactgaataggccagtgccaggagacaggaggaggatccggcgcctccgccagcgaagccccgccctgaaatcgcccaactatcgcccctccacaaaactcgggcattcaaatagatgaatactgtatgatatttctcatgttcggaaactatcacttactccctccgtccaaaaaaaaaaaagacaaaccctaggttttcgtgtccaactttgacgtgccgttttatatgaaatttttttataattcgtattttcattgttattagatgataaaatatgattaatattttatgcgtgacttgtctttttaattttttttataattttttcaaataagacgaacggtcaaacattggacacggaaaccagggtttgtctttttttgggatggagggagtaagatgttgttctttgtagattcagtatatatgttgataacacccttccctgtagtctcctttcgacttgcaatatatatggttgaaaaatgcccccattttattgtgttccagttcactaaaaaagttatcacctactgtgatgttnnnatnnggtacttctgatctatattcagttcatgtggannnnggcgcannntgtattgtttgtntnntgnttttgatatgaaatgatgtacgtaaacaggtcaaatgaagtaccgaaattccgtgctttttnaannatttnncnanaagaggttncccatnncgnctggtnnanananaggnnncnnccctnngncnantnaanaantngnnccaangggnggnttnttnggggatggtatatgcctctgaaaataggacttttgtgcttgttcagtatgttgcaacttgcaagaaaggaattgccagccaggctatattttctcgttgttactttatccttggaaggtaccaaacaaagtgaattttgcttttctgcatgtctgaaatgtctgttaaatttcatgacggaagtttaatccatatatatatggcgaacatacactggcttgaaactaagcattccgtttagtcttgtgtgaaagattgatgtttcttctttcatggagctccattattgaatcatataatgttatgtgaaatattattgtttcttcttgcaaatggagatccattgttgtatgtaccatgtattgttatgtgaaagataaagcagggaccaaagaaaaatactttgttgtgtaacgggttcttttgcatgcacctaatgtttgtaatggttccgttgcaatgcacgacgacttttttctttatcttttgctttcatttttttatggaaatgggcaatgtcttcattttccattatggattttttaacaacaaagcttggatgccaatgcccatctctttttttggggtggggtgggcgctcgtcattagcgctttaatgacctgtgctaatcacattaattatgctaataaatgaatagttaagttgagaagttttgtaatataaaatgaaagtttcccttatcggataacttagacttgaaagtttttaaaatttgagttg

SEQ ID NO: 92563 - DNA, 835 bp, Oryza sativa
ttctgtcaagtccgcaacaccataccatgcatccctgcacacgcggtgatttacgtgttcagggggggtgtgcggcacaaccgcatgctcgaaaagatcgcctccaaagagccccagactaccgcggagctttttcagctcgcggaccgagtggctcgtaaggaggaggcatggacctggaacccctccgattccggtgtggcagcttcggccgcccccggatccgctgctcagacagggcggcgtgacaggaggaggaagaagaggtcagcccattccgacgacgagggtcatgtcctcgccgtcgagggcgcttcgcgggccacccgaaaggggaggcctgcgagcgacaaaaagagggaggccagcgctcccagcagggagcgcccaaccggcaagtggtgcaccgtccacaatacctcccttcacgacctcgcggactgccgcgcagtcaaaagtttggatgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggttttcaagagcctggggccaccattgccactgtcgatggaggagcgtgtgctcacgtttctcgccggagcctcaaggccatgaagcgagagcttctggccgcggcccctactcatgaggcgacgcgccgggcgtggtggtcgaaggttgccctcaccttcgaccagaccgaccacccaccgtgtgttgcccggggaggacagattgcaatggtggtttcccccactg

SEQ ID NO: 92564 - DNA, 1183 bp, Oryza sativa
tcctgcagcccattttttacaaagagtttcaaatctaactcctgattagacaacagttggacttcagccttcttttctagcttgtctgctttgctatcaaaagaaccttctccctcttgttcgccccgctaacattcttcgcccaccctctcaaaaactgtcagagcctacgaatcttaaattgccatttttccaacatattagaccctctactttcctttctccaaatgtctgctactagatccacaaagccatctcttagcaaccatccaagctcaaacttgaacaacagttgtttattagcatgtgtcccagcccccgtatccagcaacaaaggagtatggtcagagagttctctattaagagccctgacagttgctaacggatacttttgttcccattcagtactcattagcactctatccaacttctcaaaagttggattgtgcaacgagttggcccatgtaaattttcgaccagagagttctagttctctcaaatccaggctgtctatgacagcgttgaacaaaaaaggccactttacattaaagttattattattcttttcactagccttccttatgatattgaagtctcctcccataagaataggtatagactctttattacaagcattaacaagctctacaaggaaagcctccttatattcttcttgtgttgccccatacactgccagaacgcaccattggaagccatctaccttattttgcacatggaactttacatagaaatctccctcatctatacttgcaacctcaaagaattccaaattaacccccaaaagaatacccccaggtctccccttcggtcttgtccaatgccacataaaatctttaccaccacaaatattttttagactagaatatgaaaaatcatgttttccagtttccaaaagagtaatgaagtctagcttccactccttggaagtctctgaaaggaatctaaatttagccaagtcacctagatctctgctattccaaaaaattcctttcatgacatacttttcttatttttcaagatcactttcaccttttgtcccttgtttcttttgaagaatgacttggacttataaaccttgaaacccttttttaagtcacaacttaggtgatcgggttcttcgtccataacttcgtccactaagccaccacataagtgaccaagg

SEQ ID NO: 92565 - DNA, 1404 bp, Oryza sativa
tcctgcagcccgacaaaattgaaaataacagtaatggtttacagccaaatatctctcttttcaagaaaatgtatccacctcctgaattatgagttgtggtgttactatgtagaattttctacacttaatcagtccatattgcctacccagaatctaccggagaatttcttttccatgaattctagatctaccaggcaatattttatatcaaaagcatagtgatactttcatattccatgaataaggacaagtaccaagtaccttttgtcatttgtctccaccactcatctatctgtttgcctttctgaagctgatcactgttcaaatgctctctaattgaagtgttgaaagaccaaatccgcaaagtttggctgctacttatgaaatcaagaagaatactttgaggactgatattatttggatcaaggctcttgtcttctttgtggaacgaaattatcttccttgtagtttcaacctggtaacagaagaaataccagaatggtatatagagttatagacggtaaattaagacaaccacaagacatcatgaaaggaaacattagaagtattaccaaaagtttgtatgtatttaaagttttatagcaattggatgtgagattagtttagctgagtttgtcgatcgctgttattacttgttagtccttgcagttcccaaaagatgagcacgaaacaaaataaagcactctgaatattttcatgaggaaatctttttttggtaccaaaatcatgtcatcaactaatcaattgaatatgattcaccaaaagaaagaggtgtttgcagatgatcttagaaagagacatcaccttcttgggtccgaactaagggtgttcatcacaatctcaatgcggataatctgtgcgagtaaccaagtgacatgattactgcgaagaatctgttgatcactatttgttactcgagatgcaagcttgtccacgaaatcaagaaaatcaatacagccacttttcatcagaaagaaaaaaatgtcagcaaataaaagccaatcttgccagcactgagtctctgcaacagcataaaaaagaaagaatgaatataggcaacagacagttaccaaagacttgcacatatctgacaataatggtaagcaaatttaatttcttgaggtaaaagtttcacgttctaaaagaaaaaatagtgaaaagggtgcatcaatagaacatttgaaatttatattcccatcagctgtccacttgaaaaaggaactttattatattgacaaggtaaatggttaactttcaaattctaacctgagttcgtgagcctcagtagttcaattgtcctgtcagcaactgcctcaccgatcatatcaggtgagaaaacagctcctggcgttgatgattgttgaggatgttgtctataacaag

SEQ ID NO: 92566 - DNA, 4607 bp, Oryza sativa
  unsure (1)..(4607): unsure at all n locations
ccgcgtcgcgcctgttcccggcgaaagtgaaggtaggtgcgggccgtcccatcagaaggtgactcgaacggcaaccatgcaaatctccgtccatttatgaaaaggtagggtaagtccccacagagagggggggatggtgcatgtggtatccccttaagatataaaaggaggaccttgcccactgagagagggggagttttttcttggactggacttttccagattaggaacccagaacaagggagaggctggctcatactttgtagctccttcacacacgaatccaccaaaacacgggagtagggtattacgcttctaagcggcccgaacctgtatacatcgccggcgtcttctgtgcttcctatctcgcgaaccttccacacacagattgggagcttagagtctcacccagggtccccggccgaaccggcaaaggggggccagcgcggtctcccggtgaggagccccacgctccgtcatagttagtccctatattaatttagcaccaaccagagtattaaaggtggtcttcagcgggtccaaacaaaacgggtggggctaattggctagcgtttgcgggctgtgagcctgtgaatgggtcccaacaacctagcaacctattagccccaaatctcctactctctcgctaccttttagtcttcccattgtgccaataaagaaagtcttcttcttatgttgattatgaaatatgccaagagtgacctttcggctttggcggtagagtaggatcaggacgtatggcgatggcatcgacaatggcctctctttggtgaactccctctgctctcccttttgcgcgaggtccaaatcagaaaaaaattcccccaaggggncctttnttnttggattttcctcgccttcttcgttgccaccacctggcttgtcggagccaaaaggcatcaacgtgccgccgcagctccgcctgaccagccttctacctatcccctgtgccgccgcagctccgcccgacaagtcttctacccatccctttgtcctttttcctctccttcgaccggtccacgttagaaattgttgtatatggctatctatttagatttgatggggtaactgtaaaatttctaatacagtaactggggcagcagattcactatcaccatcactacattattccttcttctaaaggagtatagatacacatgcttcttttaagaaattgtagaactctcgaaggagtatagacatacatgcttcttttaaacgaagaaattaagaaattatataagtcgagaaaaagaagaactgatttcttttatggtataaaccaaaacatagtaaataccccgacaaagaaattgaggtgtggcacaattttacaacgaaaatttttgattggagaaatacgtgcttctgttctgtgcgtggcctaattggcacacctgaacgcttgatctcgagttggacggccgaagatttccagtaaaaacatgccttgaataggtcagggccagccaaacccggcccaaacctcactttatccgagagcccgtcgtctcttccaggcttcaagccatctccacccccaaccaaccccactgctctgctcttcgcgcgcctccaccgccgaaccccatggccgccgccgccgccgcgggggcgacgccggcgacggcgaggaaggccctgctcacaacaaccgccaccctcctctcctcctcgctcgcgcgcagccggcgcagcctctcctgctccgcggccgctgcctccgccgccccgcgcatcgcgcctcagccgccggacctgctccgatgggtgcagcgggagggagggttcgtgcaccccgccctccgcgtggtcgaccatcctgagcacggcctcggggtctccgccgccgcggccgagggagacattccccctggcgacgtcctcatcgcgctacccggccgcctccctctacgactccgccgccccgccggcgctgcggacgcggtcctcgtgcagctagcggaccaagtacctggtaatggctctcctagtcctggctcagattttcaattacctctgttagtcacgttgtggaaaccagtgtggtagattcatgtttgtgaagagttgctaatgcatcaaaagtaagatctatttctatataagaatcaggagcataattggtattgattctgctgttgacgtcggatcaattgaactgacatcctcctagtattgcgttttagttcagtagcaattttttcgccagcgcgcaaaagctttgcacgccaatatattagagttcagtagcagttgggttttacaattttgagaaatgcggttgtcctgaacacctaatgtctaatggcgaatgctgttttctcgtgttaaattgagtaagattgagtcaggttttcctataatttacgctacacaacctaatcctttgtgtagctaatgttgtattttgacataattgctgcacgatggaactattctacatgtgcactctatgatcctgccctcttttagtgtatgagggactttacattctagaaaattaggctaagtacccttcagtgactaacaaattcaatcctgcgggaagcatgtgacagaggaactatgggctatgcgactgggcttgaggctgcttcaagaaagggcaaaatctgattctttctggtggccatatatcgcaaatctgccagagacttttactgtaccgatattttttccaggggaagacataaaaaacttgcagtatgcccctcttctccaccaggttgttataaattattgtagttcttattgcatttcccctcttcttttttgacttattatatttcaggtgaataaaaggtgtcgcttccttctcgagtttgaaaaagaagtgaaacataagcttggtacagtgcccttggaagatcatcctttttgtggacaagatgtaaactcatcttcccttggatgggctatgtcagcagcatctactcgggcattccgtttgcatggtgaaatcccaatgctgttgcctcttattgatatgtgtaaccatagttttaacccaaatgctaggattgtccaggaaggaaatgtggatagcctgatatgtcagttaaggcaagtatcctgaattgtttgtgtacttctgagcccaagaaattttgtatttccttaagacaatttttgttaattgaatgccctctgttagtagctttgtttatgcataacagcataagtgacatgtgaatgcatttatttaactgaattcatggataaatgtagccttttatgttatcttaccatagatgcaagtaactctgaccaccttgaccttgcttataggttgttgctgagacaaaaattgatcaaaatgctgcggtaacactgaactatggttgctaccctaatgatttcttccttcttgattatggatttgtaataacatcaaattcgtatgatcaagtggaactgagctatgatggaactctcctagatgctgctagcatggcagcaggagtttcttcgcctaacttttcagctccagccaagtggcaacaggatatcttgtcacagctaaatctgtatggagagggtgctattctaaaggttttgcacacattcttactgatcctatttattttttgcaatctattgttgaattcaagtcgtccagtatccatgcagcaatctgaaccttcttggttttctgtgggtatcacttgtaatttcttttcaggtcagcataggaggtccagaaatagtagatgggcgcttattggctgctttaagggttattattgcagctgatccggacgctgtgagtggccatgacctcaagactttgatgtctcttaaggagaaagctccattaggcccagctgttgaagcttcagcactccgaactgtccttgcactttgcacctttgctctacaacacttccacacgaagataatggaagacgaggccatactaaaaggagaaccacctcttactactgaactagccgtgcagtttagattgcagaagaagctgcttctcctggatgtgatacagaatcttagtcgcagaatcaagatgctagctctagacaaatccaccgtgtaggatttttcacgttttggaattgctttctcggacaatcaattaccctattgtactgattctggagatgacaataaagccccaaattttgtcctgttttcttcattgtccagatgccagagtccaatatggcacggatggttaacaatcagattgaattgatcgcaaattataatcaagtattcgttgccagttgcatgtgctctaaaatctaaattatatgtttttcactgtaaaagtatgttttctttagacaaaccggttcatcggagagaggaagatcatcaagaatgaatgcatcacagatgcacaattcaaaatagctaggctacataactttagtatttacagaaccaagatataactttccattaatcctaagaactgaaatttccttgtctcaacgacaacgacgacgacaataaaataaaaagattaatgtacgcagtacagccaaagaatgatcctaaaaaaacatctgctcatgttcggctgctcaatcagtcgggtctaaccatgacgagagaagaaaact

SEQ ID NO: 92567 - DNA, 1030 bp, Oryza sativa
gagactcgccgagagggagggagagagagagagagtgagagaggtgaagaggagagagagatagcatattggcaggtgggccccaccatgtttttttaaaagaaaatattgactgggctgccatgtgtgcgtcacgtaggataaaaccgctttagattacgttgagggggggtaattcgtccgatattaaaagttcggggtgagtcatatctggttttcgggtttaggggggaattcggccgaccgcgatagttcggtgggggtaattcgtactttttccataactaaataaagcaacttttaacatgtatatgaagggaacatattctatgcaaacaagctttccgtgcacactaattagcaaatgtcacgaaaaattctataaaagattgtacacttacttcaaatagtattgcacctacatgtgaaattttatcttcaaattcattatattttagccataataaaaaagacaaaattctgacagatttttgcccttaaaattatcagatttttcactttttttattacggtaaaatatagtgaatttgaagtgagactttctagatatgtgtaatatgaataggagtaaatgatttttttagaatttttcgtgacatttgctagttggtgtacacagagtatgcacgagaagtttgtgtgcatagaatatgttcccgtacatggacaaatatatgtttagatgaaagttaaaagttgctacattcttaaacgaccgaatgcgggggggggggggggggggcgtatttgccaacaacatacctcgtggccgagcgtcgtggctaaatcgtcgtccttctaacagtacgcgttgaggaacccagtgaagaccaagatctcaccgctctccaaacaacccgtaaggctcttgtcgtcgttgatgacgtgcaccctccagttgatgccggggagaaagcggtgcccgatcctctccgacagcctccgttgcccgaacaccgcatcctccagcgtcgtcgaaacgatgttggcggccacccggcgcacccga

SEQ ID NO: 92568 - DNA, 702 bp, Oryza sativa
tcctgcggccctgaccagcttgaccttgcttataggtcgttgctgagacaaaaatcgatcaaaatgctgcggcaacactgaactatggctgctaccctaatgattggtttcttctcattatggatttgtaataacatcatatttgtatgatcaattggaactgacctatgatggaactctcctaaatgctcctatcatggcagcaagagttacttaccctaactatccagctctagcctagtggcaacatgatattttgacacagataaatctgtatagagagggtgctattctaaaggttatgcacacattcttactgatcctatttattctttgcaatctattgctgaattcatatcttccactattcatgcagaagtctgaaccttcttggtttgttgtgggtatcactagtaattactttacaagtcagaatatgaggtccagatataatatatggtcgcttatagactactataagggttattattgcagatgatctagacgctgagagtggccatgacctcaagactttgatgtctcttaacgataaagctccattaagcccacctgtggaagcttcatcactacgaactgtccttgcactatacacctatgctctaaaacactttcacacgatgataatggaagacgaggccatactaaaatgagaaccccctcttactactgaactaaccttgc

SEQ ID NO: 92569 - DNA, 733 bp, Oryza sativa
ggtgtttccgcctgcacggctggcctttatgccgccgttgttgggcgtctaggtcttcaccgaccggtttgccttcgccgccgcagactggtgtttccgcctgcacggctggcctttatgccaccgttgttgggcgtctacgtcttcaccaaccggccgcctcgtccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtcctcgcctgcacggctggcctattatgaccgccgttgttgggcctctacgtcttcaccgaccggcttgccttcgccgccgccgactggtgtttccgcctgcacggctggcctattatgccgccgttgttgggcgtctacgtcttcaccgaccggcttgccttcgccgccgccgactggtgtttccgcctgcacggctggcctttatgccgccgttgttgggcatctacgtcttcaccgaccggcttgccttcgccgccgccgactggtgttttcacctgcacagctggcctattatgaccgccgttgttgggcctttacgtcttcaccgaccggattgccttcgccggcggcaaactggtgtttccgcctgca

SEQ ID NO: 92570 - DNA, 503 bp, Oryza sativa
atgccgtccgtacacattgcgaaacgcatgtttcttgggtcatttgagaattcctggtaaatcctatcgattgtcctccactgtactgaatctgctgggtgcctcagcatactattgactttccgttcttcggcatgccagtgcacaagcttagcttgttccttattcgcaaacattctcttcatgcgctccgcaattgggagatactacaccacctttgctgggcctcccctctttgacttacttccttcaccttcactctttgctcgtttgtatcttgatgccccacagatagggtagacattcaagtcagcgtattccttgtaatacaaaatgcagtcgttcggacatgaatgaattcttctgacctccaggcccaacggacataatacttgctttgcttcatatgtcgtctgcggtaaattgttcccctctggcaacagatcctttaacagctcaacaagttctgtaaaactcttgtccgaccaaccattactagcctt

SEQ ID NO: 92571 - DNA, 1045 bp, Oryza sativa
actcggtccatccaacgagcccccgggtgctaggaatcggcccaaaggcaaccatccattggcaaaccaaacggaaagcataggaagatagaactccataactcgataggtacttttgtactcagattatgtcgcaaggaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtaatattccccttggtgatggcatggacgcccatgaacggtggtgtgaccgaccaaccgtataggcgatgacaccagtcggcggcgacgaaggcaggccggcggtgaagtcgtagacgcccaacagcggcggcataataggccagccgtgtaggcggaggcaccactcggcggcgacggaggtaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcatgccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtaaacgcccaacagcgg

SEQ ID NO: 92572 - DNA, 3725 bp, Oryza sativa
gaaagggggggaaagaagacttcttttagggtttttctttttataaatcctttttaactttgtttatttcttaacaattattatttgtgctctgaaatttccactaaaatttgagggctccttttagaccaaggagaatttgacaaaaattctccgggccacttttgaatttttcttgtacgtattttagtgtttgccaatttcttttcgaattttaattaattctattattccttttagagaatgaattttaattttgggatgaatttatcaggacgtgacaaatccaccccccttacaagaatctcgtccccgagattcgaggaggctagcaagaagataggttgggcggtctcctcttcttgtctgacttcttccgctctggactgcttggctcgatctcctgttgcagatgaaatcttctcttcacccgacttgtcccgggttgcacctttaactgactcagactaggctgcggtggttgaggatggggcttcagttctagaacttcttatcattcatatctttggcgtcaacctcataccagttaccaccttcgtgacatgcgtcgacatcagctttgtcattactaagataccatgcttgtcatttgcttctaactcgccaccaactgcctcatattagctttcctggtctccgggtgatagctacttctgctattcgattcgagggtcgataactttgcctttgaattatgtttctcaacagagccaacttatcccacttgacatgctttgacgcctttccagatgactttactgctggacttgttattgtttgatcgttaccctgccaaatctgaagcttcgctgttacatgtgattttactctgacctctgtagactatcttcgaacatatcacttggttcataactgggaatagctcccacgaacaagcaactcggattcactttctttacatttggttcgcttcccactattctcttcatgttgtcatcatttagcattcaacctattcctttgcaccttccgcatggatgggttctttctcgatggatcgattgctagggaagtgcgttgagcgatactagtgcaagtgcttttattctagtagcatctgatacaaagcccaaggttgaaccgagctttagattccactgttcaggttttacttcttgacttcttggtcatgtcacaaaagtttccatccttgtcccccatagaagtacttctacctgtggtcatctctcttactcgtgaattcacctgctttaatgacagggcaactattgtagggttgtttgctatcgggagtcttcctcgagtgacacaaatcatggttctcgttatcttttatcaatcacctttcgacctttctcaaccaggtactcttcgctccgggtgttgaggatgtttctggggcaatgaggtgcttgggcgtgctgcctttccgtgaaaccttgatgtggttcgtcaaaaactgtactgactaccttcagggaaatacattgcttgctatctgtatccatgccactagggtttaattgccgatgatcacctttagtgcttcttcgagatgggaagcatccaaattgttcttctaccataccacctttgccccttttctgatacctgatagactaattaccaaccatcgactactatgtcctcaaatgtggatgtctcctggatcttcttaactgtttgtaggtatatccgaacttatcaatgtagaggcatggcgggtacccttatgggtttcatccaacaatccttatcttgatctgtaaaaggcgtatccaaactcctatccccaactactgtctcattggccttttaacccaactcagtttaattggttttcttttccatcaacaggttggttattaactcaaggttagaacatagttcctctgaaatgagaccctaggtctcctttatcagtaagcaattatacacataatcacatacccgcatcttccaaaagaatcctcatggaacttgtctgtattacacatttctccctcattacatgaatacgaggcactgccttaaacaaaaaaaggacggtgcttaacatcggtacattgtatcctcaacatgaatcatccataagcatagcaaacccactgtttatagacatgaatatatttatgtattacatgattgctgcaaactttcgattacaccatgataagtagcggactgaaaaccacaaacatggctgctcattttgattctggagagatatagctggcattgttctagtgactgcatcatccttgattggttctgtgatgatgtgataggactgcatattgctatcattcacaggagaagcttccttctgattgctgtttgaagcggatgatggtcttctgcttggtatcgccctccggaggttgattgccctttgcttggcctggagtaggtcggggagagacacaacttcttccatcaacgacaattctttgctgaggctgtcggtgcagagaatggttgctatgatttattgcagagtcaggtgcagcaggaggagcattggtgcattgtttctgctatgggttctgattaacacgaggcctcacgggtacggcgtttgctccagtgaccacaatacgattggaatgtctgcttcgtgtaaattggcggtaatgtggaggtcgattttgccttggttgcaggcagtccctcgagtaatgccctggttctttgcaattgtagcaaatcaacgtcttctttgctgagctatccgtctgaggacgatcattctgacttggagttggagttggtggttggaaatccttgctaacattggcatcagtggtaccatagttgctatcaccattggagtctttctcagagtcaaaattgctagggttgtcattctgggtgccttcattgatactatcgtcgatatcttggtgaatgctgttgacattgcacgcttgatctaagtgatcatgaatggggcaagaaccatggtggttggtggtattatcagcattagtagtgctattgttgttgtctgcattgcgttcatcttcttggggcaggaactcttgatacacaacagaagatccggtgatctgaagtggctcagtgcgctgtctttggttaccacctggaaatactgggttgttgaccatccttctcttgcagttcgtcatccgattatgctcactttcaagttgcatggctttgtccacaagtttctcaaaattttcataatcctctaggagtagttgcactgcaagctcatcttttaacccctggagaaacttctcttgtttgtcttcatccgtttccacatcttctggtgcatagtgagccaaacgatagaactcatgcaggtactctgtgacggtcaaatctccttgcttcaggtagcgaaactctcgttttcttagtgtgatcgttcctgcgggaacatgtgatctcctgaatacagatgaaaactcgttccaggtaatggtatgtccttctggccgtgatgcttcgtagcgatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggttcagttttgagaaattctgataacttgcactgttgctggactgtaggcacttgaacgttggttgcccctgctgggttgctcca

SEQ ID NO: 92573 - DNA, 933 bp, Oryza sativa
cgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcatcgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgc

SEQ ID NO: 92574 - DNA, 1281 bp, Oryza sativa
tccgcatgcacggctggcatattatgccaccgttgttgggcgtctacgtcttcacagaccggccgcatgcgccgccgctgactggtgtttcagcatgcacggctgacttattataccgccgttgttgggcgtatacatcttcaccgactggctgcctcgaccgccgccgactggtatttccgcctgtacggctggcctattatgccaccgttgttgggcgtctacgtcttcaccgaccggccgcctcgtccgccgccgactggtgtttccgcctgcacggctggcctattatgccgccgttgttgggcgtctacgtcttcaccgaccggccgcctcgaccgccgccaactggtgtttccgcctgcacggctgacttattatgctgccgttgttgggcgtctatgacttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctgacttattatgccgccgttgttgggtgtctacgtcttcaccgaccggctgcctcgaccgccgccgactggtgtttccgcctgcacggctggcctattatgctgccgttgttgggcgtctacgtcttcactgtcacgtcctgataaattcatcccgaattaaaattcattctctaaaaggaataatagaattaattaaaattcgaaaagaaattggcaaacactaaaatacgtacaagaaaaattcaaaagtggcccggagaatttttgtcaaattctccttggtctaaaaggagccctcaaattttagtggaattttcagagcacaaataataattgttaagaaataaacaaagttaaaaaggatttataaaaagaaaaaccctaaaagaagtccttttcccccctcccttcttgggccggctcggcccagtccctccctctctctctcttcccccgcggcccatcggcctcccccgcgcgcgcgccgctgacaggcgggcccgctccccgctctcgctgacgggtgggtcccgcctgtcgtcttcctcctcgcgccgcgccgccgctcgcccgtgccctagcgccgccgccgccgcggatttcgccgcatcccgccgtcccagcgcgcattaaagagggggaaaatactccccgtgattccctctcccgtttccccctcttttccctctctctctccctcggattcgtccgatttgaatcccgcgagtttc

SEQ ID NO: 92575 - DNA, 1704 bp, Oryza sativa
ggggaaaagaaagactttttagggtttttctttttataaaaccattttaactttgtttatttcttcttaattattatttgtgctctgaaaattccactaaaatttgtttacgcattttaggcttttaggaaatatacaaaaatcctccaagccttattcgacttttaactttgcacattttaattgttggaggctttcacatggattttacttattctatgcataatttcgaggatgtattttagagtcgttttgggacgcgacaccttcattgtcaacttttacattgcgaagatcgacccatcgacaacgaaacaacgggactttgaacttcaagtaatctagctccaatatttgctcaactctaccatagtattgatcacgacgaccaccgtcactaccagcctcgatgcgtaacccactgttctgcactgtgcatttgctgtcttgctttaccgtgtgaaaggtgtatccatttatgtcatatccttgccaggtggtggcagtgcattcaggaccctgtgacaaccactgaagtgtttcactagacaagttttgcaacctggcaattcggttcttcagccactcgttgaatgaagacatgtgcttattcctgacccaactctctgatcggcttcggttctcttgtcggataactgcaaggtgttcgtcaacgtacggcaccacctcagtcatatgctgtagtaccgtgaaatgagcctaatcatacaccttccgatccagcctaatagtctttcttccaatagtaccaacaccatcaagcctcccttcttgatgagatcgtggtaatccaattgaagatgtttctgacatgtagtccacacaaaaatcgatgacctcttcggtggtgtaactctcgatgatactcccctcagggtgtgaacggttccgtacataacccttaaggatccccatgtacctttcgcaaggatacatctgcatcatgaatgctggaccacagtactttgtttgcctcacaaggtgcaccggaagatgttccattatgtcaaagaaagttggaggaaagtacatctcaagatgacatagggttttcacaagttctgcctgtagttcatctagtccctcgggatcaattatcttctggtcgattgcatggaagaaggaacacaaccgctggatcgtgtgtcgcaccttaggaggcaaaatattccttattgcaacgggcaacagctgtgtgataagaacgtggcaatcatgcgacttcattcctaccaacttaagatcttgcagtgaaacgagcctactgattcttgatgagtaaccagatagaacctttataccactcaaacatgttagcaaatcaatcttctcttctttcgagcgagtgtagcaggctggaggaaggtaaaccctgccggattccgtggttatgggatgtagctccgagcgaacacccatatcttccagatctcgtcgggcgttgagaccatcctttgtagtacctgggttaagcagtaatcccattaaactctcgcatacattcttctcgacatgcatcaaatctatttagtggcgaacttcaaaatccttccagtatggtagtctccaaaatattgacttctttttccacatgctcctctcttttgtcttttgtttttccacatgctcctctgttttttccttcgatgtgctcttctcttttcgctttccaactttcctctt

SEQ ID NO: 92576 - DNA, 759 bp, Oryza sativa
ttcctgcagcccttaacaatatgaaaagttcaaactgttcccctaagcatgaaatttaagaattcttgaacaaaaacatatgtactactcccctgttatttttcctttttgatgacttcatttccaaattgaaaaggaaattcatgttgctttttacaaattgaaaagcaattactagagtaatatatgagaaatgaatcacttacccaatcaccaacaacaaacaggcttacaagcactgggttatgaagatctcttttagtttgtaatgaatagatatccagacaagcaagtccaaaactccaaagaagctgtagacccatggaagcaatcaagtagctgaaaatagggagatcacaatatcgtcaattatgtatatagattatatcacgtatgcactgttgagctcctgctcaagcaattctgaatagtagtaaacaattttcatactttgcccaacttggtctcaaaacattaagttaaaaatggcacccatacaataatcaaaggatgtaacatgttgaatgttgacacattcatacacaacatctaatggaaaaattctcataagatgttaagttaaactttaatagtcacaaagaagagaacagataagcacaccaaatcattgggcagtcctgcctttttggtttaagacagataaataaattgtttttggtcccttcctggcatggaactgaattatatcaggaaaaaggccagtaaagaaactgtgagaaaagatcaaaacatcataac

SEQ ID NO: 92577 - DNA, 1083 bp, Oryza sativa
agatttacatggatttgtttctctaatggaaccgtgcctaagatgagaaatatatgattataggttttgctagattccaatgaccatagagcactaatcttctttctttacagttgtaggaatccttgataaggctgatggcttcgatggatgagcctctttatcccatcgctatactgatagatgagctcaaaaacgaagatattcaattgcgtctgaactccattaggaggctctccacaattgcacgagcacttggagaagaaagaacccggaaggagttaattccttttctcagtgaaaataatgacgatgaagatgaggtgcttcttgctatggctgaagaattgggcgtgttcattccttacgttgggggtgtagaacatgctcatgttttgctaccaccattggagacattgtgtacagtggaggaaacctgtgtccgagacaaggcagttgaatctctgtgccgtattggagcacagatgaaggaaagtgacattgtagactggttcgttccagtagtaaaggtaagaagtttattaatatttaattgttttttttctgtagagttgccagatttatcagttcgctgccaacttcactatgtaggtttcttgttactttggcatacaattgtgtgatatttgtgtttgtttcttgcctgtcaattgcaattttgttatatattgttgattgttctccatagaagctattttaacacattgcaattgttgactggaaacagtgccacaatggcattagttatcatgctttcattttccttttccttagtccattccatctagcaccactaatgaatactttatggacagactattttacactacatcgtgttgtattcagctaaccatgcattactcttttcagaggctagcagctggtgagtggtttacagctcgagtatcgtcttgtggacttttccatatagcatatccaagtgctcctgatcaattgaaggcagaattgaggaccatttatggtcagctatgccaagatgacatgcctatggtccgaagggcagctgcatcaaatcttggaaagtttgcagccacagttgaa

SEQ ID NO: 92578 - DNA, 737 bp, Oryza sativa
agttgtttactaccattgcttcacgattgttggaaacctgacttgctttgtttctggcattctgtaggaggctacaatcgaacaacttcttcctattttcctttctttgctcaaggatgaatttcctgatgttcggctcaatataatcagcaagctcgatcaagttaatcaggtgatgttcatgtttttttcttattgaaatgaatttatcttatcttttgtgatgttcatgctgtttttattagcgtgaagtctaatttactccacctcaacaattattttagtctagaaatcaaccctcaactatgacaccagacattttatacacacttcgactatcaaaactggctagaatacccctcaagggcaaacctggttatttttttaaaggattctcactctctaccagcctaaccttgaggtattgactacctgcagtgtttagaaaacatcagtcccacagctcaatataacatttcaattttgcttccctaatgactgataaattccttggtcatagaaaattcattactgagtccttttgatctttcaggttattggaattgatttgctgtcacaatcactgttaccggcgatcgtagaacttgcagaggataggcactggagggttcggcttgcaataattgagtacattcctttattggctagtcaattaggcgttggatttttcgatgacaagctgggggcactttgcatgcaatggttggggggtgcag

SEQ ID NO: 92579 - DNA, 1747 bp, Oryza sativa
catgaaaactacatgaatcatgtccaatccagacatagggaatcagacatagggaatcagacataaatgagagtatgacatgaaaaaaattgcgattgtattagatcttttagggaatcagagatgaaacactggcaatatgggttgttttctgtcagtttgcgatcaattttataccctttcagtaaaaaataactaatggtctagaattgtgcagtaaaatacattttttagaatggatacacaaaacatatgtgtaggtttctgtcgataacttctttcattatattataacttcggtgttccctttcattcttgaaatattaccgtaaattagtaatcagctgcatttccggtgccatgtcaatatccatgtggcacttgtagctagatggggtagtatgccaaggttttcatttccctgtttgatcacttgtttgacccttctttcttgaagtgctaacataatttagcaagagggacattaaagaacattatatttggatgtattgcaggttacagcgattctttcgtttgcagcagcttctgcttctgctggtgtcactattctttttgagagagacgtgcacttctgtaggatgtacccgcagctttcgtgtggtcgttacgagctttcagttatcttggcattcatcacatggtcgttcatagctacatcagctgtttccatgttttggttactagcttcgctttgaatcgtatcattatcgctgtcatgttgtgctaaccatcaggattccatcaaatgtactctgcttgagacatttagattttagatttctgttaatgaggaagcatccaaatcattctgagtaggtattatctgcttggctcaccaatctttggtttggaaagagtttatttgacaaaagtcgggcagatcatgagaacagtaatggagccaagtaatgttgtcacctagaaatcttctgtattaaggtcaagggtatgtatatagcatcgaaaatgaagggccgtgttgcaccttcatgtttggtgaagttcactctgacgaaatttgaaagaggtattggccatatctcttcctgagccacaccataccgtatgagatggagaaaaatggtgatcacgtgatgcaggcttggatatggattgtgcaaactgttcaagtgtcaactactgaaaaattttgggttttggagaattagatgcggtttcaaatgaattgcgttcagcactcagcagattggaattggactctgattacttggtaacttttgcggtgtaattttagtatgaattttttgcggctcatttttcgtccttgataaattcagtttgaatacacaaaatgttgacacttcattccgatcatactcttgcttggaacaaaatcaaaaattgtgaagcaaacgaaattgccactggctagatgcatttaggggtataagtggatcagccgcaaacccgtttattttaacttattttaacctacaagtccgtttattttaacttattttaacctacaagtggatttcatgggttagccatttacacccttagatacattcatgttgaggctagagaatcttaaggtttttacctgtgtgctattaaaaaagatgacccttgcctctatgccactaaaaagtttgagtctctctctatgctattgtcgaactttatcgcgtcctccacaccattccgtcgctattctgtttgggtttaaccatttggcagctctgacatgtgggcccaagtagga

SEQ ID NO: 92580 - DNA, 683 bp, Oryza sativa
aagattacatgctgatgacggttcgcgactccaacccgtggtatgcaaccatagtgaattacatggtatccaaatacataccaccaggggaaaatcaacgaaatttgaagtacgaaagtcaccgtcatatatgggatgagccatacctatacagggtctgcaccgatggcttactaagaagatgtgtgccgactgaagaaggacttaagatcataaagcgatgccatgcctcaccctatggtggccattatggtgcattcggcacccagggtaagatttgcgcaaagtggcttcttctcgccaacaatgtatgaagattcaaaagaattcgtcagaagatgcacaagctgccagaggcaaggaggaatcactactcgtgatgcaatgcccctcacatacaatttgcaagtcgaaatattcgatgtctggggtatagacttaatggaacctttccctaagtcccgtaactgcgagtacattctggtggcagtcgactatctctccaagtgggttgaggctatgccgtgcaacaccgtggatgcgaagcatgccaaaaagatgttcacagaaatcatcttcccaagatttggtacccctaggatggtcataagtgacagaggttctcacttcatcgacaaaaccctccgagacctcctacgagatatgggagccaaacacaatgt

SEQ ID NO: 92581 - DNA, 690 bp, Oryza sativa
acatataatcgattattcaaaaccctgtccacattggttggaattactccatcggcttgtcagccgatcggctctttgatcttcaatttatatatcttgtcagttgtaggatcaaactgactggcacgcccgcatctcataaatattctggaccagcgctggagctaagtagatctcccaggccattgtgttcatcgacttagttcgggccaacacagatctagcaccatcgaccaagcacggattttttttgtcaacaagagggaaagtgatatcaccaaagttcttgcaaaataagttgtttcccaaagttcgaatccttgaggggattctacgctccgttgaggagctcacaaagagccgggtcttagctaactctttcctcaagaggttgcacaaagcactactccttccacccactagtggttttcttttctttcggaggctagatctggcattcacaaacttctcctggctaaccacaagtacattggtggctcaagattggcacttagccgcttaggagtacacaattcccaagattaaaagatggaacaaggatcccttggagatgaaactagtactcaacgaatcttcacgaagttaacaccaagcactcacacaaactcaaaaccacaactctcacacacacaaggtccgagctcaaagatcggtggagagggggaaatt

SEQ ID NO: 92582 - DNA, 680 bp, Oryza sativa
ttcctgcagcccttatattttaatgatggaatataaaattagataaagggtgtagcagcaaaccatggctcaatttcaggaatctcttccttctgcttttgctttggaggcctcccaggagcaacttcaatcaagttcgggttcatgactacttctgcctttgcctttgcaagttgagcttgttttactttaagttctttagcttgtgcttcaccaaattgattctagaaggtcaaattattagggtaagtaaaaggaaatatgataagtaaatacattttgaaaactaatcttaaaagttgatccttacagaccttaattctctgcagctcagcttgccttgaaagttttccctcctcaataaactgaaatccaggccttctagggcggaggagcttgttttggttgatgcccatcctttcatcaaagtgtgcacttgattttgcaagggaatccaagtctggtttgattatttggaaagcttccttcttttgcttatttatgttaacctacaaggtataaccaaaagtgacagtcattgcacagaagagttactgataacatttcatagtattcatgctagtaaaataagagatttacttttagagtgctcaaattggttggcttggtcatgttgataacattcccatgttcatcaatttccctaccctgagcatcaa

SEQ ID NO: 92583 - DNA, 841 bp, Oryza sativa
tgatgcagaccattcagctggagtactactagcttgattcaacgagtaactataagccgacacttgaatccatagacgacaggtgcacgacaaaagaccatcagactattaagaacaggccattcacgcaaggactccacagagttggaatgaagaacgaaccaggcagtaccccctccattttatattagaacttcattcatatcaaagacgttttaccttttttttctaagtcaaattttaactttgataaagttcatactcccttcattttgtgtctagattctttaatatctatatgaatgtagacaatgctagaaagtcttacattataaaacagaaggagtagaaaacatggtatcaaaatatatttaatgttaaatttaataaagccaatttgatcttctagatatcaacatatcggtgtccacatcaagagccaactcgtacgatgcaagtactacaccgttaccaatagctacagtcaaaaatcacattgcagtgttggcatccattaaaatcacagaaaccaaggcccaaaactaccatgtaaacaaacataataatgtgtccgatcttgctcaattacaacatcatcaacatcaaacacagagaacgaggggtcggagccatacattatcatcttgggaagtgtttggtctgttactggggctagaaaggaactcttcaaactaaagtgcaaattacaaatattccaaaatttggactaagagaatcaagttctaaatactggacaggaagacagttagcttgacatcatgatttgatcgcatgcctgaagggcctggtttgcatagtatcctacaaccccgggggatcc

SEQ ID NO: 92584 - DNA, 9232 bp, Oryza sativa
gcccttccccctctcctcctccccccgcccacctgcgacttctcccgcggccgatgggtattcgacaacacctccctcccggcctacagggagaaggaatgcaccttcctcaccaagcaggtctcctgcctcgccaatggccgccccgacgacctatggcagtactggcgctggcaacccaacaactgctcgctccccacgtacttcccattccttctagttctagatctgccatttcatttcttccagatggatcgatttgagttgattcgattgcaggttcgacgcgcggcggttcatggagaagatgcgggggaagaggatgatgttcgtgggggactcgctgaatcggaaccagtgggagtcgctggtgtgcctggtgcagcccatcctatccaagggcaggaagaagatcgtcaagcgcggttccttcaacatcttctacgccaaggagtatcgcgccaccctcgagttctactgggctccattcctcgtcgagtccaactccgacaaccccaatttccaccacatcgaccagcgcatcatcagccctgagcggatcgagagccatgccaacaactggaaggacgttgattacctcatcttcaacacctacatctggtggatgaacaacgaagacatcaaagtcaggtctgtacccaccaactttgatgttactacttcatttaaccaatttttagtttagctgggatttctagtgtgtttaaaatttctttcattttttttttatttttgcaggaggccaaattcaacttcttggtcagatcacgacgaggtgccaaggatcgagacctatggccgtgtgttcaagacttggtcgacctggctggaacagaatgttgatcctgccaggacttcggtgttcttcatgacaatttctcctcttcacaacaggtgatcataaaacttgcatttctgatttctctatctcttacctcctctctacttcctctctagttcaagcaatggcggttcgttacgaacatcaattagttcctccagggcagggcctaggaaaacttaatttggtaaccttgaaatctttaatgttgtggaccactgtcggtttgcaataggacaccctacctatccctgataaagtggtttgttactcctaattacgttctgtacaagcaagcttcctcttgttccagtctgcagagcacagccactatgtcattgtccaccagaaaatgaggtcagttggacccgtttgttaggtttgcacgtgataaactaggaacaaatttgcctgactttctggggttttagagtctttcaaattccatagttcactagttggtcttggaataattccacactagttcactagtaggtcttggaataatcactcctgtatccgtatatgcatcagaatgacagaaagtatggtgctatgcacaaactagttacttcggaacataccaatgtctgaaatcagaaggcgtggtgctatgaacttactggattaacgcacctcattcctcaccttttatatatattatttccaaatatttaagaacaagtgaaccaattttaagtactttagtttggaaccactagtattatttcttgttttgtgtgattctcaaaggctctttgttcttttctggtttgttgcttgtgaagcacaaggtgccacaccattccatcacactatgcacgcacccatgtgaaaacaaccctccttttgttgttgtaccagatggtccaccaagaaatttgttgggttcttatattgtatatagacacacatatatatagactgggagtgcacccttggtgattcttttagtgagttttcatggtttcttcaaacaaaaatgcttctgtgcttgtgggtgtgggcaagcaatttaaatttcaaatggaacatttgggataggcacagtatagcctacaagattttgcatgctttagtgattctggcccattttgacaagacaattttcagcaaacataaaacgacgtaatgttcgaaatgttgtacctcaaggaaactgttcaccaatctcagagaaactgcaatgatgtggataactaccatacccacatacacaaatctcactattaaaaaatattgatattggctttgcctgaaagaagagtttctactgttaagaataatgatctgcaaaactaaatgcagtgtaaaaataggcttaatatgcttcttaaataagtctttgtttgatactccctctgtttcatattataagttgctttgacttcttttctagtcaaacttttttaagtttaatcaagtttatagaaaaatgtagcaacatctttaatacaaaataaacatattatcaaaatatatttaatgtttcatttaataaaactaatttggtgttgtaaattttgctaaatttttctacaatttggtcaaacttaaagaagtttgactaagaaaaaatcaaaatgacctataatatgaaacggatggagtacatgtattgggtagccatttttggaaagttgaatttgcaatcttttgagttaggttggtagttggtagatggcaaaaaatttgggggagtgttacttccaacaaaactctgatgcttttgctaggagaatttacatagaaagattagtctatgtcgatgtcacctagaccagccagaaaaaagaagctgtggtagtagattctatataaacagtaacatgaaactctcatgtatgctctttgatgtcaaaatctgatgtttgcagtagtaagatcggtataggtggccgttggttcaacactgatgctgtcatcaccttttgccaatttaatatagacgagccctgcagtgagcttcatagtcgcactctgttcagatccattgctaagacattttaaaaccaccttactgttgaagttagtgctactggaagtctggaactgtggaatatactaaaatataggcatcgtgtgaggtggttgtgagccttgtgcgtcatgacctgtgcaaagcaaagtactatgtgtactactagtatactttgtgaagttagtgtcggtgtcaaataatagtaatatttcatcttcatctgacatcttgaccccaatcctttcaaccatgagacaaagcatacatcatttggtgctttaggctttgattttattccacatcatttgtacagatattgatttgcaaatgatttgagcacagttgcttataaatcaagtcgctttcttgacatgttgggacatttacattctgatgcactcatgtaccggttgaaattaaggatagaatttaaatcaatcgtgtgtttgtgtcagcaaaagacctgctactgtttgttgttgtattgaactaatgatatctgctcttgaattaacattatggtacatgcatttctaatttatttacatcgctgaagcattttttcccctcttgtgatgctatcttaaaaacagcccagcacaatgggggaacccgaacgggatcaaatgcgtaaaggagacacttccagtcctcaactacaccaagccactggatctcaaccatgacatgcggatgtacgacctggtagcaaaagttgctaaaaacatgaagaatgttccagtgtcgttgatcgacatcacaaggatgtcagattacaggaaggatgcccacacatcattgtattccatccgtcagggtaaactgttgacaccggagcagaaggctgacccacagaagtacgctgactgcatccattggtgccttcctggggtaccagacgtctggaaccagatactctacaccaggatcctctccaaatcctcccctccatccacacatccctctctccctccacaatgacaagcagggagcatgatttttttttgccccatcgtatactatataggaaatgtatcattactattcaatttttttggtagtttggtgaagaaaatcaagctagagagagaaaggatggagtgggctgtttactggtggcatgtaaaatcgttcaattgaattgtaaattagttttgagctaaccaattgagcaaacagcactgttgtagacactcggtactctggactgtgaaatcagctggcaatacatatatacaggggggcacagtgattaatctgagatcaatttgttagtattatgtgttgatggcgtgatgcttttgtctgagaagagcagtcggtgtgagattggcccagatggccttccttttgtgtttgggccgtatgtgtgcatacgccaccttaacttccatttattcactcatcgaaataattaatttcacgtcgatcctactcctgagaaaaatatagctccttgagaaatcttttatgtattctgaagttcatgataaatcttgtctcagaaattacccatttcagttaaccgaagaaatcacctacaacgagacgataaatctttgtcttggaatcagctaactcctaacttatcagttgccattagcgaccttagcaaggtaatgtatttttaacccggagagtttaactaactcacaagaaaaaaaaaacagtcaacctcaaaacaagtctctgtataatccaaactatttctcctaatgcattttcgttgctctataagcaacaactcgcagcagcctgcctgcatctctttccagatcatacctacgttcacatgggcttaacagctcagcttcaccttatgcggctgagatttgctctaataagtgttatcagatctaagtgaagtagcagtagtagtgctaaaccaagaagatgaggccaactcccatgttgtacgaatacttaccgctagcatgtatctttgcagtggagcacccttaaatgttggtatttgcaaattgccctctaatggtagttggctagttgaagagcatagcagcgtcgtgctctttttttaaggcatataatcacttacaagccgaaaagtctaagcctaaatacataagcgtttttttcgtttggctttttaaaaactataagtcactttacactaacactattaagtcaaaagctatgtccggaaagttttttttggcttatatgagatagagatataactctaccactaaactaaggatttcaaatctatttgcttataaattatataaactaaaaaaactgacttaaaagtctaaacctaaacaatgagacccttatacatatgcttataagccaaaatttagtttattttacatcatttgcttttaatcgttaaatttatgcatataaaagttttactctcttattttttgcttgctaataagccatacggataagaaagcattggtgaaactatgagccgctaggtgttattaggcacaaatcattttgaaacaaccttttttctatgttcttttattcttaacggatttatagataaatatgcatgattttcgaacccttagacaatgtgactttgaaaaaaactttctatatatgaattttttagaaaaccatttaaacactatttttaactttataatatttaatttgtttgtttgtaaaatttataattaccacaaatcatccatccaatcagccatttagcacaaaagaaatctagcttggacaatatttagttggctacatcaatagtgacggggcaactctaaatattattgatggtagtatatcaccccttaaataaattaaacaatctagcttggacaacatttagttaactatatcaagaggcaccagaacttttgaccctttgaccatgagtttcatattataataactttagatgagaaagttaaggacctgtttagttcccaaacaaaatttctcacgttgtcacttcaaatgtttggacacatgtatggagtattaaatgtagagaaaaaccaattacacagttcaccaggaatttgcgagacaaatctttaaagcctaattgcgccatgattgacaatacggtgctacagtaaacatttgctaatgatggattaattaggtttaattaattcgtctcatagattcctgtgagtctgaaatttgttttgttattagattacgtttaatatttcaaatgtgtgtccgtatatccgatataacatgcatgggtaaattttttttgccaactaaacaaggcctaaaatgtacaaatccctttgagatgcttttaggaaactaataacttgggtgtgaagtagttaagggtgatttatgtcatcaagtaaacctgtgttagtaataaaattgatgggagtagtgggtgagagagtgaatacagggatgatggggggttattaaggaaaaagaggccatatgtttgttgcaaagcaatagagaagccaagcaggcagccactaaattgggttggggtgcctcctcctccctttctttctttcatctgcttcgtcctcagatccgatctctcttctcttgttctggggttggggtctcacgacccgccgccttcttcgtccccgtcgctctagaggggatctcaccgccagccgtctctcgccatggcggcggccaacgcccccatcgccatgcgcgaggcgctcacggtatcctcttctcctcttactcctccccgcgagatctcactcgtaaccaaggcggagctaatggcgcctgactcgtatctcttctcctcgctcgatgcagctcaccagcctggggatcgcgccccagttcgtcaccttcacccacgtcaccatggagtcggagaaatacatctgcgtccgcgagacctccccgcagaacagcgtcgtcatcgtcgacatggccatgcccgcgcagcccctccgcaggcccatcaccgccgactccgccctcatgaaccccaacacccgcatcctcgccctcaaaggttccttcctacctagatctacctgctatctactctttcggatcttcacttatttcctagcgatctactctcctactccctaatctttctactatttgcttaattcaaggagccatagactacctagcacattcattttgccatcctaccatagctggaaaccatactgttattcttaccatttgcttcatcttgttcaattcatcagaaatgtgtatgctaattgtggtttacctctataatttcgcgcacatgtataatttccagtaacaatatgttaaggactgacaaattatttagcttcgtgatctactatcaaaaaattcacgatgaatctcgatcaactgtgcattttacaacttcaagagtacttactccatagtaaaccaacagttttcatattctcatgctgctcattcctagtcacagtttccatgcccttgctagttgctactgactaggagtcgactatcatttcggttttcgcttatatttgtagccatggccacaacatcaacttattctcccataactccataagttaagcttaattttaacctcggattgggcttacatggatatttccacgctgttcttcctaattgaatacatgacgtacagatcatctggtcttgcacttgatgtttataatatatcctctccaggcaattgttcacttgttatactgtttcataccattgtcacgatttgttcatgcttcatgcttttgtatgtctatttttaggttgcttcagattggattcatactggcaataaatttttctaatgtttaccatcaccagtgtttgtctgacattcaacattcaatttaaaatgcctagtttatacattgacatcatggtgtctggctagcttactaattgcttacgtagaagcagaatgatatgtctttacttttgcaactttccagctgtttaacttttttttgttgctggaatttgcagctcaaatacctgggacaacacaggatcacctgcaaatcttcaacattgaggctaaaacaaaaattaagtcccaccagatgcctgagcaggtacaaaatttgaagttttgccaaagtatgcgtaaccactttgtttaaattgtatcctataatcttaatgtattctttgcatattttattttcttttcacaatcacaggttgtgttttggaaatggatcaccccaaagttgttgggtttggtaacacaaacatcagtttatcactggtcaattgagggtattgaactattgatctgaacttttgtccaattattattcgctgctttgcattatttggatcatatccatacaaaccaatgattttttttgcatgtatttgttgtaatacaggagattctgaaccggccaagatgttcgataggacggctaatttggccaacaatcaaattatcaactatcgatgtgatccatctgagaagtggcttgtgcttattggaattgcacctggtgctccagaggtatgtttgttaataagtgccgatataacaggctgcaatggtgtaaagatcaaaatccttttgggcatagtgtaaaagactacatatattttcgaaagttgtaggaaatatgctacacctatgctggagcagttcttaaaagtttattacgtaatgctttgttctatatcatcctaacattgatgtgctctctttttcacccatcagaggccacaactggtgaagggaaatatgcaacttttttctgtggatcagcaacgtagtcaggcacttgaagcccatgcagcatcctttgcatcatttaaggtaatgtccggtactccagttatatttgtgctggttacatattctttgttctactatttgccaaattttccttttatttttcctccacaggtcgtgggcaacgagaacccttcaactctcatctgctttgcctcaaagacaactaatgctgggcagatcacttctaagttgcatgttattgaattgggtgcccagccaggtttgtctctggaaattttcaagatttgttttgtttctattttcaagtttgtagcagagtaagaaataagtagaatgccttttatcaaacacacatttgtcatttagtgtagtcagtgctattctgcaaatggttctatattccaccccattcttctccttgtaggccattaacagtgaataaatgttcatggataaatcattcctctgttcactcgttcttcctatcatttatttcagggaaaccagggttttccaagaagcaagctgatctcttcttccccccagattttcaggatgattttcctgtggccatgcaggtgaatatcttgcactctaaaggaagtataccctgttagataccgcatagatctaatttttttaaattttctgtcaattacagatctctcagaagtatggccttatctatgtaattacg

SEQ ID NO: 92585 - DNA, 536 bp, Oryza sativa
aatccatacttccccctttttccggttccacatccccttgccttattcctcttcatccccatccccaacactactagctattcatgtgtttagaaaaaaaaaaaaggttgctcctaacattatataaatgagtggtgtattgctatatttgtgtatctatatatgtgtgtctaacgagcaaagctgcagcaagcaggggagtggaaacctataaaagataattctacaaggtgatttgcttaagcttaaatgaaatttgcccactaaagatcaaatgtatttgactctaagtacccatttagcttccggtttgctgtgaagggtgtattcactgattaagaatggattctgatgatttatgaagcaataataaagcaatcaaatattgtattatcaggtatttctttttcttgatgttatgagttttaaagcaggaattgaaatgactgtaatattgacatgcgttatttgtctttacccaaagtgacagttatgaaataaatgtcctttcaaaatttgtggtttgggctgcagga

SEQ ID NO: 92586 - DNA, 1111 bp, Oryza sativa
catataattacatcagtgtggcattttaatgtgtgtagggcattccgaatgaagaataccatgaatatgatgactcatccaaacatatgtctgttgtggttatgctgaaatctgtggagtttctagttgatcttatgcgttttcctggacaactagttccattctcatccaaggctataattacatcacatatatctgcagctggagagagtgactcagctgattatgattcttgtgattctcctcttgaacctaatagtcctctgtgttcccaacggtatgcttgtgtattccgttttaatgacatgtgtgtcttgtcatggttccttttggcgattttgccccttgacacatatctagtattattgtattggtataaaattcatacagttccagatgctatgtggtcctgaactatgtgtatcaaatttgaaccagagcctggggtcatccctaattgcagtgtctgcttaaacgcgatatccaaacatgtgaaaaatactatctccattcatgaagctatagcatgttgagtagagataatactggtcttttccatttctttaggtttatgatctacctccattttgttcttttttggtgtacagtagcatgtggagcatttactgcttgcaaatattgtaggtgttggacagcaactactgtatgttatgtggtgtttttcgtatatgaggagtgagatgagaagaagcaattaccaccaaattataatcgtattgtcgctaggattagatttcaaggattaattttccttttaaatttacacaaaagatttgcttgttaaagattttgttaggagtttgtctggcctgcttctttttatataggagtgaaggcacgattgaatagagcaagcagaagttagaatctaatctctccccctctctgtttcctatgttccaccacggcacctgggaagcgagggctctggcctcgctcttctcgctcttctgtcggtcgagcacagctaccactgaggcattcgggccctccccagatcctaacatcgtagctatgagagttccaatttatcaattgtacccatttaatactacctccgtcccaaaatataagaatttgggctgcagga

SEQ ID NO: 92587 - DNA, 4674 bp, Oryza sativa
ttatacaggaatcacctcatgatttcaatgacaatgaactacatgtaagaggaccagatgagcaagagggctcaagaaggcaagttagtaaccagaaggctgtgtcattaccttcatcgccccatcgattgcgcagtgatggttctggcctcagaggaccagccgagtttctgacagcagatctgatgtccacttggaataaggttttgcgatcttcaccatttctgaacaagcctttattgcctttcgaggaatggcatattgagttctcagagattactgttggcactcgagttgggataggcaagtacatggttcgctatctatattctgctacattcaggaagtccctgcattatgaaatacaccacttcgttagtttttatcttttattgaactttttagaaaatcataatgaatgatcaattatcccaatataaataaggatgttttaagttgaccttttagagtcaagaaacagcctcttggtagaatgtcattttaaaactgctaactcatctgaatgttttccagggttctttggagaagttttccgtggtatctggaatggaacagacgtagctataaaattattcctggagcaagatttaacaacggagaatatggaagatttctgcaacgagatctccatacttaggtattacatatagctttttgcaataacttccgttatctacaatattatgtcctaatgttattccctcttttttttttcccagccgtcttcgacaccccaatggtattgcctccacatacagtcctcattactgtagtttcattttccttttttttttgttttgattccattttctttgatgatcagattgttcttattgtttgaaatttaatataactagagatgttacctaagaatggttgtttggctttgaatttcagttatattattccttggtgcatgcatgaagcctcctcacttatccttagtcactgaatatatggaaatgggttcgttgtactatttaattcatgcaagtggccagaaaggtaagctcagttggcgaaggaggctaaaaatgcttcgtgacatatgtaggtgagcagatgacacatgctttactgatatttgttggcagttataattttcttgagtgtctagctcctgatacgtttctgtgaattcttgttgtcatgtctaacactgatctgattttttttccctgaaggggtcttatgtgcatgcaccgtttgaagatagttcaccgtgatctaaagagtgcaaattgccttgttaacaagcactgggcagtcaaattatgtgactttgggctctctcgagtgatgtcaaattctgcaatgaatgataattcatctgcaggaactccggagtggatggcccctgagcttattcgtaatgaaccatttacagagaagtgtgatatcttcagccttggagttatcatgtgggagctttgcactctgagtaggccttgggaaggaataccgtcagttcaggtaaccaccattattcatctctttgtacttttttcatttgaagtatacatctaacgggatatgctgtgtgcttcctcaaggtggtttataatgtggcgaatgaaggggcacggttggaaataccagatggacctctcggaagcctgatagctggtatgatttgagttatttcttactaaataaatgcccatgcgtttgcaatgggtaaacatgaaccttcttatatgtgataatatttttcagaaaaataaatgtcagtattttgttttcgttgaacacaccattcatacttttgttacatggatcacttaacagtttttccataattctaatattaaaattagccataattgacctttccattagaaacgtgttgtagaaacccaataataagaaaataataattggtggaaggactaatgtgtaatattaacaatttcaaggatcacttagtaaaaatattgtagcctacaatcaatggttggttgcatctattggtgctcctgctgtcattttctagacttgtattagtttcttctgtatagtaaaccaacatttggaatgatttaggccctgcttgtttcagcttaggattactataatctggattattagttataatctgaaacaaacaggtagattattatgatagattgttataatctataagccagattagtataatctgataatctcctctaaatgtgcttttttttagattattgggtggctaaagactcactacccttattctactataatccattgaaacaaacaaatcatagcttattctattatagcttattataatccagcttatagtaatcttgctcaataatctggattacaataatgttaagttgaatcaaacagaattcagggccttagtttataaaattagaacttgcatggacattttccttttgggatggtgcttgttgtgaaatttctctaccataaagctatacgagttaacaatctgcataaatcttttcgcaaataccatttttttctatataaataaaaaagatcactgaacactgatattcctgatttcctacactctaatcaagtagcctgatgttgacaagggttagaccagcctgcagtaactgcttggttcttggtgggtggtaaaggaaaagttcaaaaatcccaatgtctgtttttgcattatataagaagtgtttgagtactgttcggagttaaaagttttggagattcatacagattggtagaaaatgcaaaattgcgagtctggtattaaagatgaaatttggaaagtataatcctggtgtgagccctttctgaaacctgttgcattttgttttatagattgctgggcggaaccggataagcgtccaggttgccaggagattctcacccgcttgcttgactgcgaatacaccttatgttgagataatctgcctctggtctgtatagcggttttagaggcagcgaattggttcggcttatacatcgtttctttttcccatttctcatcattttgacatcgttgatgatgtaaattggcaacctgtactataataagcaagcctcaaagcatctttaatgttacaccattggtcgtgtgaccattttccatggtactccctccgtttcatcattttccatggttccatggtaccattttacccgcagccatcatttaccaaatattggacctccgagttttgtccctttcccagttacgaagtgaatttaactgttctccatgaacatgttgcgaggttactgctttaaatggtgcttggaattggctgctctcttcaaggtatcctctacgatttttagtcatacatgtttattagttattactcctgcaagtcgtactggcattcctatacaatcaaataagatgttaaccctcctagtttttttttaattttttaaaaaagctccatggcatgtttagattatagccaatataaatcttgccaaaactttagtaggatttcttatgtatttactaagtcggtaacaaactaaacatacatttttttgggtaactttaaaaaaaatggtatgattaaaaatggcatcaaagtgaatagccgctagttccgatattcaactcaagggatttgttgcgtgtcggtcaactggaacttgtttagcagtcgggtagaaaactagaaacacctgcaaataatctgaatgggacgctccattgttcagcattttctaggattaaataattgatagtcttggctacgcatataaatccacaatatctacaccgcgtggttataccgacacctgaacaaaagaaagtcgcacggataccaacagaaatcaccattttatagctatcatatactgagtatgccgcaagttaatccatagattagggctagaaccacgaattagtcttcacacgacaatagcttcaaattcattatttagtgttgggatcaatcttcttccaaaagaaatggagcatctgacgtgtcttttggaaagaacgactcagctgacatccgaattccgaaagtaagtgatcacatttcaagtttttgaccaaatttcaccgaacgaaagtgacaccggctaagaccgactcaacgatcctcacgcacggcgttcttccacttgccggccacctcctcgagcgcgcggcgcgacgccccgtccggcgaccacgccctcgccgccgccgccgcctgcagctccctcgcccggcgacgcacggcgctccccttctcccctggatccatgagctccttcaccgctgccgcgacctccttccgcgacaccacgccgccgtcgccgccgtgtgccaccggacgtagcgccaccccggctacctccgtcaggatgaccgtgttcatcttctgctcggcgtacagcggccacgcgatcatcggcacgccggaggacacgctctccagcgtcgagttccacccgcagtgcgacacgaacgccgccgtcgccgggtgcgccagcacgcgcacctgcggcgcccacgacgccacggcgaggccccgcccgctcgtcctctccacgaagccctcggggaggaagttcatcgggttgctgtggcccggcgcccatggagtaaggcagcctgcccgtgctcggcatgcgcaccacccagaggaagttgtgggcgctcatctccagcccggcggcgagctcggccgtctggtccacggacag

SEQ ID NO: 92588 - DNA, 11156 bp, Oryza sativa
  unsure (1)..(11156): unsure at all n locations
tttaaatgagcaaaggttacacaccccttggcagcataaagcatatactaagttgcggggtttacagtttaaaatctgttataggaagggatctagcaatgctgctgcagatgcactttcaaggaaatacaacctggaccctgttgacctcatggcagtttctagttgtgtccctgtttggctccaagaagtggctgctgggtacttgctagatgagcaaactaagcaacttttagcagaactgtccctatctgtcaattccaaacctcctttctctcttcataatagtattatcaaatacaaaggtaggatctggattggttacaatactgaattgcaacatagaattatctcaactctacatgacagcccaatggggggtcattctggtttccctgtcacatacaggaggattaaatccctttttgcctggcccaaaatgaagcaaactgttcaaagggcactcaagggctgtggagtttgtttgcaagtgaaacctaacagaagcaaatatcctggtcttttgcaacctttgccagttcctgatggagcttggcaggttattactatggattttattgaaggtntacctaagtcattcagatttaattgcattatggtagtggttgataaattttcagaagtattcccactttgttcccctggcgcacacattcactgcccttgaagttgctgatcttttatgcacaacatttacaaactccatggccttcctcattacattatctctgatagggacaaaatcttcacaagtcatttgtggcaacagctgtttgctaggtctggaactcagttgcacctaagcacagtctatcaccctcaaaccgatgggcaaactgagcgtgtgaatcagtgtttggaaatctttttgcgttgttttgtgcactctatgcctcataaatggagcagctggctttatttggctgaattttggtttaacacttcatattattcaacacttctgaaatctccttttgaagtcttgtatggctatcctccgggacattttggtatccgtgatgattcttgttctgttcctgatctggataattggttacaagaaagaaaacttatggttcagctcttgaaacagcatcccaacagagctcagcagcaaatgaaatgttatgctgataagaacagaagcgttcgtgcttttgaagtgggtgatttcgtctacctcaaattacaaccttatgtgcaatcatctgtttcacggagggcaaatcataagctatcttttcgctattttggaccctatcaagtgttggccaaggttggcaaggtagcttatcatcttcaacttcctagtgacagttctatacatcctgtctttcacgtttctcaactgaaatctgctgctgggttctccaaagtggtgcagcctcaacttcctgaaatgggtcaacttaaggtccctgaagttattctgaacactcgtcaggttcaacggggtaagtcattaatacctcaagttttagtttgttggtctggagatgttgcagggcaggagacttgggaagatcttgttgatttgcgtcagcgctttccagcagcgttggcttggggacaagcccaatctcaaggagaggggattgtcaggaacctgacgttgctgggtgagctacaggaagctgacaactcgagggaggaagaacagacttatgctggaagaggagcaagagtccgtaagtgtaacacgcgtgtgtgggccggattggaccaaatgagtaccggccgagcccacgagtaagtctggagtaagagagagagttgaattgtaataagaacatagcacgttgactttctttcgtatcgatgaagtaagaactggaggcgaaggcggcggcggcaccaattcttctggattcggtgaaactatctcgtttcttgcctgttcttactagttcttgagtagttgagttagggttctaacacaacgcaaagaaactagcacattaaatcccacattgatgggaccaaaactgatgttgttgggtggaggcgacgctatagctcatggtcttggatgcaggtcttctacagtactgcatatattgctcactgacatgtggatcccacagccacttgggcccacatatcagtgagcagtactgtacatgcagtactgcaggggatctcaattgcatggttttgggtagagtgtgagtgacaaagttgctcgacttcaataggaggcggtggcatcctcatcacggctactcttgtaggtggaggcgtcggaagacggagcagcggtggacaatggtgcctccagtgcaggggtggaaccagacaggactaacagaaaggactgaacaaagtatataaaactatagctccttcttctaataaatatatgatagaaaattttagtgaaaacttaatggggcttccatggttataacgctgatagcaaaggctcgcgtccccgtcgtccccatggcagatccgccactgcctccatgttaattagaccgcagcagagactcctgcattgttgagatggagcaacagggtggagggaagggcaaggacatggttggccttgatgatggagcttgatctattatccgccgcttggatcatgtaacttcaaatgaggtactactgatatatatatatatatatatatatatatatatatatatatatatatatatatatatatatataagcaatctcaggttgtcttgataaaaatgttctgccgggctgaataattggttatatttgagcttacccaaaaaaaattatcctttatacaaatgaaataaagtagctcagcttcatttagacgacgggattagtacgataccgtagggtagttcgactacgctttgcttttatttttttcccctcgtgaccttttgtgtgtgtgaagcggtataggagaggaagaggagcaataggggacatcggtgctccagtggatggaaggcctcgatggcagtagcagaggatgtttgcaggcatggatcacatgagtagggtggcagccggcaaagggagtaagggagacgcctcgaatggcgacggaaagagctcagctccagcagcaaatagtatagtggtggtagcctgtggcaatggctataagagaggggagatggggaaattggattcagtgggttgtggcggtgatgcgatgagaggagggaagaggggtactagcagaggagatcagccgatgagaaggattggttggacatggcagagagaggagagctcgaagagcttgatgcacagtggggagaggggatgtgatgatgacgaaccgcagcgacaatggtgccacagggaaggagcgagacgtttgctcggtcggctaggccaagcgctaacatgtggggcccacgtgggtcccacttgccacatcagtgaaaaatgatcattacactgtcgacagaccaaagttaacacggtattatgaattagtgtatgggctatacctagtatttcagtgcatggacgaatttcagactcagatgacaaattaagggacctaaagtgaacttattcctacaaaattataacttccaaatgaatacttaaaagcttattattattattatggcgtggatgcacatggatacttatcattatacacgtgacgacatatatataacatatgcacacatccataaatatactcccaacacacacgaataggcggagaacaacaatacgtctctaatcttactaaaatacgtgtgtactccctataaattttaatgtataacgccattgaccttttgaccaatgtttgaccattcgtcttattcaaattttttgtgtaaatataaaaatatttatgttatgcttaaagaacatttgatgataaatcaagtcacaataaaataaatgataattacataaattttttaaataagacgaaatgtcaaacgtttatcaaaaagttaacgacgtcaaacattaaaatatggaggggataatatttaacaccatgtgataaatagttgagacaaaatatactttatacgattattactcaagtaaatcagtgcagagaccgccagactggtaaaaagtggtgacagtaatagattaatagtacttctagaagaaaccgcgatacttaaatatgagatctgagcaattagggtgtgtttggttgcccatattcccctagcctggctcatttctcgcatccaggctgagtttgacctggctaagagtatacatatgcagttgtttggttggttgcattggtctagccaggctagcatgagattttgtttggttacttgtataagagatacggtttgaaagggattttgtttggttggttgcatggatgtgagtgttctttacctcttcatttagttgggtgaggttacctctacaatatatataacaaataataagagtattttgatttatccaattgaatattcacttacatatgcgaatgatactgcaaaatcactctattatctacataaaataagtcggccaacttttcacaccgaatcagtggtacgaaaaataagaaaaaggttatctattatattattaaaggaatagaaaaatgagcctccacgttcgctctcatggcctagaaattctcacattaatcggagaaaaagaaaaagcagagtccatgtagaaatacaatttagaaaatagctgaaatttggaattaaaaaaaataagaaatattagaagaggagactagagtccatatagaaatacaatttagaaatagttgaaattcggaattaaaaaataaggaatattagaagaggagactagagtccatatagaaatacaatttagaaatagttaaaattcggaattaaaaaataaggaatattagaagagaagactagagtccatatagaaaaacaattaggaaataactgaaattcggaattaaaaaaataagaaatattagaagtagagtatagagatacaatttacaaaaaattcggaattaaaaaaaagaattattaaaagacgagtctagagtaggaatatatataatttacaaataactaaaactcgatattaaaaataattaataactaacacgtatataaaataccatatgaatattacacatttgtagtttcgtaaagttattgtaaaatttaaaattatgatgttattttaatatatttgaataatataataagaaaacatatatgctattatatgagagaaaatataatgatgctagcgcgcaatctgtgcatgccactatgctaggttttctttaagctagatgaaccggtggaactaattaatctattagtagtaattctgcatacattgacttctctgttgctggagtacttgctagtgagaaacgaaagaaaaagaaaacagaaaacccggggagaaaaaagaaacgaaagagagaaaggaaggggatcggcgttgcagccgtcgcttcgtcgtcatcaactcccgtccgcccgcagccgcatgcatgcccacctgcccgccgctcgccgttcctccacccatcttcctgcgctcctctccatccgccgcttgccgctcctctgctccagatctgaccggcacagaagaaggtgggatacgacggtggccgacgattgaagatgggatacgatgggaagaggagggatgcggcagcaaggtggatccgccgtcctcgtcgccgcgacctccgctgagctcgtcaccgtcaagctttttgccgcctcaccactagttggatctggcagtgctcacaccatcagcggggacgtgtgggcaaggcggtggccggatattgaaggtgggagacggtgggaagaggagggggatgcagcagcaagttggattcgtcgggcgccactccctctagcagagctcgtcttcgccatgtcgattgctgggggaaaatgaggaggagcaaggggcggagtggtgaccccatcgcttgcccttgcacacgcgggtgcggggcgctgcatgcgcggatgcagcgcgttgcatcgtgcgggcctggccgagcagcgaagctcaacttgagcgtttctgctcagcctggctgtgggggattttttgcatccgctcgaccaggctgggagcgagctgcaggcaaccaaacagcgacctactgcatccacgcgtgcgagccaggtttcatgcatgcaaccaaacacacccttaatctctccctccatgcatcacagtcacacacaccgcgagctccgagctccgtgctccatggatccgtcacctcggccgtcgccgcacgtcgtcctcgtagccagcccatgcgccggccacgtcatgcccatggccgagctggcgcggcgcctcgtcgcgttccacggctgcgccgccacgctcgtcacgttctccggcctcgccgcgtccctggacgcgcactccgccgcggtgctcgcgtccctcccggcgtcctccgtcgccgccgtcaccctcccggaggtcacgctcgacgacgtccccgccgacgccaacttcggtaccctgatcttcgagctcgtccgccgctcgctgccgaacctccggcagtttctgcgctccatcggcggcggcgtcgcggcgctagtgtcggacttcttctgcggcgtggtgctcgacctcgccgtggagctcggcgtccccggctacgtcttcgtcccctctaatactgcgtcgttggcattcatgcgccgcttcgtcgaggtccacgacggcgcggcccccggcgagtaccgtgacctcccggaccccctccgtctcgctggggacgtgacgatccgcgtcgccgacatgccggacggatacctcgacaggtccaaccccgtgttttggcagctcctcgaagaggtgcggcgataccggcgagcagatggattcttggtgaacagcttcgccgagatggagtcaaccatcgtggaagaattcaagacggcggcggagcaaggcgcgttcccgccggtgtacccggtggggccgttcgtccggccatgctccgacgaggccggcgagttggcgtgcttggagtggctggatcgccagccggcagggtcggtagtgttcgtctccttcgggagcgccggcatgctgtccgttgagcagacgcgcgagctcgccgccgggctggagatgagcggccacggattcctctgggtcgtgcgcatgccgagccacgacggcgagtcctacgacttcgcaacggaccaccgcaacgacgacgaggaagaccgcgacggcggcggccatgacgatgacccgctggcgtggcttcccgacgggttcttggagaggacgagcggccggggcctcgccgtcgcgtcgtgggcgccgcaggtgcgcgtgctgtcgcacccggcgacggcggcgttcgtgtcgcactgcgggtggaactcggcgctggagagcgtgtccgccggcgtgccgatggtgccgtggccgctgtacgcggagcagaaggtgaacgcggtcatcctgacggaggtggccggggttgcgctacgcccggcggcggcgcgcggcggcgtcgacggggtggtgacacgagaggaggtcgcggcggcggtggaggagctcatggatccaggcgagaaggggagcgctgcgcgtcgccgggcgagggagatgcaggcggcggcggcgagggcgcggtcaccaggcggggcgtcgcaccgcgagctcgacgaggtggccggcaagtggaagcagacaaaccgtgctccatacgaataatgctgtttagtttggcaaatttcgttgttcgtaaacgaattcggctcaaatttggttggtgatcactactgacttttggtgatcactgcattgctatctcgaaaggaaacctcaaatgcttcatttctctcttcttttttttttttgaatggaaatgcttcatttcttttggaatctgatcccatcgtcctgaacacagattaaagaattgtaagcatatttcatgtaagctgattctcctgcccctatacctagtttatgtacgtacccaaacttgcacaacatacaaaactgtttgctggtgttatgcgtgcaactttctttcatcgcctagggtgtaaaaactttaaagtatacggacacacatttaaggtattaaacatatactaataacagaataaattacagattctgactataaattatgagatgaatttattaagcctaattaatctgtcattagcaaatatttactgtaagcatcatattgtcaaatcatggtgtaattaattaggctcaaaagattcatctcgcaatttacatgcaaactgtgtaattggttttttccccacatttaatgctctatacatgtgttcaaacaattgatgtgacgttttcggccaaaattttttgggatctaaacaaggccctaggccatgttttttttctcctagtagtacgtgcacatggatttatagattttgtacagtctagttcatattctatttttcttaggtttagattcaggccgtgtttagatccagcggtaaaaagttttgacgtgccacattagatatacggagacacaattaaagtattaaacgtagactaataacaaaataaattacagattccgtctataaaccacaagacgaatttattaaacctaattaatctgtcactagcaaatgtttactatcactactacacaaaacattttcatggacgccggacctgtttgtttccaggcaggccataattggcactgcacgagataatcaggggaccggcgccagaccgtcgcccgcacggaaaaacgcattatcccgtgcgggccactttactcaaccgcacacgaaaatgtcgtgctggcctctttactcaccccgcacgcgaaaacaatcctcatgccaacttgctacacgactgccactttaactctcccactcattctctcctcccactccactccttctctcctcccggcctctcatcctctcctcacagcagcgacagcggcggcgtgcggtccctccctccctctcccttcggctcccttcccctctcctccctccgcttgcagatccggcgaagggaaggcatggggacggcggatccggcggcaggcgcaggtggaggcggcaggtgacgacggcgcctcgcggtccctccctccctctcccttcggctcccctccctccccttgcaaatccggctgaggggaggcatgggggcggcagatctggcggcgggtgacaacagtggcgcgcggcccctccctccctctcccttcggctcccctccctccccttgcagatccggtggaggggaggcatgggggcggcggatccggcggtcggcgtaggtggaggtgacagcggcggcggcaggcgacgacggcggtgcagaaagagagggagacgccgatgagggagggggtggggaggccggcgagctttctcgaccttctcggtggatagagtaggccggcggagctcacccgccgctgcttcactcctcctgcagccacctccgctgttgctgccccctccaccgctcaccgccagctccgctctactggctttctccgccctatgccgctgcgccctatgccgctagtagcctcccaagtttactaaagaagagaagagaagaaaggataagagaagaaagaaaagagaaaagaagatttgctgaccccacatttttccttctcacttatatgtgggctccataacttttttttctgactaggatgccacatcagcgtagccagatatccatactgctataggacccaaattgcatggttttgtatagtttagggggtgaagatttctagtattggggattagggatgtcatgcgaacttgatgtaaagttgagggacggctggtgaacttattccaaagaaggcctaggagggagggaagagaagaggacttcgatggcgggccaaaagtgaaagagagagctttgggcaggattcgccccaaaaagatggagatgattaattttagttttatcattttaattaaccctgaaattggttgttgttgatttaaaattataggttgctctgaaaatttcagtaaaaattgagggaccaatttagagcatggagaatttaagaaaaatacaccaagccactttgaatttttggatgtattttagtatttgaaatttatttgagacttttattaatttctattattccttttagaaagtgacttttaatttgggatggatctatcaggtgtgacataacgataagagagctccaaattaatttcaagacccaaattaatctcgcgttagatgttttctttcaccttcgagtagacaaagagctctctctgtgtgttccatcttcctttggttttggttctccctgagcagacttgtgtccgttcttctgtttttgcgctgattcagttgttcctcgatcctgaatacttgcacgcatgagtatttgggataagcatgcctccggaacgccatccaccaccagagtacctgcactggtagacatgcggttaagtttgtatcatttgtttcaacatataataagtaaagctaaacatatgtacttctagcttgttgatgtgtaacataagcatggttatatacaagctagtgatgttctcatcagtttggatatttataaaaaacagcaataatgcacacgctcacatatacacatacacttacgtaataatataaatacacacacatacactcattaatacgaatgcacatgcgtatatactctaacccatacggtccaatatatgccttattacacatcactctctagtctctacttgcatggaagcacgctttatctaccaaccagcttgttcagtatgccaccatatatagattatggcacacatatcctccataaatcatcattttagtatatatttgctttctattcttgtatgtcataatgtcattcatcaaacttgtagcttgacaatgtacgtatatatagagggagagatatgagatatgatgaatcgaatttgaagatgctcggcatacccggagcatgtctaggcaagctgttgtccggcctggacatttctataattactaaaacttgaaaaaaaaatccaggaagatattaggcatttgtcattttgccccctatgttcaatttttgtgggttgttagtttataaaaatatgcatagtttatcaagatgggactgtaatctc

SEQ ID NO: 92589 - DNA, 621 bp, Oryza sativa
acccccatcggcgccacggcgactcccgcggcgctgcacgtcgccgcacatgagcaccgaccccaagaaacacaaggggttcgacgcgtgtcgcgcgcgcatactgtggacgaagatcttgaggagtcggcgaaatgtaagccgtctgggaggtctccttgattggggagtcgggcccgaggaaggcggcggccgccagtggtggcggtggcttcttcgtacgcgctccgctctgctttgcttctgctgctccgctcgcaggtggggaacccttgcccaccaccgccgcccgctccaactcccacccaccgtcgccgcccagaccgccgattgcgccatgagagataaaagagagaagggagagatggaggaggaaggagaagagagaggggatgatatgtgggctccacatgtcagtgggccataatattttttaatgtgtgcatcacagataggtcccacagatgaatttttaattctactgccacgtaagcgccacgtgggatgaagactaggtcagcatcgccacgtcagcgccacatcagcaaaaccgctctccaaaaccactaagggagtcaacttgcactggtttcaatagttcgaggagtcgtcctatccggt

SEQ ID NO: 92590 - DNA, 740 bp, Oryza sativa
cgccttaacatagcagttggcgccagttatattctcctactcctccagcctcccagatcatcccaccagtggcgaagagagaataaggagagaaacatctagagtgaataagaaagatggggttcgtccgtgccctgttcctgctggcgatggtgtgcgtggcggcgcacgcgaaggactaccccaaggaggagggcgcgaaggcggaggggccggccgccgcctcggggggcggcggcggtagcacccacgacgtggtgaagctgggcggcaagggcgacggcaagacggacagcaccaaggcggtcaacgaggcgtggacggcggcgtgcgctggcaccggcaagcagacgatcgtcgtccccaagggcgacttcttgacgggtcccctcaacttcaccgggccatgcaagggcgacatcgtcatccagctcgacggaaacctgctcggctccaccgacctcgccttattcaagtcgaactggatcgagatcatgcgcctcgaaagcctcgaaatcagcggcaagggcaagctcgacggccagggcgccgccgtctggagcaagaactcctgcgccaagaaatacgactgcaagatcctccccaacgtatgcatgcatgctttcctgtgatcgatccatcgagacatacacattaattatttatttgatcgaccatttggtatgatccatggatataaatatatgtgcagactttggtgctggacttcgtgaacaacg

SEQ ID NO: 92591 - DNA, 709 bp, Oryza sativa
ctgcaccccgtccgtggatatggccatgcccgacgtgaccttcacaaggagtatagttcattaattactaatcaacatatatatgtaacaaatttcgcatttcgcataccttgatagacaagttcctgaatggagtatgcatatcgcagggtgttcgctgcgtgatatcaccaacggggaagtgggttgcttcgtgagctgccactgcctcaatgccctctgatccaacttggcccgttgatgcgcagctgctgcggttgcccgaggggctcaccatgacgggcgcttgtgtttccattccgcgctgctcggccaggcgttggtccacctgtcttgtcacctcctcttgcatccttgcctcgtaggtggacaccctgtactcaagatcgacgatcttagcttctgtatccctcttgctcctcatccaactcctatacgtgtggatgtcctctttgaatccatatttccaaggaatgacgccttttcctcgcattcgtcctagatgctcaggattctgtagtgcgagggtgagctcgtccttctctgtcgggccggaaagtcccctgcgtagaggcttcaattgcatccgcaagtcggcgtgctgcatctcgaatctcatcgccgaatatgagggagccatcacctggattgagcgatccaccgtgtgcatagaaccagttcctcgatcgctcaggccaattagccgtgg

SEQ ID NO: 92592 - DNA, 831 bp, Oryza sativa
actctcgtcgacaactcttggaacattgaacatcttcgtcgtttctatgcttaagcttatcattgtggttcccttatcttgactggcaacatcaaattttcttcttgccgttgtcaatccggggctatcatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtattgtacaaattgagcctccatttgctacatttacactcagtcagaatcaatcctttcatcatcagagttattattgctcggctgaaggtcgttgttgcggaattgctctacaacatcacttgcaatcttgtcagccgcactttgagcattactgataagatcaagagcagcttcttcacttgtcccgtctgcaaagccatcaatggtatcaatttcgattctcgggtacaaggatttggtcattgccaatgccatgctagctcccatacttccagctttcttgatgttcttgaagtacacatccggtgcaactcttagcttgtcaaagatctcggttgcatcaagtgcactcggaccactgttattaagaaacatagcttggacaagtggtgtagcgacattggcgacttcgtctcttgctccttcaagcttcttgatcttaccaaccaggacatcaaactgagcttgagatttgattttacggtctacaaaacac

SEQ ID NO: 92593 - DNA, 703 bp, Oryza sativa
gtagctgacgacgatggcatttgagaagattttatacattctctccttcatgattttgaaatccagagagtctggttcttcgcgattaggatcatgcttgccgtcaaactcaaaagctgtatgggatctttctttaattggcgccagtcggcatttgatgaaatgccgagtgatctgctctccttgcaagccttgttctttgagttttaacatgcgatccaacaattccaaggcttgggcagcttcatctccgattggaagagagttccaagtgtcttggtacaccggaggaagacaagaatactcgggaagagcaggctcaggattctgaacataaaaccagttcgcatgccaccctttgtttgaggtcttgaagggcatagagaagtacttctgactcagagttcccctcaactgaaatcctgcccctccgactacacatggcttattcttgttcggttggggcttgagaaagaagatccggcgaaacagagcgaagtggggcctaattcccaaaaaggcttcacagacatggatgaaattggcaatgtggactatggaattcgggtttaggtgatgcaagctgattccatagaagcttaatatcccgcggaaaaatttcgaggtcggaagagcgaagccgccatagaagaaatgagagaagaccacaatctcgtgtgtatcgggggtcgacaaaatctca

SEQ ID NO: 92594 - DNA, 1125 bp, Oryza sativa
ttatgtcatgtatgctccatctagtttgagataatgtgattgaaagagtcttgaagattgtatatgtcacctagagggatgaataggtatttccaaaaatttcttaaacttacaaacagcttagaactaactggatagtccggtaccactgcagacaatctgactatagagcagtcggatagtccgactgcatcagaacaatccaatcagagcatcgccagagaaaaactataagtgacctggaaaatagaaatagaaatgaaaaaataatggtggtggtggcaggatgtagcgtgggttgatcgtttagaagcacgaaagctccttgaggcagccggtggcagtgcccttggcattcttgcagacggccatggtcttgttgtttgtgccagagtactcgaccttgatgtcattcaaagtgacgccggtgcacggcagcttgtctgagcagaagaggctaacggcctcgggcgtggaggaggtgccggtgatgttcttgaagtgatgtccttgatggtgaccttggagttgccgttggcagtgcagatcttgttggggcagtacttcatgtcgatgatgatggggttagcaacgtcctccatcttgatgttctcgtaggtaaacttggaggtggtgagcaccgaggcggcgtcctcataggacttgatccggacgccattggtagacttcttgagcacgcagtttttgacggtaacatcggtcacatccttctcgtccttgtacctgcccaggctaccgacgctgatgccgtggccaggaccgcaggtgacgccggagatgttgacgccctcggtgccggggccgatggagatgcaatcatcgccggtgccgatgaccgtgtcaatgatgctgatcttggaggagtcgcccatgtggatgccgtccgtgttcgggctgtcccccggcgcggtgatggtcacgtccttgatggtgatgttcttactcttgaacacgttcatgtggaagaacttggggttcaccagagagatgccgctgatgagaccgttgttcacgaagtccagcaccaaagtctgcacatatatttatatccatggatcataccaaatggtcgatcaaataaataattaatgtgtatgtctcgat

SEQ ID NO: 92595 - DNA, 727 bp, Oryza sativa
  unsure (1)..(727): unsure at all n locations
aagaacaaagcacgtcgaggaagaaggacgacgacgacaccccggcaggttttcaagatcaccgcaaggagctcaaccatatcttcggcggccccctggcttatgagtctaaacggaagcagaagttaactgaacgggagatcaatgctgttcagcccgacacgccccaatatcttcgatggtcagagatcgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccctggatgatatgcagatccctcgctccgagttaaaaccaagcaatgcgccttttcacggagtgattccaggattatccgcaactccactcggccagatcaccctcccagtcacttttggcactcgggaaaactttcgcacagagaacatcagctntgaagtcgctgatttcgagacagcataccatgccatactcggacgcccggcgttagccaagttcatggccgtcccgcactacacttatatgatgatgaagatgcctggtccccgaggagtcctatccctacggagtgacatcaagcaagccgtcacatgcgacaaggagagttgcgacatggcccaaactcgcgagatggcgtctgcccgagaggatatccgactggctgc

SEQ ID NO: 92596 - DNA, 1479 bp, Oryza sativa
gcgccttagcaaccgatacaccgtctccaatggtcgacgcgaacttgtggtgcgcgtcaacccggccacgagggcactcctcctgcaagcaattgaagaacaagcaagaacaagtagaacaagcactgaaattgctatataaagatgaaagtttcactatcaaatacaatatggtggggttccgattacaggcagacgagcggtttagccaacacgcgcgctgtgagccggtagcaagtagctatctctatcatcaaaacccgaatgttcttggcggcgactagaggtataagaagaggggaagaacgaccatagggtcgtgctccaaccctaggacgtgcccctaatgggcccaacttggatacacagcccattgggccaaaagaggtgacgcaacaccatggacagaaaacagtcgggagtaaaatgacaattgcggccgctccagaatagatatggacatgtggctggatccatttgaaagtagacttgataagctttccatgaaatacttgcacgcccaaatcggagttcgcttgaagtcgtggcggccgtcagaagttggcgctgccctgcagtccgaatccaccccgcgcgaatcctcttccctttggatcctctccatcgttcctgagtaaaacacaagtgcacgcgtctccggggtataaagacgaggcatatgaactcaagaaagaactcacctgataatttagttgacgtgcacgagcgcgggtaatagaaccatcatgttgtacatggggggacgtggatgtatcgatggtgttgatgtcctcatcatcctccccttcttgcatttgagtcgtcctcgactcatgctcatcttcttctcccaaatacggcttcaaatctgcaacgttaaatgtgggactaaccccgaaatctgcaggcaaatcaagcttatacgcattctcattaatctttgctaacactttaaatggtccatcagctctaggcatcaatttagactttcttaaatcaggaaatcgttcttttcgcaaatgcaaccaaaccaaatctctaggttcaaaattcaattcccttctacctttgtcaccagcaaacttatacttagcattcatgcgctctatgttttctttagttgtctcatgcagttttaacatcaactcagcacattgcttagcatcaaaattcagtttttcagaagatggtaaaggcatcaaatcaattggagcacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggatgacaagtagtagaaaacaaaagtttagtccccaatttagcccacaaagttctccaaaaatggctaagaaattttgtg

SEQ ID NO: 92597 - DNA, 984 bp, Oryza sativa
catggctgacaacgaaacggaagaacagcgccgagcctaagaagcggaccaagatcgcgcacgacaagaagctgaacgtcgccgactggaggaagtgcgacagcgacagaagcgagaacgaatacagcgtgagcaacaagatcgcgaacgggttgcaaaggaggctgaagatcgacggcaacgcgctttggaatccgggtgacgagcgagagagttcattgggcaacaagacgtcgatggaacagcggtctttcgcaccccccagcagaacgcggttgcagcaatcactcttctcgacaccctcctcaaagaagacgcactcaaccaagctgatcatgtcgtcaacatcttgaaccagacgaagaccatgatcgctgcctcggttccagccaactccgcaagcacccgtaccccgactggtagccgagtccctcacctccgatctcatgatcatcatcagtcaaacctcagcatcaccggcacaggatctagtcgcaggagcaggggtcacgacgaacgatctattcactcgcctcccgaacgtcacagggagcgccgagtcgaacggcctcgctctccacctcaccagcgccccgtcgatcttcgcgacacaatcaactagcgccgtgcagcacgaggtcaccgccattcaccaaatcgctacgatgacgacgtggatggagtagctgccttcactaatgacctgcgtcgagtggattggccagtcggctttaagccgactggaatcgagaagtatgacggcaccactaatccagagtcttggctcaccgtctacggactcgcgatccacgcagcaggaggagacagcaaggccatggcaaactatctacttgtggccctagcggactccgcccgatcctgtctccacggactaccccgtggcacgatcggatcatgggtggaacttcgtgatcacttcatcgccaacttccagggcaccttcgaacgccccggaacacagtt

SEQ ID NO: 92598 - DNA, 645 bp, Oryza sativa
cgtcaggttttcgggactgatattctaagggaaaccagaaagagaaggtaaagatcattcaagaaagattgcgtgtggcttagtctcgtcaaaagagttatgccgacaatcgccgcagagatttgagttttgaagaaggagatcatgtgtaccttcgtgtcacgcctcttcgaggggttcatcgttttcataccaaaggaaaattggcaccgcgtttcgtgggaccttataagattgtcagtcgaagaggtgaggctgcttatcagttggagttacctcaatcgttggcaggagtccataatgtgttccatgtgtcacagttgaaaaagtgtttaagggtacccactgaggaagctaatcttgaacagatagaaatccaagaggatctgtcatatgttgagaaaccaatccgtattttggagacagatgagagaagaaccaggaatcgagttatccttttgtgtaaggtccaatggagtaatcactcggaagaagaagctacttggcaacgagaagatgaattaaagtcagcttatccgcatctgttcgccaattcttccgaatctcgagggcaagattctgtttaaggggggtaggtttgtcacaccctaaaaatcctaaatatataaattgttgtttaattgg

SEQ ID NO: 92599 - DNA, 1035 bp, Oryza sativa
atagacccatctgggaaagactctgacccgactaacatggacacgagttcttccaaagaaaccgggccaactgttggggatcacccgagtgacaatcagccggcaaccgataatgtagaatccagtgatcaacctccaactggaacccagtcggtcgaagctgaagccggagttaatcaggagcccccgactggaaaccagtcggacgcaaggtcaagccaagagactccagaagtcgaaacccaagcagatagccctcatggacaaaacgccagcaataaccagagatctggatctcctttaaaggcatccgaatccactcgtcctcgtccagaaatcattacgggtaaacacttttgtttgaaaccatgttgacccaaataaactctgatcaattgtctaacctttgttagcgaatacattaggaccaatgattagtgatgaagaagaaatcccccgtatacaagcagccgaagattcgtgccctcccattctggtcaagtggtgggatgataacttgcagcctcaaggaattgtaataaaccggcaaaaagaagacgaagaggtctgccaactgaaaaaggcactcaaccaagcgactcgcattgtaaatgtaagttctctggtacctgatctcaaccatcttgtttgccatttaattcatgcgctaattaaactgtcttgcagaggattcatctcaggaaggaagccaaaacggcaaccttagagaagttagtccctcatctcggaaccctcgaagccaccaggaatcaactgcacgaagcgaaagagcttgccaggaagaatgaacatgacctgagggatcggatcgctgagctccaggaatcaaattttgaactgagtggcacatcaaaaggtacgcacaaaccctgcttaactgactcatactgttatctttgcaatcttccgtaatcaatgtagtgcaagctgccaagatatctcagttggagaagcagattcaaattctggaaaatgacaaggcagagctggcaagacaaagagacctggctttaa

SEQ ID NO: 92600 - DNA, 753 bp, Oryza sativa
cggtgaggatgtagacatccaacaacggcggcataataggccagccgtgtagcggaggcaccactcggcggcgacgaaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggatccactcggcggcgacggaggcaggccggcggtgaagtcgtagacgcccaacagcggcggcataataggccagccgtgtaggcggaggatccactcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcagtatgataaataatgataaaaatcagatt

SEQ ID NO: 92601 - DNA, 807 bp, Oryza sativa
agactgttttaggagtcggccaactttgaattgcctcaacttggcttgatcaacctcaatcccctgcggagttacaacatagccaagaaaagaaactcgatctgtgcaaaagctgcacttctcaaggttaccaaataaacgtgcatcacgaagagcattaaaaacagcacgtaaatgattaaaatgttcacccatagacttgctgtaaatcaagatatcatcaaagtagaccaccacaaattttccaatgaaaggacgcaaaacctcattcatcaacctcatgaaagtgctgggtgcattagttaaaccaaaaggcatcactaaccactcatacaacctaaacttcgttttaaatgcaattttccattcatcacccaacttcatacgaatctggtggtaaccactacgcaaatcaactttggagaacacaatagagccactcaattcatcaagcatatcatcaaacctaggaaaacgatgacgatatcgaatgataatgttattaatagctctacaatcaacacacatacgccatgaaccatctttctttggtaccaaaattaccggaaccgcacatggactaagagactcgcgtacataccctttatcaagcaactcatgaacttaacgctgaatctccttggtttcctcagggttggtccggtatggcgcacggttgggtagggaagcacctgggatcaagtcgatttgatgctcaatgccgcgcaccggtggcagccccggtggcacttccttgggaaacacatcagagtactcctgcaaaatgttagcaacagcagggggcaa

SEQ ID NO: 92602 - DNA, 733 bp, Oryza sativa
caacggtggcataataagtcagccgtgcaggcggaagtaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggtggcataataggccagccgtgcaggcggaaacaccagtcggccgcggcgaaggcaagccggtcggtgaagacgtagacgcccaacaacggcggcataataggccagccgtgcaggcggaagcaccaatcggcagcggcgaaggcaagccggtcggtgaagacgtagacgcccaacaacggtggcataataagtcagccgtgcaggcggaagtaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggtggcataataggccagccgtgcaggcggaaacaccagtcggcagcggcgaaggcaagccggtcggtgaagacgtagacgcccaacaacggcggcataataggccagccgtgcaggcggaaacaccagtcggcggcgacgaaggcaagccggtcggtgaagacgtagacgcccaacaacggcggcataaagg

SEQ ID NO: 92603 - DNA, 5707 bp, Oryza sativa
accccatcatcatcgacatgaagtactgcccgacaaagatctgcactgccagcggcaactccaaggtcaccatcaaggacatcacttcaagaatatcaccggcacctcctccacgccgaggccgttagcctcttctgctcagacaagctgccgtgcaccggcgtcactttgaatgacatcaatgtcgagtacgctggcaaaaacaacaagaccatggccgtctgcaagaatgccaaaggcactgccaccggctgcctcaaggagccgtttctgaacgatcaaccacgctacatctggccaccaccaccgttattttttccatttcaatttctatttttcaaacaaagacaagagagggaacatgtgtgcagattggtcgctgagatcatcgccggtcgatccaccacaaacactagaatttcgccctctttgcctccatgatatgcgtctagctgaaaattttgtttactaattgtacgatgcaactgtagaatcatgtgatgaataatcttggtgacgaccaaatttgaaagataagtgttcattgaaaatacggcgaatagtgttttctgtctgtgaatagtgtgttggcactgtttattcaaaatacggtgaatagtgttttctatagttgaacaatgtattggcattaggagccgggcggtgcacaccagtttgaccgcacgtgttcaggcggtctgaccaggtagcccgacggtcagaatggcagactgggaatcggtttcaggttgttttcgttaaatttctagattgctttatatttatgacttctagatggtttctattcctatgtgatactattgtgtgctgaagtgagtctagttggtgcgaacttttattcggatatggagtttttctttgttcatgtgcaggtgttgcttgagactatgagaatatagcctgtgatggatcaggactaggcttgggagaagttgaagtccagatgatcaagaatatcacgcgggatgctcagtctagagaatattacatagtggagttgaaggtttccatatagcgtacatgtggtgttgtgtgcatttggaaagaggaatcaaatttggattggtgtctaagtttgtaaagattgcagtgttgagttgtatggggatgttgatttcatggtttggtaggatcaagcttgggggtttgttgacggtcgttatagaccaatttcgaccgtcaatataattaaaataaaggagaactagttatgcttgctatgcatatttgttttagaataatctattttcacttgtacttagattctatctgtcagtagataaaagagatacaatatggaggaggaccaatagcaaaacactcaaacaatcaatcagatgctaatcagacttgtggacaaatgtgccagaaactcagaattgacacgatcaaataggcccataattcactgttttgagtctagaagcaaaagaggaggcgacctgccgagaactgggttaggccggcacagcccagggttcgaaccagtcccagcatcgttcgatccaggcctttgatcagacggtgggaattcactcccaacggcggttggagggtctttccgactttccaaccaccacaaccgtcattcttcagttataaaaggccctcacctcctccactcgttcacacactcaagcaagctcaagatatctcttctacactttagtttagtattctagtgctaagtggagtagaatagaatagctctcgttgtcctcggagtcttcggagaaatttcggtatggttttagtagttttccttctttcttttgtaaggctttcgaaattaatgaaatactattcattatatacttttgatactttagtatatctgagtatcgtctttactttatatctgtatcggtacagtcgtatagttagtctaccagagaggtgcagtggtgtgggtttaatgtctgattactcggttactctatgtcatctcgggggatgtagaatagtatttaataatgtagacgtggtgtctagattattaagtatcattatctgggcatatatgctacgggtcagtcgaggtgggccgctgtcacaccctgaaaatcactaaattataaatcattgtgaaaaaggaatttttagaaattacttaatgattaaagtaagtgtgtgaataaaatctataagaaatttgaacttaaacttgagctagataaaatttcattaaatattttgtgtgcccaagtattttcaggatttttcttggatttatttgtgcattggaagtatttttaataaataaaagatcatttcagcaattatttaaattaaaaagttaattaaaattcctcttctttgtctgggccgaattcagcccactcctctcctctctctcttccttagcccgcagcagcccactcttcctctctctcttagccgaagtccagtttttatccctctagcaatcaggcctagtaaagaaaaggaagcccgaaaaataagtctgttttgtctccctctgctacagtgtcgcccctaacctccagccgatcggtcttctctctgccgtgcccgtgtacagcgccacctccccaccaaattcgtcccctccgttgctcctctttccaaattggttgaaaaaacggattcccctcgatctcctctatcttatccccaagaaacccccttgaatcccgttgtatattgcgtgaattcgacgcggtttcgagctccatttttccggcgaaccctaactaatccgttgccgattcttcccgtatccgagccgatctcctcctcctttggctataaatagcagcccctcgacctcctcttccgtttcctcctttttcccgattttttccctagccctagagccgccgccacgctcggcttctctctcctatgccggccgccgctccagccacgtcgcgccgcctcctcggtcgtccccgacctgcgctgtcgcctccctcggctccgcaaggccgagctctaccccggccattggtccctttgtgccaaatcccgccggaagccgcttgccgacgcgaaccagagggtttcgacctttgccgcgcctccagccgccatccaccgtcgaccccgtggtcgccgaacctcgccgtttcctccggtggcatcgcagcgccaagccgaaggccatccaccccttcttcttcgccggtgttcgccgtaaagctgccgtcacagtcgtcccgatctcgccgctgctcgaagctcgtcgccggctgccgttcatcgtcgatcgtcgtcgtgtaagtgtgggtaaggacggtcttgttctactcttcgctttagtgctctcgctttccaccgttgtgtcatcgtttgtcgtcgccggccatctcccgttgccgtttttcgtcgccgtcaccattggtgagttcgtcgtcgcgtcttctctctcccggagctgtccccttatcgtcggagcgtcgccgttcagtcctcgttgttatcctgagccatctgccggtgatgatgttatcgctgacatccgcatcatctcgagccattgcaaaatcaatataaattctatcttttcaatgacatattattcctttttaatatatgtcatctatcaaatatgatctaatctattttcggagaatgttttaatcttttgtctcagctataaatcatttgtaaattgtttaatcaatttggaatagtcttttctttaataggtttaattggaattaaatcttgtaaaattcatatctaactcatacgaactcggaatgaggtcgttcaagtctcataattcatctaaattcaagctctacccatttatgaactttaattgtactattcatttggtttttattagtgtttttcctcgttttgcgttctaggtttagttttccgttatttcggagcatcgtttgttcgttggagaagttcttgaagacgaattgaagatgcttgtttgtaaggcaagtcacacagatcccaaacaaccctttgagcatgttgaacccgtttaaagctaatgttttatttcaacttatgcattattttcgaatgtcatcgggcggtgagcctttcccaattaattaatggccgaagatgactttattttcctatgggtaataaattgattagcttgaaccttatatattagtttggtttagctaaatgctatatatataattgcttagccatgcttagaaacattagctcattaatgggatgaatcatattatgttattatttatggttatatttaatggtagctcacgatggttaatcgtgttatgataattaattgataattaaaacctgattaaaggtgggttgtgagcacatggttttgatggccgtgctcatgacaattaaggaccggttcgcgagctactgttgtgaaacattaaccgtgccaaccacaagccagcgtggcaacagctttcccttttgtatagcatggttcattatggggtgccagactaagaagcgtctagaagtccatgggggtcgctggggagtccatgcctctggttttttaggaggtgattatgatccaggaatggtgcactgtggtgagttgtgttgtgcgaaggatattgtcacgatttccccctttgcagtgtcgtggtggtacttcggggcatggcaacatgtgtggaatcatgtcttgtgggtacagtggtacatctctggccagagtaaaactattcgaatagccgtgcccgcggttatgggcgggtctaacaatgtttttcgtgattagtcccacactactcattaatgataataatgtgataattaatttgactcctggtttggaatggataattcctggtttggaggtttgatctgtacgaccggggttggttgttcaggtttggttgggcctgtgcagcatgggtgtgctgttcagtgttgattaatattgaggattaattactctactgttttacaaattctcaactctttgctaaatgctgctttcgcaaatgaaccctatattatgccatcctttggtatccatgtgcacttgcatacttgctgtgtggcttgcggagtattccatgtactcaccttgcaataaccatcaaaccttagttgaagaaaaatgatccggaaggagaagacctttggcttagatcctagttgagctgcctgtgggggtggagctgaagcttcgctagattttattttccgctgcagttttcttcatggtgaggactaagtgcctcttatgtaagtatttatcgttttagttattttgatgaatctgtacattaaagtgtcagtttgtgtacctcagctgattcctggacgaggattttaatgcacaaattagtttggaaattacttgtgaatttctgggcgtgatagccactgatggtgacagctcagtacgagtattcctccacgatagtatatatattcctaagaaattttcctggggagggtactcctccgtatttagccccagttggatggccatgactggttgtcgtaaggaactatgcaacttggggtggtctctcgaagcatcatgaatggccactgttagggggtattggctatatggttgtatactagcaggtgtaaactaaagttgagtgtatactagaattatacgaattgattgttcttctatttcttcttccacttagtttaggaatgattaaatgagatatatgagtgctttgcttcgtgtcactctacttgtataaatatcttaacccacgcc

SEQ ID NO: 92604 - DNA, 690 bp, Oryza sativa
caaattccaagctcatccacctcattcctgccatcaaaaggtgcatgttttcagttgctggtgaataaaaagtccattttgtttggacttggaggcaaacaaatgaataaacagtgtttaaagagtaataatccagcaagtaaattgagtaataagtatcttgatatgcctcttttccggcaagtccaaacaaatggatcttttctactcacaactaaatccaaacaaatggctcttttgcagctaataatccagaaaaaatagagtatctagatcaattaatcaaatgactcttttccagtcacactaaacaatatctaatttcacagtaacaacaactataaacaatccagcaagtaaattgaaataggcagagtaataggcaattttgatacacaccatgaacaaaaaattcagccaccaatgaaacagtacctgaggatacaagtgcacaagagacaagttaaagctttgtacctgagcatacaactagcttagggaggactgatctgaccctgtccaaatgctatcatttgtcgaaggaggctctgagtatctgctgccatcttcctcaggctctcaatctcctcagcttgtttttccactttcgcatcagattcttgtgcctgcgccttcaatctttcaagctcctcctgaaagtactgcagactctagcttctttgcatctag

SEQ ID NO: 92605 - DNA, 588 bp, Oryza sativa
tttcctctccacttaaaaattgctgtcagcagatatattcaaaggagtcccctcatacattacttcagaaaagaacaaatgcacaaaaacacaaacatcaaatattcaaacaacatcatacacaacaatcaaatcctcagatcacaatttaaactgacagccatgttctaacagcaggttatggtgggacttagccatacacagatattttactcaaaatcactatattcaccatcatcatggattggcccttcattttcactgtcatattgtctcacagtttcgtcagcatcatcttcaaagccattttcttcaacttccaattccctttccctctggatctgatcaactagggaagcctgaacacaaataccatcttcataattgctaggctgctcgttgattgaagctctctcaagatctgcaacctgaaaactagtattttcttgctcatcatcttggtatgacaattcatgctctgcctgggccggcaggtcatcattttcttcttcgggcacattccacaagtgcctatggaaaatttttgaacaactttccaaggctcaccatgcttgttatcttctaagt

SEQ ID NO: 92606 - DNA, 616 bp, Oryza sativa
taacaataagggtcgcaccaccgagatgaaataactatgaagcggttggcttgtggtccatcaactacagtaaatttttggcagggatatgacattaatagatactcgtttagcacaagagcccgagatagtaagacttgtacgcaaaacagcggtgtccgtgtggaggcaattgatgaagccgggaaaaaacaatcatacttcgggtttattgaagaaatatgggaaatcgactatgggcacacaatgcaattccctatatttaagtgccagtgggtaaaatacccgaacggggtcaatgttgataagttcggttttactgttgttgacctggcgagtgtgggtcacaaggatgacccttgggtactcgccaatcgcgtggcacaagtgttttatgtgaaagacccttcaaatttgaagaaagatatagtgctatcagggaaacaaaagatattgggagtggatgggattgaagatgtcgaagattacaaccaatacgatagtatgccactttatagtcagtttgtacagaagattaagaatgtcgacacatctactcaaaagaccgtgaagccttacatgcgcacggacggtgtgggcaaaaatgttaaagggt

SEQ ID NO: 92607 - DNA, 647 bp, Oryza sativa
gtcttctttcagacataaggcagttctacgaaatccctacatcctgaattaaacaaacttttatcaaatcaaataaccaattaatcagcacataaatcaacatgctaatggccaaatgcataaatactcttcaatccttgcatggcatagctatggccagtgccacagcatgccacaagagagggtccgccactggcaagagcttcaatctcttgaaaaattttccttgagtttatctttctcatccgattcatgtgttttttttggggtccaatcaaacgaccattcctgtgtttttccgcgttttgcaatcatctgatttacacctacgttcctatcagaatgctgtatttttccgtttttcattcgtgcgattcaaagggctacttgatataggcacacaaagatagtattttaaagtgtgtcaggcttttgacaggttgatccaagcacatttggcacaaaataagtgaagtacagggacgatgtaggtcggtggacccatctgtcgtaaacccatactagttccttagtttctcacatatcattcaaatagttaaattctaaaaaaaatcatagattaatatgtgatatatacttcatacacatgtaagtttaaatacgacatataaaatttgataaaaaaa

SEQ ID NO: 92608 - DNA, 1507 bp, Oryza sativa
gattaaataattgatagtcttggctacgcatataaatccacaatatccccaccgcgtggttataccgacacctggacaaaagaaagtcgcacggataccaacagaaatcaacattttacacttatcatatactcactccgtttcaaaatatttgacaccgttgatttgtttgaccattcgtcttattcaaaaaatttaaataattatttattcttttcatatcatttgattcattggtaaatatagttttacatatttcacaatttttttaataaaacgaacggtcaaacatatgctaaaaagttattgatgttaaacattttgaattagagggagtactgagtatgccgcaagttggtccatagattaggattagaaccacgaattataagtcttcacacaacaatagcttcaaattctttatttagtgttgggatcaatcttcttccaaaataaatgaagcatctgacatgtcttttagaaagaaaggctcagctgacatccgaattccgaaagtgagtgatcacctttcaagtttttgaccaaatttcaccgaacgaaagtgacaccggctaagactgactcaacgatcctcatgcacggcgttcttccacttgccggccacctcctcgagcgcgcggcgcgacgccccgtccggcgaccacgccctcgccgccgccgccgcctgcagctccctcgcccggcgacgcgcggcgctccccttctcccctggatccatgagctccttcaccgccgccgccacctcctcccgcgacaccacgccgccgggcgccaccggacttagcggtagcgccaccccggctacctccgtcaggatggccgcgttcatcttctgctcggcgtgcagcggccacgcgatcatcggcacgccggaggacacgctctccagcgccgagttccacccgcagtgcgacacgaacgccgccgtcgccgggtgcgccagcacgcgcacctgcggcgcccacgacgccacggcgaggccccgcccgttcgtcctctccacgaagccctcggggaggaagtccatcgggttgccgtagctggcgcccatggaggaaaggagcccgccctttcttggcatgcgcaccacccagaggaacctgtggccgctcatctccagcccggcggcgagctcgcgcgtctgctccacggacagcgcgccgccggagccgaaggagacgtacaccaccgaccccgccggctggcggtccagccactccaagcacgccgactcgtcggcgtcctcgtcggaccttggccggacgaacggcccgacgaggtacaccggcgggaacgcgccgttctccccgtctcgcctgaacgcttccgcggcgcccggctccatctccgggaaactgttcaccaagaagccgtcggcgccgccgtatcgccgcccctcctcgagcacgtaggcgtagaccggatcggcagaatcccggaacccgtcggggatgtcgccgtggcggagcggcgcgcatccggggag

SEQ ID NO: 92609 - DNA, 741 bp, Oryza sativa
agtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttttgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatgtaaaaaacttgggcactcagcgttgtgtaagatcctgagatcccgaacccatatatctgctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttt

SEQ ID NO: 92610 - DNA, 1936 bp, Oryza sativa
  unsure (1)..(1936): unsure at all n locations
gacggtagacaacaatttattccgtaaagcccatttcactgttctgcaacactcttcattggtagctccttacatcgaggagcacttgactctagttcgcgccaggaacattggtaagtccgatgcatggattacacggcatcacattgatactttccccgcgtggctacgacaacatctcatgggtaacgagtcgatcaaccaacaacttgccttcctggcgaggggaccgtctgggttcggatttcgggccggaaaccaatttttttttcccccaaaaacgatatgaacaatgggtcacatttacacgagagcccaagacatgaagagcacgaaccaaaacagcgatgttcgtgtcaatgccntggnacncnnannnnncaagtagggnaggttgcngtgccatcgaggacatatgggaacttgactatggtcctctcaaggttcctctgttccggtgccaatgggttaggttgactggtggaggcgtaatgattgatgacagtggatgacaactgttgaccttaacaaggttggatactcggacgaaccttttgtccttaccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcatttatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatatttaatttactatctttcatatgctacttatatatgactattccaatttttaaaaggtttaaatcatgcatgtggcatttacatatgttaattaaagtttttagcatttaatttaatataattcctacgctaagtatatatgatgattacaatttttattaattttaaatcatgcagtatgtacatacatatctttattagagtttttaccaatataataatatcattcatatatatgctaagtatatatatatattggaatttttattaattataagtcatatatttgcttattacgatttatccacttaatttattacagacaaaaataattttttgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttggtaagaccaaccgggactaaagatcatctttagtcccggttgttctcaacaaccgggagtaaatatcttttctttactcccggttgttctcaacaaccgggactaaagatatcttagtcccggttgttctcaacaaccggg

SEQ ID NO: 92611 - DNA, 1091 bp, Oryza sativa
atttacaattgtacaggtacgatatgtggagtgttggtgttgtcatgctggagttgatagtaggttctccacatgttttccagataagtgaccgtacacgtgctctaatggatcatcgccttgaagggtggagtgagcaaacaaaggaacttgcatacaagtgagacattattttgatattcctgtctgaaaattgtgaaggacgttttctatttctggatcagtgaaaactgttggtgctgcattttgattatttcatcaggcttaagaatatcaaagttgtttcactgtaaatgaaaagagtataagctcctgtcagattgtcaaccacatggttctcaggatatcccaaaatattcagaaaattaccagacccttctttttagccaatcaaagaattcatgaccttttctgaagtgcatgattaacagtacaatccattattgctggaaattcgatccaccctactgcaagctacataattttggttttctaactatctgtaagcaatttaccaaaatgacctttctattgatatgatgtagtaggtagtagcatgatttaatttgtctggtttgtttccctgccaaacctttgaagatgctctatttattggaagggataattgcttatttgaccctgtttggaaagctaactaccaatctgaccctagtttttctagtttgcttattggaattacgaatttaactatttccaaattaatttttcatatggaaagatatagtcctgaagagtatattgtttgactaactatttcttctgttcctgttgtaatgttaggttgaggtcctacatggaattgtgcattttagtcccaggaatttcctcgcagcatcagggcagtggtgactctgaacatgtcagtatctcaactccactttatgttcatttaacatgtaatgattttttacaatatatatgttcatattcttccaaaatgtgatttaaatggttatttcctttatttacacattgttcattatggaccaaaacaatctgtatttttttaaaaaaaaaggaaatgtaagaaatgtactccctccgtttcaggttataagacgttttgactt

SEQ ID NO: 92612 - DNA, 5719 bp, Oryza sativa
tatacggccggaagtgccgcacacctctcttctgggatcagacaggcgagcgtcaactgtttggaacagaggtattagcggaagcagaagagaaagtcaggatcatcagggaaaggttgagaattgcccagtctcgacagaagagctacgcggataaccgtcgaagggagctcacttttgaggcaggagattacgtgtatcttcgtgtcactccgctccggggagtacaccggtttcagacgaaaggcaagttggtaccacgcttcgtgggaccatacaaaatcctggaacgcaggggggaagttgcttatcagttagaacttccatccaacatgatcggcatccatgacgtgttccacgtgtcccaactaaagaagtgcttaagggtacctgaagaacaggctgattcggaacacattgatatccaggaggacctaacatatgtggagaagccggttcgtatacttgataccagcgaaaggagaaccagaaacaaggtcacccggttttgccgagttcagtggagtcatcattcagaagaggaagcaacctgggaaagggaagatgagttgaaagccgcccatccgcacctcttcaccagcacctccgaatctcggggccgagattccgtttaaggggggtaggtttgtcacaccccgaagttttcctcccaagccaaaattgtaatttttataaatgaccctaagaaaatgctggtgaaatcagaagaaaaccctaagaaagtaatgcaaataataatcggatatgacatgtggaatttttcttgagttctacatgtcgcaattcattaacaggatttttagtggaattttcagagctctagaaataattttaaccaattaaaattgagcaagcaatattttaattccagggaaaatcctttttcctttttctttttctttttcctctctttttcctcctttttctttcgaatgggccgccggcccattccctccttcctccccctcctccttgctgggccggccgcaggccgaggcccagccaggccgccccgccgcctcctctctcggggtcgccgacaggtggggcccacctgtcgggtccttcccccacctcccgccgatctcgctcgcgccgtcgcgcccgcaaccgccgccgcgccctcgtctccgcctcctccgggccacgtcgaccacacccgcgcgtgcgccgcgtctcccgcgcccactcccctctctctcccgctcgcgcccgcgcccgagatggccgggattcgattttcgaatcccgcctctctctcctcccccactccccacgtcggccggcgattcccgcctctcccggccacgtccggttccctctccccctatttaagcatcgccgtcgtcccctctcactttttccccatttcgccgcactctctcgagcctcccatcgctcccgcgccgtgcaaccccttgccgccgccttttccgctactccggccgccgctagccgccgttagggtcgccgccaggccgcgccgtcgccgccgtcgggttcgcgtggccgagatccaccccgtccacccctcctccgtcgaggttcgtcgccggagccctcgttccctcgcactcgggtgagcaccacctccatcgccgccttcggccatggtttccgatcgccgtggtccatctccctctctctaatccctctcttctccgtccttagggcaccccgaagctcgtccgcccgccgacgtcgtcctcccgtggcttgccgtcgccgttcgccatcgtcctcctccgcgccggccaccctcggtgaggcatccctcccctcttttccccttcctctcctcctagtgccgcgccgccgcttcgagtcgcgcgccgtcgccttcggccgccgccgcctcccgtgccgccggtcgccgccgtcgtcggccgcatgccgtcgctgctagacctggccggccggtcggctttgatgccgagccgagccggcgaccgcctttatcgccgcccgttcccttcccttcctagccgccgcttagcgcagccgccttcgcgtcgccttttgcgctgtcgccttcgccgccggccgccgtcttgcgccgctgccgcaagcgcgccgcgccgtcgcgcgccatggccgccaggccggtttgcgccgtgcccgcgcgccccggccgcgagctcccgccgccgtccgatctacccttgggtagatcggggccatcggttcggccgccacgtggtgcgccgctcctccccggtccgtggacccgatccgccgtggaccgccctctcccgagtcactgccatgcgggtcccgcttgccggcgccccttcctccctctcccgagccgctgaccggtgggccccgcatgtcggcgccgcaccccctccgtgctgacgtcagccctggaatatattgcgcaataaatgatttagggtttttcttttatagtaataaacacagtgaatcttctaaaattcataactaattcatccgagctccgtttaagctcattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtactttgagatagtcgccgaggttcctccagcagcagagcaaggcaagttatgcttgtcacttgaacatgttgatcctatattgcaaatgctctattgttttctttcaaatattgcattgttttataatattactatgggatggttacctattgttacagccatgtttttggatatcatgctcctttgttagcttggggttataacatgattagagtttggactaggaattgcttagccatgcttagttcaactagttcacaatggggaaaaccatattaatgtttagactattggttctaatgataatgttggattagtaccaccgctctggtgttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccttagtgtaatcctttaatttggatagtttaggtggatggttgggcctgtcgcaacgtgggttagcgttggacagtggatagttaatattaattaattattacaactgtttaaatctttcaatctctgtttataaatgctcgctttatgcaaatgaaccacttcagctcttctttgttaattccctgcatcatacccctattccggtatgacttgctgagtacagtgggtagtactcagtcttgctctacttttcccaaccccagagttcgagttcgggtcagatgaaggtttctctgaggagtaggcttcgtccgtgccgtcgaggatgcctgtggagtggtgttcccgctgcagtttagtcaaggcttagctcctgttatctttcttttcttccgctgcatttatgtaagactttatgatgtttgtaagacgtggatctgtatgtcaacattgtcgtttgtgtaccccggctggtcctggacggggattttaatgcacattctgcttggaattctattcgggaatttctgggcgtgacaagcattccccttgttcctgaacaaacgccttagccgtggtattataaggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacattgtctcgggcaatttgtttccccccggaagaatgttcttgacgagtttcaataaatcgccaaattccttgtcactaaccctattttttgccttccattgcaacaactccagagtggtatccaactttttgtgcccctgctcgcaacctgggtacaacgaagttctgtggtcctccaacatcttgtccaatttataggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaaaaagacatatatatataggggtgggactttagtcccggttggtagcaccaaccggggctaaagatcaccgggatctttagccccggttggtgctaccaaccgggactaaagtcccacccctatatatatatatctttttcctcctccagctgcccgagcaagcttcaaaatttcttcaaaaaagagaaaaaatcataccaaaatttctattaaatttattttaataattacatacaaatcaaaaatacctaaaaaatttacaacttcatcctccaatattttttttatcatactacatgt

SEQ ID NO: 92613 - DNA, 2963 bp, Oryza sativa
ccctcctcccctccctcccccacctcagcctccgcctccgccgccgccgcctcctccatcctccagtccctccccctccacgtggtaactccccctccccaaccttctcgatccttcctccattttgctgttctaatccgctgtgctggcttggcttggattccatccccagtccttcgaccgcggcttctacctcctcgtcaaggcgatccaggagctgcgtgagcgcaaggacggcctcgtcgtcaccgtcggcatcggcgggccaaccggctccggcaagaccaggtacgggccgctcccctccttcccgccgcgcgctggttgctgttgctgattggtggtggtggtgttgtgcactttgtgccgggcgcagcctggcggagaaggtggcgtcggtgctggggtgcgtcgtgatcgtctccatggaggactaccgcacggtggccggggccgacgacggcagcgacgttgacgccatcgacttcgacgccctcgctcgtaacctccaggtccgtgcccgcacgttccttcgattttggggattttttttggaggggtggggattggatacgtgcagggtgcttgctttaatggcaggtcactaggtcagaatggcgtgacaaatggtgggcttgaatgctctgttccattgtactactaccattgatagggtgggctagtggttgttgttggagaatagagttgatggatggatacaaatgggggaagtagagttattttcagaaagagaaatgtccagcttcttgtctccgtgccactttatgttctagccctctatacagccggataatttgatcgcagtccatttggtccaaaaccaaaacaacagtttcttcttgataactattgtcaattgatatccctctgttaataattattttttaccaagccaactttacatgacatggtcaaattataaaaaaaaaatgttaaaagatgatcaagtctagtggtttgatactatgtagttgcaaggagtcaaatgatacaggaattgggaaagtggggtaaatgggtgttcctaatctaggaggagcattcaatttgtgcttccattgtgccctctacatctggaggttgcagaacagtttacatgcacaccaattgtattggaatatttatttaccttttcttttaccatgttttcaaagggaaagccgaaatggtagcaaaatgctagtatgatgacgatgtgtaggcgtgtagctatgctggtgatgctgttgagtgtaattactgtgtcaaggtctgtgcattccaatggaaagttggaattataaatagcttctggaaaaaatggagcctctactagtgaaatcaactactggtcataatatctggaagacgtgcaattgagttgctagtatgccttattctcgtcttacagccttttcctgtgtttaatgccaaagccattcgagctgcatatgcctgcataactgataattgtaggtccagtgcttttctatgacactttgcagcggtattcatcatgttgcacaattatcgagtatttttgccgaaatgacgaaaaaaatgctgcataaacttgtttggttcatgggcccatgtgcttgtagtattttagtccctagagcctttcttctgctattattgttttgatttattaccctctgatattatttatgtattttcaacaattcttaaactgtgtataaattctatttttaatgaggccttgaaaagttgtctgaatacattagatgtctaaacaattggataggttaatattgtgattgcattggaagagagaaacaacaacaataaagaaaatgttcattgtggaggttactagtgtgttcctctatgtgttcaattggtcattcatgcatacgaccataatgattaatgaagagatcagtagtagtattgtaatacaattcaagtactttctcttttggaaaccaaataatccaaatttgcatgggttctaccctgtttattttgaaatacataatggacctaatttcccacctcgtagatttgctatgaggaaatatgctggtcatgtgtgatctggcatattttctgggcttagaaatgcccaatctctctgctatactgttgctggttttagtgacaatccagccgatcgtttttggtctataagggttgcttgctttactcctttacctgctgcctgctggaatgcacacatttctgctttctccaatgttctaaaagtgtcatgcttgttgtttgtaattgatgcatctatttggatcaatatccagactcctttgagtaatctatttgtacaaaattttcttcatttgtttgccaccttgacaattttctgcttatttaggtgtattacaagtatccttacaatcatgtctgctgagcaggatcttgtaaagggtaaagatacattgatgccattggttgattttcaagagaagaaacgtacaggatggaggcaactgaagatttcgccatctggagtggtgaaatatctcagaaatacatgctatgaacatttggcaaccttagaatcagatatctttgctagtttgatacaacatatccttgtaggtgattgttgatggtgcttatgctcttcattcaacactgaggtcactgcttgatattcgtgttgctgtggtaaaaattataattgccctaaatatttttcattatagaacagttattttatctcaataatttcacccatgaacttcaggttggtggtgttcattttagccttctgtctaaagtccagcatgatattggagattcttgctcgttggactatctgattgatagcatatttcccttgtttagaaagcatattgagccagacttgcatcatgctcaagtatacatcttgtaccttttttgcctttttatagtctgtaggtaccatttgattcttttttatttgagttgctacttgctagtgcagattagaatcgaca

SEQ ID NO: 92614 - DNA, 511 bp, Oryza sativa
acactcaattgaacttgagtacggcttatcatcctcaaacagatggacaaaccgaacgtgttaatcagtgtctagagatgtatctcaggtgtatgactcaagctacacccactaaatggaatagttggttgcaccttgcagagtattggtataacacatcctttcattctaccttgggctccttgtaaagccttgtttggagtagagtctcatgtcagccaagtgccagttttgttatcttcagttcatcagtcagtggctgatttggtgtctgagcatgaccagttatctgcattctttcagcagcaactccagtgagcacagctgcgtatgaagaacaaagctgaccgaggtggttctgagcgctcctttgaggtaggcataatggttttcctgaaactccaaccatatgcagagtcctcagtgataaatcgtccatatcctaaactggcattcaatttttttggtcccttccgagttgtggagaaggttggctctacagcttatcgct

SEQ ID NO: 92615 - DNA, 4422 bp, Oryza sativa
tgacttttggtggaccccattaaatgatctcaaagctaaatggatgtttccaagtagcccaaaaactccatcacaaaattctgctttcgcacaccttgattgtgtacattctcatggagtcatggtgatccctagtgaggtcaaaagtgattgaggaaggctgatagagtattaggacaccataagaggagaggtatggtttcaatagacagtgaaggagatgatgagttgggaggagaaaggggacagaaaaatggacagtccaagtaacatagtatgtattacatcatgtgggattacagcttcttaagcaacaacgaatattgtagtataaaaataccccccctccatatgtgacatggtagttaccaaaccaagaatattacccagaaatgaaaaatactgggtcccttctgaaccataacaaaatgtatgtcaatgaaaatatgaaagagaaagatggttatgtattttaccactccacattcctcagagacttgaagctcctcgaatttctttcttttgcacttctcaaagtcaaagcaaggaacttctgctttgtgattctttctgatctccataatgttctgcggggcgataagagaatcgtcatttaacaggcactatagaacccaaccatatgattccagaaaagaaaaggcagcatgcaaaatgctgtggagtaagaataattttatcaccactattgaatgcttaatataaccaatacatatttctggcaaattaatgtcacataataattttctgtctctgttgaattaaaatcagttttgtaaatacaagaattatctggtaatgtggttgttcaccaccagattttgaaccctaaattcaagtgatctcgtatagatagaaacatggttcaagaaggcgctaggtgctagagggtcagcagagctggtgcctagtgcctagcgggcacctaggacataccaatcatagaatccaagaaattatcaagcatattacatagagaaaaatagcaacacaatagcgcccaaagtaggttagcctcctaatgcactatctaatgcctaatcgtggcagctaccaagtgcctaggcggcgccttgcatcgacttttagaacaagatagaaatttggaagcatgcttgaaatatttaagattctagtagttatgcacaggaatttgtaattcacatgataatacagaaaaggaatcaatataaaaaggaatcaccttagtaagcaaacctatatccaatgagctatactcatcatatttataatccctaacttgttcaggcttataataactctccaagcttataacttcacaaccaattatattggccatcttctgagctaaacttgtcttgcctgatccactagggccacctacaaataaacagtgtatcaacttaaacagcgacagcatagtcagtaaatgtaatttgctgggtgtgtgggtcatatcatttttgcacaagtttaacagaattattattacagaatcaatctattccatacaatataaaattcttagaagaattcttgtattcacatacatggactagtaaaaaaacagatggggcgcaaataatcgctcagtaatctgccagaaggcccatttatgtttattgtctgctttagcacacattttcacaatagatggttgttcgccataaataagggacaattgcttatatttagaagccgaactaccaaattgaccctactttttcaggtttgctcatttgaccctgtttttcaaaagcgaagccaccatctgaccctgtttttactagtccgttagggtttcagttagaaaaagaaaaaaaaataattttactcgcatgaactgaccaaaatacccctcatcccaacctttatcccacattggcgtggctggccggcgcgtggagggaccaggagcaggtgagcagcggtgctggcaagcaaagagagggacggcagtgggcgccagcgtatggaggagcagcggcggcggcttctgccgcacagagagaggaagggaggggcagcgccggcgcgcggacaggcggcggcgcctgttcgcggaggagcagcgcgccggcttttgccgcgctgagggagggacggctccagcacgtggcaggaggagcagcggagctggcgccggctgttgccgcgtggagggaggagggatgggcggcgacggctgctgccgtgtggagggaggaagggagggagggccagctccggcgcgcggaaggaggagcggcgacgccggcgcacagagggaagaggagcagcggcgcgggcgcgtgtagaggcggtggtggcgatgcgtggataagcagcggatggtgcggcgctgatggggaaacgcgcgggccggcgcttgctgtgtggatggagtgcgtggccgtgtggacggaagcgtgcaacgcttgcctggctcagccggaggcacaggtcctgcgtgaggcgctcatgtggcccacatccttgctcgctcttgctctacccacacctcctctctataccttgttctactagatctggaagttgctttgctcttgttttgctgatctgattgaataatctctcttgttttacatgtattaatttcacacttttttttttttttgctttggggtcgacacaaatttgagcttcgtgatttgcttggggcaattgttggatgtgaaatagcatatatgcttttctttcttcagcgtgcaattggatggataatatatttccaaagttttattaaaattcagtcatctttgcttaagttatcaaatctaactcaaattcacacacaatttgtcaattccaagtcaaatttattaaaactttcatcacatacaccgagtacacaaaactaagccaaataaataaaaactcagagagtatactcaaaatgagcaggggtataaacggcatttggcccctaagttaacaccgttaggttggcctgatagaatagggtcatagctaatgttcatttttgaaaagcggggtcaaataagcaaagttgagaaaatagtcaaactggtagttagctttcaaaacagcgtcaaacgtgcaattgccccataacttaaatatattacaaaaaaggcatgacatgtagccccagcaactggtacaacaaacccacagagaattgtaatacaagttaatcctaaaataacaggtgtataggaatagattaggcacaacctatcaggcactcttttttgcacagcaagcataccattatagcacattaaaaactggatcatgtgaaatttggagatatagatgctctgatatcactttaatgaaactggtagtcattgcaagtgagacttgtcacaagggatatctggtgcagatgtctgactaaatgattttaagttgccccagcaaagtagagtgagttgttttagttatttatcattcacagcaagcagatgcttggtcttagtaaacacaaaactactgctactttattaacggtaaagatgttattaccaatcccaacaatgacaggaaatcctttgttctccaacaatgcctgaaagacaacaattaatggaatatgttacagatcagtaatgcgtaactgtgatgaaaaaaatagaatgtggtttcatttacctgaattgcttgaactgataggagaagacccctatctaagtcataggagtctggcagtggagctaactggatgttacttcctgaagaagaatctgcaaaagtgtaagaatatattcaatggattttctacagaaaaaataataaataaatatggtttccaatgtactccgtaataggcatggttgggattagggcacttgcgcctatttctagttgtgtatccctggacccaagtggcagcggtgccattgaggcagccacgccacaagggcaggagagaaggggaagactaaatactcttgtttattacttgcttgatgagtaaaatacaaaccccgtcatatagatgtgttagcttgaccattaagaaacctatccctagtattaagaaaataactaacttataagtctaaccttatctctaataagaccacctgacatgaactatccacgcacgaaaattaaccaagtaggtactattaatgcacagtaccaccagccctagagaggcagaccactctatgggccctaatgggctgcacatgatatccaatgacaagagaaaatgccctttgttttagcattaaagaacagaatatgcaaggcaaaaatcataaatgaaagcacaagtttaaaaccttgattgaaatgccattttcccataacaggctcctggtcaaactttttgggtggagacctcgtccatggttgtgcaaagtcatcaaaatttgcaacattttcggtcgaaacacgaattggctttggtgcaacaatttttttttcttgactttcagtcagtaattt

SEQ ID NO: 92616 - DNA, 806 bp, Oryza sativa
gtagcgccgtagccacgcgaaccacctctctccgctgccgcccccgactccagccgcgtcgcgccgccgcttcggtcgacgccgacccgcgccgttgcctccctcagctccgcaaggacgaggaggacctcggccgccgcccctcttcgccggaaatccgccggagctcctccttcctcggtcgccgatcgaggccgagcccgtccgccccatcccgagcgacgcccgtcgccggagctccgtcgcgtcgtcttcctgaggagccccgtcgccaccgttctttgccgtcggccgcccctttgccgtcgtgcatctcggtgagcactcccctccttttcctttttcttccctttcgttggccgcttcccgggggtcctcgggacgcgctgccgccgccggtggccgttcgaacgggttggtgccgccgcggtccgcgttccgtgcccgcgccgttgccggtggtgccgggcaagcggtttccgccttcccctttgcggcggcgggcctttggttgggcgggccgggtttgttccggggcttgggcccttggttgcggttcccttggccggccgaatgggttaggccgattttggccaatcaagttgttgaaggggaaccgaaggcaagttttgaacaaggtccccggggggccttccccttttaattggttaaaatgtggggccggggtgtgggggttgccggcccttttgttaatgtaagcgaggtccatttcttctgtaaaaataaataataattgcgcaataaatcgagtttaattctagaaattcatttaaatggctcaaagg

SEQ ID NO: 92617 - DNA, 1268 bp, Oryza sativa
taattattcatgactcggaggaacacctttgttgtgtgcaaagtcttctagttggttttgcaccaacagattttgatgccagcatggatttttattgtgctctgaactatcgaccatatgcttccgtagttggtggcgactttgcaagcaacaaaggatggtgattttgttttcttctggtttacaggtttatgctgccgtggttttttgtttgatttgcggatgtcatttgcccggcaaattttacttgtatcatgactgctccattttggaacacttaagtaagcttccaccggggcaacgaagtgtgctaagatccactctttaggattttatattcttatactcaccttgttcttcagaagcttctttttcctgcctggaacaacttcagaagttgatatttgcaaaaatatataattttcctttggggtcataacacaaaccattattgtttagtagtaaaaacatgggcatttaacattttcaatataggtagagtcattgggtgttcgctctttttccataactgtagcgttggcaatatgttgccgagttcgcgaggatagtgggcgaaatgctggcaaataatcctaagacctggctttcttattagacctacctcaacactatttgaaatataaagctataataactacttgttatgtctgtgtcgtgtttttgaggtgtctactagagatcaggtattacaaacattatgtttgtttgcgcacataaaagaatataacccctaactgcggtaaggagtattaaaggaataaaatatcttaatttataaaccaagagtagataagaggatataaaacggtaatattctcaggtccagaaaaaagtttggtaatcttctccctttggtgggcatttacgcaaggtactgatattttgagtctcgattatactccacattaaactagatgatgccccgcgctttgctgcgggatatatatattagatattgtagaaatgattaaatgatttggattgaaatattgtgaaaatgatttgagaatgatgtttatgtttagtttagttttagaatgaaataaattgtagatataattactatatgtttgtatgttgagctttatgtgattagtaggttgatgtggcatgcttgcatgctaggctttaggggtactaaggccatgttcaacgctccacgctggagctggagcgtggtctcacccttcccaaggggaatattcatgtcacgtcgaccaggaccgcaccctcacctagcgccgcga

SEQ ID NO: 92618 - DNA, 712 bp, Oryza sativa
taattatttggacaaaagagattctttgtccaaagaacacaaaaaaaaatccaaggattacaagagtttgctttgttctcataaatatcaatgtgaaatacttacaccaattaacttagccacttatgattcacaaagataagatataactaactagcctatcaatagcaatttgagaggacccaccgtcttccaagcagcgtgccactttgttcttaagctcatttgctctttccctcatctcagctccctcatttttccccattaatttcataatcgctttctcaattttgcaccactctaactttccctcgagctcaaaccctacaccccacaccgcttccacgtaccttgtatttatcatctgatctgcgaattgaggcctacatatcataagaactccctcacatatactctccaatatcgagttccatccaccgtgtgtccaaaaccagcccactgcacagtgtgccagcacctcctgctgtggggcccacttaatcaccttacccctaccttccaccgcactctcaaacccatccggcaagcatgctctctccacccccctcacaaggtttggacgaaccacccatagaaaaggatggccgctcttctccaacccaaatgcgacctccatgaactcgtcggagtccatggatgccaagctcccaaagctcacgtacaacacggaccctgtcgcctgcgtgtccag

SEQ ID NO: 92619 - DNA, 11116 bp, Oryza sativa
gttgtcttgagagaatacggtgttccaagcaagcacactacaaccaaaccctgaaaagaaataaagagaacttgccagcagcagtggtgcaagtgctgtacctgagcggccattatttatttattatgatatggcccagatagtgccttcctttgaaagttgctggttcactcaaatgaaatcatgatagtttaatttgatgtttgctggattgatgatgattccttcaaaatgatccttacatttatttaataatagtatgttttttttatgaagatcaactcttctttcaaccaaattaagttatatttgcttatgtaggaagtaattaacttttcttgtgctataattggattcctggatttcatttctcacgagagagtatgtttctttttatctttgcaggcaatctacttacttgcagcaaccacacttggagtcgatccatctaggtaaggaatgcctgggtttctttctgttgttctgagtacaaatgtttaatgactgttagtacaaacttgtaattaatatttgtagagtctactgattaatgaactagcttggttagatgttaattactgcttgacaactctcataactgttaatccattcaaatgtaaaagaaatattgtgcgtcctttaacattatttttttaagttacattttttttaaaaaaatgtttttataagtaagcaattctagattatttttccagtaaaaaaatataataaagctttgtcgacatatgatgtattttgtaataaataccatttttatcaacagtttaatagtttttcagtttactaacaccttttttcttggatatttagttgtgttgttgttgaagacagtactatagggcttgcagcagccaaagctgctggtatgaagtgtatcgtaacaaaaagcgggtaagattttttttttccatgaaatatttcagttgcatcaaatcgctttcactaattttgcatgtattccataataaaggcatctgttgatctcttctgggtggaagccgattggattatcattagctgtagcaatagtgacagtattcttcttctttttcttttttttttgaaaatgcatgagacctgtgcttcatctcattaagaaggaaaataaaccacccatacaaccaagggctcacgagcccttcacagatccacaaacagcaaggtgacacacgaccaaaaccactctactgcagcctagtgcccttgggttagcgacctacaaaggaaaacttggaacacaagagctccagtcaggcaccaaactagcttctattgatactgcccacaacacctccatgatgtatggatttgctctgttgaaaacgcagtcagtacggtgtttccaaatttcccaagcaactaggatgatcaatgaattcagtcccttttactgctccttaggtacattcttgacagctttccaccaccatttagcaaaacgagttaccgaaggttgaggggcagaggggcagcaaccgccattcccagcttcaagaaaatcaaggtctgaacttgccgagagaagacacatgagacaaggatggatggttacgtccttttgatcacatagtggacaggttgccaggtgtgctagtccatgtttggcaagtcggtccactgtccaacaacgattgtttatggccaaccataggaaaaacttgcagtgtagaggagcccaacttatccaaatacacctccaaggggcatacttgatggatccaagaaagtaagcattctaggctgacttgctatgtgtagggacctgtagttgataacttccatctctgttggtccggcacatcattttgtagagataacccatccaccatgtcccaaatacgaaggtattcacaaataaccttttttttcgataatggaagctttattaaaactcagtcaaatacaccaagatgatacatttcaactgagcccactcccggcctctgcataagatgcacacagccacacacaaagaaagacctatgtatacccccctcacgaaacaaaaaatattagtggctatcaatccgtagactagatcaccaaccatgctcttgggtaaaaaattctagtgccacctggtccaaactttgcggtaccaccacaatagtatcccgaagacccggtttgtagaggatagccaaggtgcgaagccatcgggtgactaaagtaatagcctgcaaaggagaagacaccatcttgttatcaaaaattaccccatttctacttagccaaatggaccaacaaagagctgttgcacccatcaaaaccagatttctcatgtctttaggaacacatgtaagccaacacccaaacatatgagtcacattttgaggaggttgtaagttataggccatatgaataacagaccaaaccaagagagtaagatgacattggaagaacaaatgttgaatggtttcgtccttatgacagaagcaacatttgttactacctttccactttcgcttagctaggtactttgtaagcctgagttgtaagacctcctttagtatcatccacccaagtaaataagacttgtgccactgtgcaatgtttccttgcccttcggagagccttcccagaaagatttgggggtttggggccaattctgcagttgttttgcctttcagccatctatcagtccagaatttggtattctccccattaccaattatgcattagctaattaactgtatatgtaggacaaccctgaatgtgctattgaaataggtagattaggttgctgttaagtttctattttatgttattcgtcattgctttcttctgttctgatctttcaatctaaataaataatacgtgagaattattcacctcatgttccaatgaaatgtacgtgatattatgtttttgggggcgctgtgcagatacactgcagaagaggactttgcaacagctgatgctgtgttcgattgcattggtgaccctccagaagtacgctttgatttggagttctgcgccaacctcctccagaaacaatttgtaagctgaaggagcagacggtcaatttcacccatatcatataaattctataaattcttgcccaggattatggaaagcggaaatggtctctataaaatcattccaaatacaagagtcaagaggaacagcattgctttatatactattgatatttgttatttatgtatagaggagtacatatatgaacataatagaataagaaatcgaaatatctttaattgaaatttgttactaaatctgtcctaaaaacaagttcacttttctaaccgattcatggcagccacttgtccaaattcttgtagaaaaatgaagtcttttttgacggaggaggtagtacttttcagtatgtatgctttgatggcttttaatcgcttggcatgctgatccaaatagtgggttccatgagcacgcgtttttaatggattagctttgaacgaaaaatgaaagtttgtcatgacagtggtcattggttggaacttgtaaccatctctagactctaggttttttttttcaagacaggcatctaaagttgtgcaaagcgtgactatatggctagtattatagaaaacgataatatcaataataaatcgttaaactagacaaactcagtagcttatattagattctatatgtgtcaaaaaagcaaatacaatatgatgtaacggactttataagggtgtgttaggttcatagtcaaagttggatgagatatgtcggtccatattttgttggatatggttatctagttttttatttggttaagtgaatatggcgatgcaattttttgtttggtcgtagggatgaaggtggattttgagatctaatttttttttttggctggagggagtaggtgcatttgcaggtgtagtcacctctcacttgagatggtgaatatacccccattaaattaatacataatacaaattataaattctccaacaattttacaccactacctcctttataaatacacatagaaaaaagaaaaaaaagaaaaaggaaaaggaaaaaggagaaaaaagcagggtggatctcggggctcgctgccgctgcctcctcctatcggccgtcgctgctcgcctcctcccaccagccgctgcaacctcctcccaccaacgcggcgctcgctgctcacaccggccgcagcgaactgttgtcgtcgtcgccgggttcgcatcgtcgtcatcgtcactagccgggcttgatcatcatcgtcttcaccgcggcgcttgtctctcgcgccggatccctggctcaccgctgtcccctcttgccacactagccgcagtgcatcgttgttgtcgttgccgggctcgcatcgtcattgtcgttgccgccgcgcttgtctcttgcaccggatctccgagcttgccaccactccctcctccaaccaacacggcgcttgccgcccatacctgccgcaacgcattgtcatcgccatcgctgggcacgcattagcgtcgtcatcactgtcggctcgcatcgtcatcgtcatcgccccctctctttccatggaggccccgctcgtccgatcgctcgggcggccaaccatccggcatctgaggagaatattcccctccgggccgccatgtcccacttccgcccaccaaccaaacacccaaaaaaaaacgagcagccatgtcctatccacccaaaacctcccatctatgagaaggatcgcatgacacttgtgtttatgaaaatgagagagaggtgcgctaagtattaatggtgtagtatatatccatatatagctattgtgtgagtgtgttattaggtcgactatggataatgtggatatattattaaacttactttttttatgcaaaaaaacttgctctttaagctcaccagtgctacatacagacaaccttttttttttcattgataataaaatacgagaacacgtacctataattttcgggaattttcgagtacatcttttttacccaatcaattagaattcaggttaaagaaggtctttttcctcgtcgtatcctttatatggaaatccggggccagggggccattcccttgacttgtactgatgagaagttttttactccacgagaaattgaacaaaaagctgccgaattggcttatttattgcgcataccaatggaaatattttaagtaccaattgaattttttgaaatgaattgaatgaagaagaataggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaaaaaaaaaaaggcaagaacaaagaggagcgacacgcctgtccacatgcagttggcttccaaagtcgttgcctcgcctgttgcgagtgaacacggaacaggactctggagccactgccgatgaccgttttttcatcgtctttccaggaaaactatggatgacgccgttagctaccacttcacgtctccactctccacccaggcacctactatacggctccacccatagtttttcctatgaggtcttttaaggtgcttgagaggtacctccagtacctcctctcggataaacactcaccattgattcaataaggacagtttaggaataaaaatattgtaaacatggatagcactgtaactttttacaaatgtttccgtctctaatatgcttcttcggcttctgtagtgcttccgaattccgatacatgttcgtgggactcattcaatttccatatcaatcatttactcctattttgttgtgacttaggcacgttctccctccgttttatattataagtcattttgattttttttctaatcaaacttatttaaatttaaccaaaattatataaaaacataataacattcttaacacaaaacaaatatatgtaatattagattttttttttaaaactaatttaatattttaaatgctactaatttttcatgtaaatttgttcaaatttaacaaaacttaagtagaaaaaagttaaaacaacttataatataaaacggcgggaatataactcttttttcccttttgttgagatactatgagaatataccatatagattaaaggaaaatatgtacacgattattatcaattaatttctcagtttatcattaattacacaattactaatcgcgaggttagtggcgcattagggcagtcccaacccttcatctaggatggtgtctataacattaactacattgccatgtaagacttttagcttatgtggcactatattaattaagagagagagtgaagagaggaagaaattgggtctcatgcaagacacagcttcaacgcgagaacctatgcattagacactatcaagttttgcattaggagagaatagtgtcttcataatagatgaagaataaatatgattggtagagaagagagatgatgtatttattaatggcccactttaagaaaccataggttgtagagtgtagtttctattgtgatgtcttattgacatggcaccatagacactacttatagacattatgggttggcactgcccttagaccccctgccgatcacgccacgtcatgatttaattaccctctctcagcctgatctatgcaaaatcaagataattacctattaaactttccacttaatttacggattaagtaccttggcctattttttactacctttcagaagatacctctctatggaccattagattttagttgattaacggaccatataacttccgagaacccctcttttcgggcaaaatcttctcggtttagtgttaaccagcgacgaacaaattatgagaggaagtactgctacacgtgctgaagtgcatgcttgtttttcctcttagatatgtatgtctttttctttcttcttataaagttttctttcaaattacttatccgatctacaatccggttgcaccattgtgttcgttacaattaaatcttcacaacaagatcttacatgattatattacgatgaaaaaatatttatatttgtaaattacttttattatatacgtaagttacttttatcatatatatatatatatatatatatatatatatatatatatatataaaagttacttttagatttgactaagttacttcttagaaatataaaagtaaattcaataaagtctaaaaggtatttacatgtattaaaaaagtatcttaaaacaaaacggaagtaactttgtcacggtattagaagtaaattcattaaagttactttctttttgttataagttacttctataatatatgtaaattaattttaagctttattgaatttacttttatatatcgaagaagtaatttagtgaaatataaaagtaatttagatttattataaaagtaatttataatttttcatcaaaatataatcatgtgagatcttattataaagatttaattgttacaaacacaacgatgtaatcggatcgtagaccggataagtagtttaagagaaaattttatttaaagtatagatggataaagtctcctacaggtggagtggtactagctagtcacgtccctcttttcgtgtacctccagtccacggctccacccaagagttttctgttttttggtcgtcaccaccgtcacgccgtgccgtgcagaccatcctctctctcctccattaccatccgctccccccgactccgacgccgcgcaggtgcagcgcaagcatggcagagtaaggcggagacagcgtcgcaagcagaagcagctctgacactcgccgccagattccgctccccaaacaccgcactccaattccctcttcgtcgggtgcatcggccgcccaccaagccccgcccgccgaacaccatggccgccggctacggcgagcagccgctgccgctggtacaggaggccaccgcccgaatcttctccggtggcgcagacgcgtcccgcaccaccgtccgattggcccacttcctcctcccccgcgcgggcgcctcccacccgcccgctctcccgcccctgcctcccagcgatttcggccccgtcctcgacgacggcctcaaggtcgagttcaagggctgggcgccggaatcccccaagctctggaggcggtgggtcgccaagctccgcccgcgccacgagcccctgtggcgtaaggttgggatcctcgacgccgtcctcgccaccacgtgccgggtgcgccgcgacgagggcgcgctgctccagctcgccgccttctggtgcggcgagaccaacaccttcgtgttcccctggggtgaggccacggtgacgctcgaggacgtcgcggtgctcggcggcctgccgctgctgggcaggcccgtgcgcgcgccgccgcaggacgcgctccgcggcgacgtggacgcgctcgaggccgtacgccgcgctctctacctcagcaagaacaagaacagcaggcccgaccgtaccgcttgggcgagacatttcctcgagcgccctccggggaaggtcaaagtcggcggcggcggcggcgacgaagcgtgcgggcgcctcgagcacggcgcgttcctggccatgtggctgtctctcttcgtgctaccggcggctccgttcgatgtggtccggacggaggtgctcccactcgccgcccggctggcgcgcggccgcggcgtggcgctcgctcctgctgccctggctagcatatacagtgatctctccgcgctcaagcgctacatcaatttggagaaaagatatcaggccttcgtcgtgtgggcacccctgcaaatcgttcagctttggctctggaagcggttccctgagcttcgccctcctgagaccacgggcaccaatcaacctgacggccatggcatacccacggaatcccagtggcaaaatgctctcaaggtgcttgaccccgtttatgtccacgcagtgttcatgtcacccaagaagtttgaatggaggccctatgggagtagcagcttcgcgctgcggccagagatgggtagccatcgtgttcacggccaagatatagcagaaagtgcagaattgttatccttcatactatgtttacgtgcttgtgagcttgtgggcatgcgctgcattgagcattaccgtccgcatcgtgttgcaaggcagctcagctttgaccaggatattcctggaactcttccccgtgttaactcaaactgggtggctgcatgggaaacatacaaaatggagcctaagaaatttgtattcattgttcccaagtacaagcccgctgttacaattgattatgtgcaatggtggaagccttacttgttgggatgtgctgctgctgttgttaaagctaggaagatgaaagaacttccacttttacttagtccaagaaaaagaaagattgatgtgcctcctgatgttagtccaaaaagggtaggaaatggtgcaaaggaaaaggcagtggaattgtcgtttgaggcaccaataggctcagtaagcacaataaacgaattatcttgtgtatcagccaccaaaatagtacaaggcaaatcttttcagcaaggtaataaggaaccaccagaccttgtcgttgcacatgacagagagaatagaagctcgctacatagtgaagtactgcaaaatctccttgttgaggatgccacaaacactggcagcaatgaagccttatgtgcagtaactatagctgatatgcactcaacagaagtgtcgtttgatgttccagttgccttagtaagcattgtagatgaattaccttgtgtgtcagcctccatagaagaacaaggcaaaccttgccagcaagataaagaggaagcacacaacctttctgtcacacatgacagggagaatagaagctcgctacatagtgaagtactgcaaaatctcgttgttgaggatgccacaaacactggcagcaatgaagccttaggtgccataactgtagctgatatgcactcagcagaagtgtcgtttgatgttccagttgacttggtaagtattgtagatgaattaccttgtgtgtcagccaccaaagaagaacaaggcaatgattgccagcaagataaagaggaagcacgagacctttctgtcacacacgacaaagagaatagaagctcagtagtttatgtgcactcaacacctgttgtggctgcaaacactggcaacaacaaagcctttggactttcacccataattgatgtgcagtcagcacctgaagacgttgtggtgatcagcgatgacgataatgaggatgaggtcggtgggatgcaccaaaaaccaccgcagttggaaacagcaccatcctccttagaagggcaaaatgcagaaagtcagataatcagtgcaagcagtaatcctcaggacagccgagtgatgaaagatgttagggtccaaagcaattgtgatcacgaaactgataatgttcgaagcaatattgttctcagaaaagaatcatttgaagtacttgctgttgatactgtccagcctggttttaatctcttggatacaccaacaggggaaacgcagacatgcgctgttacaggacagatagacaagggatacatggtggaaaaagaaattttggctggtgtggaaggtatcaaaaatgtaaatgaagacgtgtccccatcatttcaagaaataaactctcctgtggaagattgcatggtggccaatagaagaatgggctcaggtatgaggattaataaaaatacagttccatatttcaatcaagctatgtaccaaataaatcatgacaaaaatgtgttgacgataacgtaaactttatgctattttttcaatttttgtaggaaacaactattctagtggtttggcacatgtgaatactcaattgatcaacagagtagtttgtactaggacactatactatcttagaccattttggttgtcaaaacatggtcagaacaaagatgcaagtgacaccactaccgatgaaggaactttccaaccaagacgggaagttgggacgccacaaatgattgaagaggcatttgcagctcgacaagcccaaaagttgagttgcaaaaggtaattgatcgcctgaaggaagagattgtggcactagaggttccatagagggc

SEQ ID NO: 92620 - DNA, 1181 bp, Oryza sativa
cctgcaccccatgggcaggatataacaaaatgtttcttcgaggatgcgtgtccacatttggcattctaggatttgttacctcgtctcacaaatttgcatcgttttgccgtttcaatctgtgatggtgagaaatatttgtcttcggattgaaattgtaaatttgtttagccagcttttttattcactaaatggaattccaagttaattcatactcctagccaacataaattgtgaaattagtttcagttccataagacagtgagtaccacacaaaatgagaattcgaaccaatgctgcatacctgtgaacccaatgagtaacattgttccactcaaccgacccatcacctcatgtcctcctccttgatgatccttatgtgccaatccaccaattgttgatagctgctgatgcattgctcctggtttcttctttcttgtgtgtattggtgtgttcatgttaatcttagtgattttcctaaactatgttagatgatgcagaggagagctctaggtggaggatgttgctcaggagctgccgtgtttctttctttggcctaatccggtagcatgtgatttgtccttccatattaatagtatctgtgtagaatggtacaagtgtgataaatacttgactgtgtactagcactcagacttgtgaattgttttattgttaaaaatcatgtgcccctgatctgatacagtcttagcagaggctaagaaagggttcttacttgtcaccgacaagaagaatggatactccttcctctacccatttggatgacaggtaataaacagtcattgctaaagggtcacatgatgtaaggttgcatctcatttccttcattttattttgagtttataactacccatgaagtggtttgttcaagggtaagataaggtgtacgaatcgtacagcctttggaaagtgtgagcgtcaacacaattacgaccagcaagaaagacatcagtgagcttggtcctccaaatcaattttattttttatcttctattcgtcaaacatttggtcatgtcgctgcagttgtatggtgagaaggtataaaatctgatccactataatgtgttatttaggttgttggagctcttatacgaaaggttctggccgcatctacacaaaagacagttaattgaagcaaaaaaggtgccttttttatcacattattc

SEQ ID NO: 92621 - DNA, 888 bp, Oryza sativa
ctatttaaaagatccatacctttagcctttaagcctttagcagttgcagttcaatatgaggcacctttagcctttagcatccatagttcaaagatcctgcacaaaggggtgctgtcatattcccatttatcattatttttcccataaattcataactatacatcgcattaatacggtgataggtggcgatgtcatcatttgatcctgatctatctcttgaggttttggatcatccaatactggatttcttttactatatggtaagtaccatcaaaagctcattgtccctaattctgccccttgtatattctaatacattatttcctgctacagttaacggagatactgccctctgctcttgtcctattcatcctccgtaagcttccaccgaaacgagtatcagcacagtaccaccctattcgttagaagggctggttttgtcgtcacaagcattccaaaaacttgtttcagagcgagaattgtgatatttgagctgagcttcaagtagttttgatgggtcatctatgtcatgcttctgatgtggaagaggtttttttgtcctctcctgacccatttttctgggctttatatttcttgagaccagaatattatcagatgatttatactttgttctgcctaacaaaacttaccgttgggagttaattacatcagtaacttataaatttgaataggtgatgttgataaaatcaggttgtgcgtgatctttcacaaacggatgagcattgttgtgatttaagtcggctcctacttaaatataggtcatatctccacccctatagaacgccaataaccgatgtcttgttgatccgtgtgctgaaagcagaaggtggttgtaatgcgttgtaattggtgggacgtgatcagatg

SEQ ID NO: 92622 - DNA, 652 bp, Oryza sativa
  unsure (1)..(652): unsure at all n locations
aattcctgcagcccaccgagagggtactggacgggtggtaaaatgggccatcgagctggctgagttcgatctgcacttcgaaccgcggcatgcgatcaagagtcaaatcctggctgacttcatcgcggaatggaccccggtggatgaacctgttccatccgatgtccccttctcccctggagaataagaggatccaaacgccgacattcgcggcgggcactggattatgcatttcgacgggctcccttcaacccttttcccanagggntnggcnaagggnttgaccncngagaaaaggtcacgttgacctcgccaaacgaggatgtccttaaatacgttgttcgtctcgacttccaggccacgaacaacatggcagaatatgaagggctcctcgcgggattgaggcggcagccagaatgggcatccgccatctcctggtcttaggtgactctcanttggtcgtaaatcaagtacccaaagaatatcagtgcaccgaccagcaaatggaagcatacgtccgcgaggtacggcgcatggaacgcaacttcgacggacttgagctccggcacgtgccccaacgcgacaacacggttgctgacgagttgtcgcgtgttgcgtccgcacgagccccactccccccggggactttcga

SEQ ID NO: 92623 - DNA, 2541 bp, Oryza sativa
gctgatctcggcgcttcttacagaagtgaaaggtgaattggcttccccgggcagatgcaattttgttaggaacgccatggagactcacgatcctaccgaagtagagctcggatagtttgttccctccataggtggtcttcacaagaataaaccgagctaccttggttagtcggtccacaactacccatatagaatcatatccgtcttgggtttttggaagtccggtgatgaaatccatcccaatttcatcccatttacattctggtacttggagaggttggagaagtccggccggtcgttggtgctctgccttgacacgctggcacacatcattcgtaaagcaacattctgaacccctatagaaggcatcggtgtaaaaacaagaggaacttccaatagccgaatccgaatcaaatccttccacatcatctgtgtcggctaaggaatcctctcccaagccatcagcaccgaagaacgaagaatttcaatcttcgggatgcgctctagactttagggatggtcttcataacgatcatgagaacaccttgacggacatccctcctggtaatgctcccatagaggaagtaatggcgattctgcttcatgagtcccctgaatcccttttagaacaggatgtttatcatttcattcaaaaagaagattccggcgagacccttgaagtgttatccatagaaccaccatcgcaacctcatctcgagcctaaaccttgtccctctggccctcgagatgttgttcttgatagttgtcaggaaacaacctcgatcatgcacgacacatcctttggcaaggagaaccttcaggccatggacaagcttgagacatcagctctggtggacaagagaaatcactccacaaatgagcatgaaaccttctctttcaaaatccctcatgattcatgctcatataaggaaaccccagactcctgttcgattagtactaccccctcgtgcaaggaccacaaccactttacaatttttttttccacatgttaaaaaaggggtctggaacctttatttatcataaatctgcagatctcgtatatgttttcacactaatcttacatgatgatgtcccaaaggtaagcttaagtgtcacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaatcaataaagatctaagcagcggaaaaataaattaaacggcgtagacggcttcactccacaggcagcttgaccaaggctacacctactcctccacaccatcagcctcattgaagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttcagaatttaataaaacagttaagtaataattaaacaatattaatccaacactatacaacataccctgttgtataggcccaaccattctgtacaaccataccggctgcacagttctatctccaaaccaggaatataccattccaaaccaggagctaatcaaattattaccaattatagcatcattcactaaggtgagaagtgtgaaactaatcacgaaagacattgttagacccgcccataaccgcgggcatggctattcgaatagttttactctggccagaggtgtaccactgtacccacaagacacaaccccacattatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacatttcagtctggcgccccgcaatgaaccatgctatacaaaagataaagccgttgcccatgctggcttgtggttggcatggttaatgtttcacaaccgaaacttgtgaaccggtccttaattgtcatgagcacgaccatcaaaaccatgtgctcacaacccaccattaccaggttttagttggcacattaattaattaactaatcacgattgaccatcgtgaactatcattaagccatcattaaataatagtgagtcataagttatcccgaatgtgtactaatgtttctaagcaagctaagcaattatatctaatatctagttgaactaatataaataaagctcaactagttaaattgtaataacccaaggtatcaaggaatgtagtaatcaagtacaaaagggccataacaaagaatatgttaattccacccaatgacattcgaaaataaatgcaatagttgaatagaaacaatagctttaaataggatcaacatgctcaaagggttgtttgggatctgtgtgacttgcc

SEQ ID NO: 92624 - DNA, 3005 bp, Oryza sativa
ttcccctgtatcaattcggccggagaaggaaagggacggccggattggaaagcggcggcggcggcgcgaaactagggtttcggcccgaggaagacgacgggcctgacaggtgggacccacctgtcagcgacagcgagggcgcgcgcgcgcggcagctgcggactgggccggactgggccgaggagagagagagcggttttgggccgactttcggcccaaagccaaaagagactttttaaaacctttttcaatttaaattatttcttaaatgcaattccatttattaaaaatacttccttagctcaaataaatcccagaaaaaatctaggaattatagaattaagcaaagtatttaatgaaattttatctggccccattttatattggaatttattaattaaaattagatcttttcttcaagacttttaaaattatttctaaaaattccaattaaacaacaatttataaattttgaattttcagggtgtgacaaacctaccccccttaaacagaatctcgtcctcgagattcggaagaactggcgaacagatgcggatgagctgacttcaattcatcttctcgttcccaagttgattcttcttccgagtgattactccactggactttgcaaaaacggataactcgattcctggttcttctctcatttgtttccaagatacggattggtttctcaacataggtcaaatcctcttggacttctatctgctcaatattagcttcttcggtaggtacccttaaacactttttcaattgtgacacatggaacacattatagactcctgccaaagattgaggtaattctaactgataagcaacctctcctcttctactgacaatcttataaggtcccacaaaacgcggtgccaattttcctttggtgtgaaaacgatgaactcctcgaagaggcgtgacacgaagatacacataatctccttcttcaaaactcaaatctctacggcgattgtcggcataactcttatgacgagactgagccacacgcaatctttcttgaatgatctttaccttttcttctgcttctcttaagatatccgtcccgaaaacctgacgttctcccgtttgatcccacaaaagcggagtgcgacacttccgaccatacagtgcttcgtaaggagccatctgaagactagcttgataactgttgttatacgagaattctgcataaggtagattcttatcccaacttccaccgaaatctaaagcacaagctctcaacatgtcttccaaaatctgattcaccctttcggtttgtccgtctgtctgtggatgataagcagtactaaagttcagcttagaacccatttcttcctgaagtttcttccagaaatttgaagtaaactgactgcctcgatcagacactattttcttagggacaccatgcaaacacacaatccttgccatatataattctgccaaccgacttccggaataagttgtctttaccgggatgaaatgtgccactttggtaagtctgtcgactattacccaaatagagtcatggcctgatgacgttctgggtaaaccagtgataaaatccataccgatttcttcccatttccattcaggaatcttcaaaggctgcaacaaaccggcaggtttctgatgttctgccttgactcgctggcaaatatcacataccgctacgtattctgcgatttcacgcttcatacttgcccaccaaaatctttccttgagatcctggtacatcttagtactaccagggtgaatggagtataaagtatcatgagcttctttcagaattgcatcctttaaatctttgttgtcagggacacaaattctctcgcccaaccatacagttccttgctcatcctccaagaaaccgatagcttttcctcttctcatattcttcttgatctcttgaatatcaggatcactaatttgagcttctctaacttgatcaattagtgtgggcttcgcttctaaggctgcaacaaaacctctactgacaattcccaaatttaatctttcaaattccttgcataattccaatggcagctgtcatccttcggtagcattgcaataacctttcctgctaagagcgtctgctacaacattagcctttcccgggtgataatgaattcccatgtcataatccttaattaattccaactatctcctttgtctcatgttcagatccggctgagtaaagatatactttaaactcttgtgatcggtatacacctctgtacgagtaccgaaaagataatgatgccaaattttcaacgcatgaactactgcggccaattcaagatcatgagtagggtagttcttttcatgcggacgtaactgacgagatgcataggcaaccaccttcccatcttgcatcagaacacaacctaacccaagtttagatgcatcgcaatacacttggaaacccttctttggatcaggcaaaatcaaaataggagctgatattaaacgacttttcaactcttgaaaactctgctcacattcttccgaccacttgtacttcacatatttctgaagcaggcgtgtcatgggcttagcaatcttggaaaaattctctataaaccttcgataatatcttgcgaggcctagaaaactgtgaatctctgaaactgtctttggttgcttccaattggttacggattccacgttagtaggatcgacggcaactcctccggctgagatgacgtgaccaaggaatttcacttcagacaaccaaaattcacacttgctaaacttagcatacagttgatgctctcgtagcttctccaatgcaaggcgaagatgttcttcatgctcttctttggttcgggagtagataagaatgtcatcaataaagaccaccacgaacttgtctaggtattccataaatactttattcatcaagttcatgaagaaagcaggagcattggtaagtccaaaagacatgacgtacattcgaacaacccatacctagtggtaaaagcggttttaggtat

SEQ ID NO: 92625 - DNA, 1136 bp, Oryza sativa
gaggatttaaaaactttttccaattaaaataatcactgaaatgatctttgaattgttaaaaatacttccaatgctcaaatgatttcaagaaaaatcctgaaaatacttggacactcaacgtatttaacaaaattaaaatcagatcatttaatgattaatttaatatttaaataattgctgaactgctctttgtattattgaaattaagagttgagctccgaaaaatccgagaaaatttcagagagtataattaaccatggagaatttaataaaacttaaatccagccatgctttatatttaggaaattttatttctcacatttaacttcacttgtaaattaatgaacatttaatataaattctaataataatttattaaataatttataaatcctaagacgaaaatcaggatgtgacatcatctaagcatggtaaagctaagggaactaaaggtagcacagttgattcaggtgacaaaagtggggagcctaaggatggtgagattgaggagattgaagaagaggagattgaggagcaagaggccttgaagttcaataatttccaggatcaagttgattatgctgttcatcaagctttgattaatctatcgggtgctggtcaatactttgacaaatatcatcaagactgtggttgatatcacaattgctgagcattaggataacgggccagtctttctgccagaaggtgggttccatacatatagaagcttggtgacatgtaatcaacagcctgtctccaatgtacctccagggcagccgatggcgtcagcttcagctttgagaccaggagcatcatcttctacgtagagaccagtggtcaatcctcatgtactgactagggaacaacctcggcatgctgggaaaaacgtcaatcggctgactcaggaacagattgcagctatatttgggccatctcaaccggttgtcgagccgattcaatcgacaccaattaggcagcaagtggttcagccgattaggcagcagatggttccccaaataccggcaggacagagaacacctattattcagcaaaatcagcctgttggagctcagtttgttcctaaacagcagatacataatgtgcaacagcctcctcagaactatctgggctgcagg

SEQ ID NO: 92626 - DNA, 9557 bp, Oryza sativa
ttagagagagggagatgaaccacggcgaccggaaaccatggccgaaggcagcggtagaggtggtgctcacccgtgcgcgaggggatgagggctccggcgacgaaccttgacggaggagaggtggacggggtggatctcggccacgcgaatccgacggcggtgacggcgcggcctggcggcgaccctaacggcggctagcggcggccggagaagcggaaaatggcggctgcggaggttgcacgacgcgggggcgatgggaggctcgagagagtgcggcgaaatggggaaaaagtgagagggggcgacggcggtgcttaaaaaggggaagagagaaccggacgtggccgggagaggcggaaatcgccggccgacgtgggggaatggggaagagagagaggcgggattcgattttcgaatcccggccatctcgggcgcgggcgcgagtgggagatagaggggagtgggcgctggagacgcggcgcacgcgcgggcgtggtcgacgtggcccggggaaggcggggacgtgggcgcggcggcggtttcggcgcggcggcgcgagcgcgagatcggcgggaggagggagacgggcccgacaggtgggccccacctgtcggcgaccccgagagaggaggcggcggggctgcctggctgggcctcggcctgcggccggcccagtaagggggagggaaggaaggagggaatgggccggcggcccattcgaaagaaaggaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacctgtagaactcaagaaaaagtcccacatgtcaaatccgattattatttgcattactttcttagggttttctcctgatttgcaccggtattttcttagggtcatttataaattacaattttggcttgggagggaaacttcggggtgtgacaaacctaccccccttaaacggaatctcggccccgagattcggaggagctggtgaagaggtgcggatgggcggctttcaactcatcttccctttcccaggttgcttcctcttctgaatgatgattccactgaactcggcaaaacctggtgaccttatttctggttcttctttcgctggtatcaagtatacgaaccggcttctccacataggttaggtcctcttggatatcaatgtgctccgaatcaacctgttcttcaggtacccttaagcacttctttaattgggacacatggaacacgtcatggatgccgatcatgttggatggaagttctagctgataagcaacttctccccttcgttccaaaattttgtatggtcccacgaagcgtggtgccaacttgccttttgtctggaaatggtgtactccccggagcggagtgacacgaagatacacgtaatctccttcctcaaaagtgagctcccttcgacggttatccgcgtagctcttctgtcgagactgagcaattctcaacctttccctgatgattctgactttctcttctacttccgctaatacctctgttccgaacagttgacgttcgcctgtctgatcccagaataaagcgcatatggctgtataaagcttccgaccgtataaagcttcaaacggtgccatctgtagactggcctggtagctgttgttgtacgagaattccgcatatggcaagcttttgtcccaagctccaccaaaatcaagagcgcaagctctcaacatatcttccaagattaaattgactcgctcggtctgaccatcagtttgcgggtgataggccgtgctgaaatttaaacgggtccccaattcttcctgtagcttctgccaaaattttgaggtgaactgactacctcggtcggatactatcttcttgggtaccccatgcaaacacatgatccttgcgaggtacaattctgccaatctctttccgtataggtggtatgcactggtataaagtgagccaccttggtgagtcgatccacgactacccagattgaatcatgacccgatgatgtccggggcagtcctgttataaagtccattccaatctcctctcatttccattccgggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttagtgctgcctgggtgaatggagtactgggtctgatgagcctcggtgagtatcagatccttcaattccttgtcgtcaggtacacacaatctttctaccatccagatcgtgccatgctcatcctcaaggaaatcccgagcctttccgactctcatgttctttttcagctctgctatttccggatcatttacttgagcggctctaacttgatccacgagcgtaggccgtgcctccagagcggctacgaacctgtgttcaacaattcccacgttgagatgcccaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgccggagatttaggtccggttgggtgaagatgtatttcagactcttatggtccgtatatatttcgcagcggttgccaatcagatagtgcctccagatcttcaaagcatgaaccactgctgccaattccaagtcatgcgttggataatttccttcgtgtggacgcaactgccgcgaggcatacgcaaccactctgccctcttgcattaggacacatccaagtccgtgacgggatgcatcacaatagacttggaagtctttcgtcgggtcgggcagaatcaaaactggtgcggatactaatttcttcttgagctcctcgaaactcttatcgcactcagctgtccatttaaacttctcatctttcttaagcaactgagtcatgggtcgggcgattctggagaaattttcgatgaatcggcggtaataacccgcaagtccaagaaaactccgaatctgcgacacggtcttaggtggggtccatttggtaactgactccacgttcgatgggtcgactgccacaccctgagctgtaatgacatgacccagaaattttacttccgtcaaccagaagtcacacttgttgaacttggcgtatagctggtgctccttcaacttctcgagtactagacggagatgttgttcatgttcctcctcggactttgaatagataagaatgtcgtcgatgaacaccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatcctcttcccggattctcaactggtggtagcctgatcacaggtctatcttagaaaacactttagctcctttcagttgatcaaacaaatcatcgattcgcggcaaagggtatttgttcttgatggtgacctcgttgagtgcgcgataatcaacgcacattctcttcgtcttatcctttttctccacaaaaatgaccggagcaccccaaggtgaagtacttggtcggatgtaccctttctgcagctgctcatcaacctgcttcttgacctcggctaattcgttggccgccattctgtacggtctcttgtaaatgggagcggttcccggtgccaagtcaatccggaattcaatctccctcttgggtggtatggtagtgaggtcttcagggaacacttctggatactcggagactatgggtatgtcttccaatttcttcaaattcttctcctcggtgaccactgggacttccatctcgatctggttcaaggagaccccttgctttggcggggctagtgatttgtacactaccgtttctcccttctcgttggtcaaggtgactgtgcgattcgcacaatcgatgactcccttgaacttagtcagccaatccatcccaagaatgacatctaggtatttggattcaagaagaatgaggttggctagaaatggtaatctttgaatttctattagcactgaagggctaaaactgactgaggttgaactattccccggggtatgaaccctcattggtgtgctaagctcttctttccttaacccatacatccccacaaatttctttgaaatgaaagaatgcgttgcaccagaatcaaaaagtactgttgcagggattgagttaacagggaacgtacctagtacgacctccggtgctgtttgtgcctcctctgcagacgcgtggttgacacgagcctggataaaccttggcccggcacgcctgggcttcgggcatttgtcagcgaagtggccaagctcaccacagttgaagcaggaccctggttttgctcccgtctccttcttggcttgcgcgggcgggcctgactgtgccggtgccatgggtgggcgtggagctgcaccgcggttgggctgacctccatggtggttctgactgccactagagccctggtggaagttgctggagttgaacgggcggtgctgacggacgatcatggtggtaggtccaccctgctgtccgggagtgaagcgcggcctctggtgacttccctgaggtgccctgaactgagcggccttcctcttcctgtccatcttgttgcgttgatcctcctggcggattgccttgtcaaccagccactcaaagtcagcgtagtccccggatatcagttggttggtcagctcatcatccaaacccgccatgaacttctcctgcttctcggcgtcggtgcggacatcctctggtgcatatcgcgcgaggcgattgaactcgtggaggtactctgtcacagtcctgttgccctgatggagtgcacgaaattccctcttcttttgtgccatgaccccatctggcacctgtgccttcctgaagctacggcagaactctacccaagtgacttcagtacccggtgggcgggtggccatgtgattgtcccaccaggctgacgcaggaccctgaagctggtgtgtggcgaaagcgaccttctcctgatcattgcactgcaggaggttcagcttcttctctatcgcatggagccagtcatttgcctccatagggttggtggtgctggagaaggtgggtggcctgacacgtaggaactcaggcaacttggactgagggggagggggaccaaactgctggtgctgctgttcggcgtgctgcatcatcctctggtgcatctgctggtgctgctgctgcatctgctgcatcatggctgccatcatctgagtctgatgtgccataacttgggctagcgtcggattctcaggaagtggtggcggaccattgccggaatcactgctggggtgcacaccattagcgcgttcttcgccgttgctgccctcgcctgttgcgcggctaccagtcctggtgtagaccatctggagggaaaagcagacgggggggaaagaagaaaaacagatgctcagaaactaagctttattacaaaggaattaaaactgcaattgttctgatctgaattaaaacacttaaagagcaagcaaaaatccttattaagacagccatatcataggcacatgatatcgaccgtcgactgaccccaaacaagcaacctaaacacaccaactaacaagcagaagctagacagtcgataaactaatgggaaaaacgagcctaatgctcggaacggctcctgcggtcggtggagtcgaaggcgtcctcctgctcgtcaccaagtccctctgagcgactcctggagcctggcagatacgtctcgccgctgccactgggagtagcagacaaccaacctccggtgccactggctggacctctggcggctgatgctggagcgaaggagagagcggactcgggagctggagctggagctgcaggaactgcgggcggaactggaggtgctgcgggagttgctgctggaggtgggttcctgggcgcaagctggatgcgcacgggtgccgtcgtagtcttgcggggcgtagtgcggatccggactcctcctggcgctggaagaccctttagctgagcgttctccttcttcaggcgcgctatctcgtccttcagagcaacgatcctcatgagcttcccatcgttcaaggccttggtcgccttgtgcaggtccgagtgcatcctgtccaatcccctcatcacagcacacatgtgaccaaaggtggtgtcgttctcgccagctgtcggacagaaggagctgacgccatcaccgttggctcgacgggggtggtagcggtacgccgtgtcgtggaagatgtagttgtcgcgctcccgtagtctggccatcatcaagtaggctgcctcctgacaggcgtgatctgctgtgcctcctgacgcctcaactgccatgttagcgaggcaagtccccacgtagccatggacctccaagcggacacggtgaggaagctcgccactaagcggcggaatagtcgtgtactccggcgcgttggggtagcccaccaccagtgtcatgcgtgccagctctgccacaaagtcgatcatgccttctccgcggtggttgggtgggtggccagccatctagagaagacaaaggagtaggatcaatgcatgctcaaatccaaatttaaataaggcaataaaagactcaaataagggaaacgaataagagcgaaatttttatgcatagatcattttgcatgagagcgaataaacaagacagacccacataacgataaaataatgagaaattagatatatactaataataacaaataaagcataaataccttgcaacccatgttcctgagctaggacctaatgcatttcacccatcaaaccccaactgactgacgaataaatcccaatagttttactaaaaccctagactgacccgttttgaaaaaactcacttaacgagcgaccaagattttttcccttgaaccacaaaaacagatcccaattttcccggaataaaatccaattgcaaagaacatatgcaatgaaaaggattcagagggctcttaggtttttccatttggcttgtcctacggtcaaggtcggctctgataccaacttgtcacgcccagaaattcccgaatagaattccaagcagaatgtgcattaaaatccccgtccaggaccagccggggtacacaaacaacaatgttgacattcagatccacgtcttacaaacatcataaaagtcttacaaaaatgcagcggaaaacaaaagataactggagctaatccttgactcgaactgcagcgggaacaccactccacaggcatcctcgacggcacggacaaagcctactcctcggagaacccgccatcggacacatactcgagctctgggattggggaaaatagagcaaggctgagtactacccactgtactcagcaagtcataccggaacgggggtatgatgcagggattccacaagggatagctaagcaggttcatttgcataaatactggcatttataaacaggaattgaatgcgaaaacagttgtaataattaagcagtattaatcatccactgtccaacgctacaccacgttgcgacaggcccaaccatccacctaaactatccaaattcaaaagattacactagggtgagactaattacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcaaaccggtccttaactgccatgggtgcgaccagcaaaaccatgcacccacagcccaccatgcgattcattttaattaaccaacacccaagcggtgtcactagtccaacattatcatataaacctatagtctaggttttaaatgagatctccccattgtgtgctagttgaactaagcatggctaagcaaaccctagtcctaactctaatcatgttataacccaagctaacaaaggagcatggtatcaaattagcatggctgtaacaataggtaaccatcccatagtaatattgcaaaacaaatgcgatatttgaaagaaaacattaggacatttgcaatataggatcaatatgatcaagtgacaagcatgacttgccttgctctgctgctggagggacctcggcgactatctcgaagtacaccggagcgtcggaagagccggaatctagcgacatacaaggcaaacattgcaaacaggctataagactactgaaacagggaacaaaaccatttttaatggattctacacatttttcttgatttactgagacttgaatgggattaaacggagctcggatgaattagttatgaattttagaagattcactgtgtttattactataacaaaaatccttaaataatttattgcgcaatattaaccaggactgacgtcagcacgggggcgcggcgccgacatgcggggcccaccggtcagcgactcgggagagggaggaagggcgccgacacacgggacccactggtcagcggcgcgggagagaaggggcagcggcaccggctcggcttggctcacggccggccaaccgaccgcggcgacggcgacggcgtgcgcgcgaacgcgttgtcggcgacgacaaccggcggcgaaggcgacggcgcaaaggcgatgcggaggcggctgcgctaacggcggctaggaaggggaggaggcggcgataaaggcggccgccggctcggctcggcatcaaaaccgaccggccggctaggtctagcggcgacggcacgcggccaacgacggcggcgaccggcggcacgggaggcggcggcagtcgaaggcgacggcgcgcgacactaagaggagaggaaggggaaaagaagggaggggtgcctcaccgagggtggccggcgcggaggaagacgatggcgaacggcgacggcaagccacgggaggacgacgtcggcgagcggacgagcttcggggtgccctaaggaaggaggagagagggattaaagagagggagatgaaccacggcgaccggaaaccatggccgaaggcaccggtagaggtggtgctcacccgtgcgcgaggggatgagggctccggcgac

SEQ ID NO: 92627 - DNA, 2307 bp, Oryza sativa
gcagtaataattcaagaattatggtagtctgggtggttaccttaattgtcagctctctctgtttggtggttctgtgtggggttttcagatggtgagaccaggaaaaatgctgccaccagtgatggcaaccaacccgaaggcagcaaccacaacacccatggcagcccacctccacctcctcgtccgcctccaccaccaccaccagataccaatgccattctcacccaaatcctcgcccagcaggccaacatgatgactgcttttctccaccacctccaaaatccgccacaacataatgctccaccaccacctccccaacactctaaactcgccgagttcctccgcatccgtccacctaccttctctagctccaacaaccccgtggatgcgttggattggttgcatgccgtggggaaaaagctagacactgtggagtgcagcgatgaggagaaagtcatcttcgccgcccatcagctgcaggggcccgcatctctatggtgggaccatttccaggctacgcagccagagggacagcctattacttgggcccgtttcaccgccgctttccggagaacccatgtgcccgccggagtcgtggcccttaagaaaagggaattccgagagttgaagcaaggcaaccgctccgtgatggagtatttgcatgagttcaacaacctggcccgttacgccccggaggatgtgcgggaagatgaggagaagcaagagaagttcttggcaggaatggaccctgagctgtccgtccgtctagtctccggggactatctggatttccaacgtctggtggacaagagcatccgcttggaagccaagcacaaggaactggagtcgcacaagcgccgcttggcgaatttccgcaatcaacagggagctaaccaaagggtccgctacaccaatccctatccagggggatcctcctcgcagcagcaacaacagcagcagcaacctcgctccgcgccccgccctcaattcgtggtgcgcgtcccacagccgcagcaacagcagagtcagcaagggacccgtgcgcctcgtcctcctacgccaactgtgcagcctggccaaggccgcagggacgcttcaggtccgcagcgtctgtgcttcaattgcttcgagcccgggcactttgcggataaatgcccaaagccgaggcatcagcaaggccaagcgcctccctgctccaacaacggtggtaaggatgtcattcggggtcgtgtgaaccatgtgacggccgaggacgtgctgacaactccagacgtcatcgttggtacgttcctcattcattccatccctgctaccattttgttcgactctggagcttcccactcgtttatatctgtgccattcatggggagaaatcagttggggatagaaaggcttaggaaccctctgctcatcaccacccctggaggggttatgacagcaaagtactatagccctgccgtccctatagaaattcaggggattccttttccctcggatctgattctgctagacaccaagaacttggatgtgatccttgggatgaattggttggctcaattccaaggagtagtggattgtgcgagacgcaccgtcactctgtaccgagggccgggacaaccggttgttttctttgcacccccaacctctgtcagtagttcagaactgcatcagataggtctgtcagaaatccccatagtcagagagttcggagacgtgtttccggaagaactacctggtatgccgcccaagcgagagattgagttccagatagatcttgctccaggaaccactcctctgtgcaagcgaccctaccgtatggcagcaaatgaactggccgaagtcaagaaacagctggaagagttgaaagaaaaggggtacatacgtccgagcacttccccctggggtgctcctgtgatttttgtggagaagaaagacaagacgaagaggatgtgcgttgactatagagctctcaatgaagtcaccataaaaaacaagtaccctcttccccggatcgatgatctgttcgatcagcttaaaggtgccactgtattttccaagattgatcttcgttccggatatcaccaactgcgtattcgtgatgaagatattccgaagaccgcattcaccacgcgatacggactgtatgaattcacggtgatgtcattcggtttaaccaatgcacccgccttcttcatgaacttaatgaacaaagtgttcatggaatacttggataaatttgttgtggttttcattgatgacattctgatatactcacaatccgaggaagaccatcagcaccatctcggt

SEQ ID NO: 92628 - DNA, 665 bp, Oryza sativa
agagttgtcaagtcgtcatttatcggattcttgctatattcggttaaggaaattgatctactaaaggaagcttatccagaagagaccgagtttaaagagaatacggcatggtaagttatctattaattaggaatagtttgttagtttccttgtatctttaggaaagtgtgtttagtgtcctataaggactttatcttttccttttatccttaggaagctctctttcttgtccgacaaggacttgtatcaacccatgtgtataaatatgtacacccggggtctatgtaatctatcctcacgatcaatacaatttggcgcatcgccacccttttatttctacttttgtttttacgtttcggcggaacttggcacccgacgcggggctgcatcgtcttcgatctagggcgaagatataagtccaatgttccgccggtccaggcaattgtatcgtctacgtcagcgtcgttcaagactgcatcagtacattcgacctcttggattgctctggtttggatgatatatttgcctaactatttatcatatgtctctgttaatctagtcataacatatcaatttagctttatcggttgcttctcattttagggtttctgccggtatcgactacatcgcgttgctagattagattagcttagacatctaccacc

SEQ ID NO: 92629 - DNA, 1901 bp, Oryza sativa
gatccggacatgcatggactcctcaagaatatgaaccagggtaaagccgctggtttcacagaggatgaacacggaaccctatggaatggaaatcgggtatgcgttccagacgtcagggaacttaaacagttgatacttcaggaagctcacgaaagtccttattccatccaccctggcagtacgaagatgtacttagacttgaaggagaaatactggtaggttagtatgaagcgggaaattgcagagttcgtggccctttgtgatgtgtgccagcgtgtcaaggcagagcaccaacgaccggccggacttctccaacctctccaagtaccagaatggaaaagggatgaaattgggatggatttcatcaccggacttccaaaaacccaaggtggatatgattctatatgggtagttgtggatcgattaaccaaggtagcacggttcattcccgtaaagaccacctatggagggaacaaactagctgaactctacttcgctaggatcgtaagtctgcatggcgtccccaagaaaatcgtatctgataggggaagccaattcacctctcacttttggaagaagctccaagaagagctgggtacccgattaaacttcagcaccgcataccacccgcagacagatgggcagaccgagcgtctaaatcagatcctagaagatatgcttcgcgcatgtgtcctggatttcgggaagacctgggataagagtctcccctatgccgagttctcctacaataacagctaccaagccagtatacaaatggcaccttatgaagcgttgtatggacgcaagtgccggacaccgctattgtgggaccaagttggggaaagccaagtgttcgggactgatatcctgagacaagctgaagcgaaggtcagaaccattcgggataatctaaaggtggcacagtcccggcagaaaagttatgcagataaccatcgccgtgacctggaattcgcagtggatgactttgtgtaccttcgggtcacaccattgcgagctgtacacagctttcggacaaaagggaagctcgcacctcggttcgtgggtcctttccgtatcattgctcggcgcggagaagtcgcttaccagctggaactgcccgcctccttgggcaacgtgcatgatgtgttccatgtgtcgcaactcaagaaatgccttcgagtgccatccgagcaggccgactcagagcaaattgaagttcgcgaagacttgacctacgtggagaggccagttaaaatcctggacgccatggagcgcaggaccaggagccgggtaatccgtttttgcaaggtccagtggagcaaccacgccgaggaagaagctacttgggagcgtgaagacgagctgaaggcagcccatcccgatctcttcgccagtccttctgaatctcggggtcgagattccgtttaagggggtaggtttgtcgcgtcccaaatcgactctaaaatacatcctcgaaattgtgcatagaattagtaaaatccatgtgaaagcctccaacaattaaaatgtgcaaagttaaaagtcaaataaggcttggaggatttttgtatatttcctaaaagcctaaaatgtgtaaataaattttagtggaattttcagagcacaaataataattaagaagaaataaacaaagttaaaaaggttttataaaaagaaaaatcctaaaaagtctttccccccctttttcccttcttgggccggctcggcccagctccctccctctctctcctctcccccccgcggcccatccggccttcccccgcacgcgcgccgctgacgggcgggcccgcccgccaccctcgctgacgggtggggcccacccgtcatcccctacctcgcgccgcacccgccgcctcgcccgtgccctagcgccgccgccg

SEQ ID NO: 92630 - DNA, 761 bp, Oryza sativa
gatgttggtgatgttgctagcatggttggagtggctgctgcatcctgggcatgtgtctcactcccttggactgggattgtgaaattctccaccgtaaactccacatacgcgtcctgatctccttcttcatcagtgttgctgccccagtcccagaacgtcgtctcataaaaaaacgacgtcgcgtgacacacacacgcgtcgcaccacaaaatcatacatcttgtaggcttttgatccttgctcgtagccgatgaagaccatcctcgtgctacgatcatcaagctttctcaagtttggcttggctgtcttaacatagcccacacactcaaacacacgcaggtgttcgacagtgggtcggcgaccataccacgcttcatacggcgtcaccccatcaagactcttcattggtgatttgctcaagacatagacggctgcaaccaccgcctctccccagaaatatgccagcatgtttgccgccttcagcatggacctagctgctgccaccacagtctgattgcgccgctccacgacactgttctgctgccgtgagtagggtgcagtgatttaacgtttcacccctgtgtccgcgtagtactccatgaactctatagaggtgaattcacccccgcgatcagtgcgcagcgccatgagcttccgattgctatcctttctccacgccggcttaatcgctgccgatgcttcgtgtttggcagagaggagtcgtatccacatgtgatgactcatgtcagggccgcaggaat

SEQ ID NO: 92631 - DNA, 1160 bp, Oryza sativa
atgaaagttactagtttagaatatttcaaataaagggaaggagaggaagttaaaaagtaggcagaattacttgtttcttgaaccagtcaaagaaatttggcccatgtttagttccacggtaatatttccaaccatttaatcttaagtcatgacgttgcttatcactaggtgcaattctgctcttccattgttccttatcaaattgtctatatgtagggatggattagggaaaataataggaatttattaagttaaaacaattttttaatatgaatacttactcaaacaaagtgtccatctcagaaatattagtaagaatatacaagaaagcagccttgtactcctccactgttagatcacgacatgtgcgacgattaaaacaccgaccagggtactggaaaatttgaaggttacaagaactctcaaatgtagaggaaccatcatcgtatcgagggatcttattcctagttgatctcacattgtggctgaaataaagtgagaggaaatttgtgttttcctccactagataagcttcaacaatggatccctcaacacgagctttatttctaaccttttttctaagtctcccaatgtacctagaaggttgacaacactaaattaggaataaatagttgtaaggacaagacaagcacttatttcgaatactatgttaactaatatttttacctctcatatggatacatccaacgggctagaacaggaccaccaagatgagcttcacggggaagatgtacaattagatgttgcattagattgaaaaaccctggtgggaatatcttctctaatttgcataaaagaacagcaacattctgttcaagtgaatgtacaacatccttgcttagttctttagcacacaactgtctatagaaaaaactaagctcagccaaacaaacccatatattttctggaaggaatccacgaaaagctaccggaagtaatcgctcaataaaaatgtggtagtcatggctttttagaccaaatatcctccttctcagtaggttgacccctcttctaatattggctacatacccatcagggaacttcagatcttgaaaccatttgagtataatagtcttgtcattcttatctatgcaaaatgctgccctcggcttgtgccacttgccattgcccttcaaatc

SEQ ID NO: 92632 - DNA, 5742 bp, Oryza sativa
acatccatgtgcaatatcacaagcaatgcaggacagtaatcgattaacttggttgtgatgctgccattgaagtcttgcctttgtcctagttaatcaaactcatgaggcctttgtttggtctggagcactgctgcttctgaaaagaactccagagagacctcgagaattagcttggcgctctatctcgccaagtttctgcttcacaatctctatctcccgagccaactgatcctccttttgcctcaacgcctacaaaataaatgtttttttttcaaactcataaaatgatagaaataatcgacaaaaaatagcaacacaagtcaataacatcaccaacagcaagactgaagatatacggtcacataatggcaaagcacattaacaactggagtcaaaggccagatgatttatgaatacatgctactgcaatgcattgtctaaccagagccactcatgcgcattgaagataatgttgacatcaaatgttctctggtcaacacctattgatagtgagtttttgttgcagagacttcagtttcatatggtacatataggaatttcatttccacttgggatttatgggataccatagcaatacattactcttggacttgattctgtttcattcatctctggttctcacaaagccacaacctaaggcatatttccagtgtttcagactgctatctgttctcttgtccttttcagagagaagagtactacctcttctgcatacaccaaacagatctgtctggtaactgtcacttgcttggacaggaaaaagacaatccacaaagctggtccatattgaatgatataaagcataacaatgaaaataaacagcaaagaacaagtcaacgacgtgatattgctgaaacatcaaattctagactatttatgcaaaatgtaaattggtcaaaaaatatgcaatgcaacaaaaactataaatggccaattttagaggaaaaaaaagaacagttggcctgctgccatattattgctcacagatctgatacctattgaatgttcagaaaaggccatgataacactacaatagccctggtttagaattaaggtgtagtgcctgatactaactgcaggcaaagtctgcagcactctgtatggttgcagcttgctatggccttttacaacccattagggctactgtactgcaaggtgtgtagcatagctttggtataaatgtatttttggttttcatagcaacagtttggtgaaaatgcagtacaggtttacatatgattatttgttgcaaatagttgctatcctccataattgaatcattactacaagacttcagacaagacagtctacttacatttgactgatttataacttcagacaataaaggtaagcactttgtgtctcttatatcgctgtcatccaatattagagcacttcgctgctacagtccttctacacattatttagaatgtaataactcctatactggagtgtactccaagaatacaactgtatccaagatatagcccaagcattgccttgtttgttatcacttgcaagacttcactgaaatattagagctatcctgacgattctcagcaatgtaaacaatagctattcatccccaattattcccaggccattgaactgattaatttttttagtaacatttggtagaataatcctaagattgaatagctgcatcagacaatttgttgtttggatataccaatgagctatgtgatttttttgggggggctcctatttatagattatagatacataaatgaatatagtcactgaaatgaaatatgtggacgttaacaaaaagaaaaccattaccctgcgaagacacaactcatctcaagttacaaaactattgacattccagagcttatacctcaacttcgtttctacgagcctcctcttttcgggcctcggaccttgcgcttctttgcacctcaaagattacagcagccccagcaacctactacacaagggttgctgaagtttagtgaatggcaaaaataaaacaacagcaaactatatagaaggcatgcaggaaggcaacatttgtcataatttgacatgggatcataggtgatggttaaccaataaaatcagcaaactttacaaaaaagacatgcattgaagtaacatgtggctagattttctaaatgttcttatgcattctttatttctacaaaaaaacagacttgtctcgaggatatttccagttttttataaatggaaatcacataaaagtacggtttgcctgacactaagataatcatcacctgaaaattaaagaatttaagcaaaaatcgaaagccgaaattacaacagcaaagaataagaagaaaacatgattgtgaataccgagaaaacaaagagctccccaataagatcagcagcagcttgaacagctttctcctcgttcaaaggccgaatctcaaccttagttgaatggccatatattcttctctggatatttgtggagacccgatgatttgtctacaaaaccagttcgtggccaaaatgttatttgaagtagttaaagaaagaagtaacagctgaggaggatgcagggacgacaaattgtgagcagaattgttcgatcactagcatatttactaaaagtgcacttttcagattcagacttctcattaataagtacagttacccttctcatttggaagcaatgcataattttctgataacgaatcccattctgcgtatctcaatcaacaaagtcaagaaatggccgcaagaaaatgtacaagctagccaaaataacctgatattgcggagcagctcaaaaacaagaacaagtatatcacaaagaattcagcaatcaaagaacattcaccctagccaaagatttgacacacaacggcgaaacccttcattcctcggagggtagtaaaactgcgctacgcgatcacaaggccggggaaaccccaaaccctcggcggccaaaatcctctccacatcctattctgcatttctaccgctaaattttcacaaggcctgacgatttccaagcgcacaacgaagaacaaaatggggggaaggggagacgagaggagggggagatgggcgggggcccgcgtcacctgggcgaggttgatgatgagctggcggaactgagggtggcggctggcctccgtcttgaggcggatggcgatcggcttcgacatcgtcttcagcgccagcgtccccagcttcgccagcggaaggatcatcctccccctccctccctcccccggcggcgtcgacgaggagctcgtgtaccggacggatggatcctccttttcccgctccgcttcccgtcacgcggccgcggaggagcttgggagatgaggcggcggcggcggcggaggtcttggcgagttcacggcgagacgatgccggcgttgagatcggaagtaggggatattaggaaatttccagcacgagcttcactactggagaaggcctttttttttcattttttcttttttcacttcacaccctccggtttgacagaattctcatcaactccaaaaccatctgactacttcccgataaacctaaaactgtacatgaaaacatgacccatcattattcaccagcaataattactctctccagtttcacaatttttgatgttttggataatcgcacggtcttcgaaagatatactacatttgattatgtttttctattataatatatgtaatcaattaattatttttgtttttattatagtactttataatataacattgatttactgttttaaactaaatagttttaaagttataaatagtcaaagttatacaactttgacctcaacatttttaaaaacatcaagaattatggaaccggagggatgcttattaaaactcatgtagtaacatcatttacaatttgttgaattctacaaattttcattcaacatattcaattaccaccctcacatcatttctataatatttcaacatatctataattttataatacttaatatatattcatccatataatacgcatcaaagcacggggtaccatttagtttgtttcttgattagtactaataaaccttgactttttagtatttttttcctatcttttatttcttgcaatgcaaatattggcaaacgtcctaatagttcatctataacgtcctatagagtctattaaatttatttatctctaaatatggatttttcaaaccacctttaattgttgttaataactaataacctttgtactcctagtttgattgttgacaaaaaaatatatgtatttaaagattacttaataattcctgctgcaaagcatggagaatctaatagtatcttatatacacaatatgccttgagccacatcatcttttttgagtttaatctctaccatccttcaggtcgtgagttacatttctttcatttattgatggtcattactcctatgtgttgaaagtgtataacattgattgagcgagagggattgagcgagagagaattgcacaaaagaatgtagggaatgaatgagcgggatcctttattgatcaatgcggtacaaaatatagatgggtaaggggtggcaaccggagacgcgatggttgggaaccattgcgtccgttgccaaggagcgcctagggaagacgcggttgccttcggttgcgatccatccttttatatggatgagatcacctgttgtttcataacactcccccttgagctttgatcattgttctttcattgttccagatatctataaagataatcttagaaataattatagttaaatacatcacgtaaaactcctcgaaaacccagtgggaaaaataaggagagaaccgtgatatatattattgactattttagatctatgagtaaagctcatagtatgatccaaaatagtataatgtctacagttatcatttagtaaaaaccccagtgaggaaaagccaaatgataagacatataagcttatgttgatattacctcgttaaaaactttggatgagaaaacctaaagggtaaaactcatacaaaggaaaaagagtataatatgacgaaaataggttatttgccaaaggaagatactccccctgaatcctgcaaatttttaagtcgtctcataccaattccttcgacacatttaaagaatgtggagtatggcagagattttaggaataaatcagcaagattatcacatgacttagtttgcaagatgtttatctctccatgttgctaaagctcatgaggataaaataatttaggagcaatatgcttagtgatgttgctcttaatataaccagtttccatatgaacaatacaagcggcattatcttcatagataatggtaggtgattccaatgaaccaataccacaagatgttaatatgtggttaaccattctgtgaagccatacacattcacgtgatgcctcatataatgcaattatttcagaatgatttgtggaagtggctactagagtctgtttagaagacttccatgaaatagcagttccaccttgtaaaaatacgaatcctgtttgtgatctggcgttgtggggatcagatagatagccagcatcagtatacccaattaaagtcgaatcctggttcttttaaaagaaaagtccaagatctcttgtgccattaagatatcgaaagacattcttaactccagtccaatggcatttggtaggagcagcgctgtatcttgctaatagatttaccgagaaagcaatatctggtctcgtactatttg

SEQ ID NO: 92633 - DNA, 730 bp, Oryza sativa
atactatatatcaagcagatcgtgatagtctgcaacctagctcggtggtgcacaatgctgagactaggaattcggaagaccatagacacattgtttcgggagatcacgatgattctataggggttgatgaaattgccatcaactactctgaaactagagaatcttttgatagaagagctacaattgtcgacattaatttttctgaacaaattgctgattgcctccaagttgatccagaacctaggtctataaaagagttccaaaagcgctctgactggaacaaatggaaggacgcaattgacgcataattcgcctcgctttacaaaagagatgtattctcggctgtaatgcctactcctcgtagtatctttcctgtgggatacaaatgggttttcgtccagaaacggaatgaaaacaacgaggtggtgagatataaagcaaggcttgtagcacaaggttttacgcaaaaacctggcgttgatttcaacgaaacttactctccagttatgagtggtataactttcagatatttaatatcattggcaatacaaaatcgtctatttatgcagttgatggacgtagtgacagcatatctttatgggtcacttgattctaatatttacatgaaggttcctgacggaatcgacatcccgaatcagaaggtaaatcgtaacatgtattgtgttaagttgcagaagtcattttatggcttaaaacaatccggcatgat

SEQ ID NO: 92634 - DNA, 1565 bp, Oryza sativa
taccatcttatggagcaaagatcagctacatggtatttctttgttgatttgaattatgttgtagtgttatgatttttctgtttgtctcaccaatttcatttcattttgtttgtagccgtcattttgttatccctttgtggaaaggaactggatatactaccatgttcatgcaaggttattactcagtcttttccatatagtggtaattatcttttgttgtttcactaatctttgtgttcaatatagcgtttctcatatctcaggctgtgttcttccccctcctttcccaactcacccctctcgttttccgagcacgcttttcaaactactaaacggtgcgtgttttgcaaaaaaattctatacgaaagttgctttaaaaaatcatatttatccatttttcaaaaaaaagagctaatacttaattaatcatacgctaatgagtcgctccgttttacgtgttggagggattagttcccaactgtgggaaatgaacacaacctcagtcccttacgtagaacatgccttttgaattgcaagataatatcaaatcttgtttacgtcttattctggaagtatctaactgtatatcaaatgttttgttgattactgttaaatgaaacaagtgaagtttcccccttttttgtggaaaattttgatcaaggacggaacctaaatctcgtttaactcttattctggaagtatctaactttatgtcagatgttttgttgattaccactaaatgaaataagtgaagtttccttattctttggaatattttgatcatgtgccttacaaattgaacaattatatgaacccacgtcctgatccattttctgtttgtagaagtaaagtaattggttatttttgatatggttcatgtttgtgtctaatatcctatccacatgcaagttagtgtagaaactaaggtgctgtaaccaatttcagcatttgatctttatgtttagtatcctgcacctcatttttcatggtgactggtagtagtatttgtttgttttcctgttactctgcaatggaaaaccatatatagtaggtttgagtacagtatttcacctcttctgtatatctggtttaattgattaagttcactagaattttgaattttcagcacgttttctaatatttaggccttttgttctaccctttcttattgaacatcccagttcagatgccgcatatgatcttcaccggacttgaagactacaaagcaaggggcactcaagcaagcccttactatacgatcactcattatacagagtttgcagaaaccaaggatacagtgcttatccgaggagacgttgttttcaccagtaaactgactgattcagaggcgaaatgtcttttagagagtgctcactcattctacctgaatgatgtgaggtacaggcttgtagagcgcttcaacaaagaaccacatgagtttgagttcaaagatgtcctgcaagtgcttgaaatgccaaccatgtgacaagattgaagacctgcaatagcaaagcttcctggagcatgtcagtgcatttttacagtggcagggtctagattgcact

SEQ ID NO: 92635 - DNA, 762 bp, Oryza sativa
attcctgcagccctgggtgatggtagaagtggccaatgtgggaacaaagtcgttcatcaataacaatgaagacaccagtcggcggcgacgatggcggtcgattgtgaaagcgaagacgcccaacagcggcggcataataggtcagccgtgtaggcggaggcaccactcggcggcgacggaggcaggccggcggtgaagtcgtagacgcccaacagcggcggcataataggccagccgtgtaggcggaggcaccactcggcggcgacggaggcacgccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccgctcggcggcgacggaggcaggccggcggtgaagttgtagacgcccaacagcggcggcataataggccagccgtgtaggcggaggcaccgctcggcggcgacggaggcaggccggcggtgaagtcgtaaacgcccaacagcggcggcataataggccaaccgtgtaggcggaggcaccgctcggcggcgacggaggcaggccggcggtgaagtcgtagacgcccaacagtggcggcataata

SEQ ID NO: 92636 - DNA, 1335 bp, Oryza sativa
aaacacagagagaatcaataaagtcgtcatccactttaagaattcttcgatttgtgtttcactgggtttcggcggtctaaccggcggcacaccagtggtcagaccggcggcatcgcggtggtcagaccggcgggtgacctgcggtcagaccggtggcggcatcaggcgcggcagggattccagggctgtccaaccggaagatctacaccggtcagaccggcgactacgcttcggtcagatcggctaatctactccggtcagaccgatctcatcgaaattgagggtaacttttatttctgctagaagttttcagtttttgggtataccaaccattcacccctcctttggttggcttagttcttgtgattcgatcctacacagagtcctactcggacaccacaagatttacttagatagtatctgcacttgtttatgtggttctgcttagacaaggggtcatctaagagtataaatagaacacccctaggaatagagggtacaaatcttgaccaaggcgatcacaaaaccaacatgagccacaaaagccaacaagacaatacaagtcgactccaatctggccaagttcctgttcaagaaagccgacaatagctaaccgttgatcacctgctcgagctttacgccactattctgacatagactagattatggtctcctatacgtcattgcacttgtaagatattgacatataatggtaataccggcttcgatcaataagagtaggctattacctatcagcagggtgtcttagcctatataaaaaccttgtctccgttgcttttaccgtagtctcgcatataccttagtatcagtacactattcaagaaatttatacaaatatcagttattttgttatgacatgttttattattaaaaataaactttaagtatgtcttatactttagcatatttacattatttttctaataagatgaatggtcaaacattatttaaaaatcggtgacatgatctattaaaaaatagaggttgtatcttacaattaaatacataaagagattttctcccattcttgaagaggtatatgcctcttcatacttaagatatacctttacttttaccctacataaaaggaggtaccaaaattatttttacatgttggatgattggaaatgagtatacacctccggactaacaatatgagttatatatacctctctatacctcacaacaatcataataatgttgcaggtgcataatcataaacttgttttctaatcagtttaatcggtttaatttttacctctcaaattatgaataggtatatacctctttaaagatggaataaaacctcataca

SEQ ID NO: 92637 - DNA, 999 bp, Oryza sativa
tcaaaagcatagagataagataaatttattttctgctctttacaattgcaaaagtacccgagtagtaaattatgattcgtgaaactttattccattaatgacaaactcatgtcactcatatgcatgtttgggaagtgcctaggctgactcccgatgcttgggggctatgactagtcggacagagtgtttaaacgtacggagtcatctgctcggggaaatcaaaattgacaagaggagaaatacatatttataaatattttaaaatacttaaatttttctcgagtattatatttacatcagatactactcatcctatatgtttgttctgcaggatccagatccagatatgcataatagggattcatggctttcaaagcttatctcctacgcttcagaaatggatcagtcagaacatcaccgaccggcttgccttcgtcgccgccgactggtgtctccgcctacacggctggcctattatgccaccgttgttgggcgtctacgtcttcaccgaccggcttgccttcgccgctgccgactggtgtttctgcctgcacggctggcctattatgccgccgttgttgggcgtctacgtcttcaccgaccggctgccttcatctgctgccgactggtgtctccgcctgcacggctggcctattatgccgccgttgttgggcatctacgtcttcaccgaccggctgccttcgtctgccaccgactggtgtctccgcctgcacggctggcctattatgctgccgttgttgagcgtctacgtcttcaacgaccggcttgccttcgtcgctgccgactggtgtctccgcctgcacggccggcctattatgccgccgttgttgggcatctacgtcttcaccgaccggccgcctcgtctgctgtcgactggtgtctccgcctgcacggctagcctattatgccgccgttgttgggcgtctacgtcttcactgtcggcctacctccgtcgcccccaactggtgtcctcgccta

SEQ ID NO: 92638 - DNA, 720 bp, Oryza sativa
aataatataatcttctggaaatgtacatagatataatagacatgtacgcaagttatgaggaagatcaaagtaactaagcgacagtatccttatcattccattgacatcctcgtttctttccaatgcataaccaattgacttttccacttgattccattgatcttctgtcggtgcttttgtagccaataaactggatattgcaatagttgccaagggtaaaccatcacattttgccaatatgttacaacaaacttcagtcaggtgtgatggacattcctccagaccaaaaattctcttcagaaacaacctttttgaatcaacaaaatgaagaggccttaatttatatacccgatgcacatgtgggaagcagcaagattcagctacttcatttatacgtgtggttgtgatgattcggctgccagtaatacttcttgaaaaagcacatctaataattttccaactttctatattccataagtcatcaatcacaataagatacctgccaatttttttattataagcatcagtagaaatatttgatcaaataaatgttagaaaggggatatttttcccatttcggtctcatgtcgtcctagaataattcaactaaagctgacttgttaaattaacacaaatctggtctcgcttctctaaatcatgtctcagttaggtgaaatgtgtccccattgttactgattttgcatgattgtagctatggtt

SEQ ID NO: 92639 - DNA, 562 bp, Oryza sativa
atgcataaaagggattcatggttttaagcttatctcttacgctccaggaatggatcagtcagaacatcaccaaccggccgcctcgtctgccgccgactggtgcttccgcctgcacggctgacttattatgccgccgttgttgggcgtctacgacttcaccgaccggcttgccttcgccgccgccgactggtgcttccgcctgcacggctgacttattatgccgccgttgttgggcgtctacgacttcaccgaccggcttgccttcgccgccgccgactggtgtttccgcctgcacggctggcctttaatgccgccgttgttgggcgtctacgtcttcaccgaccggcttgccttcgccgccgccgactggtgcttccgcctgcacggctggcctattatgccgccgttgttgggcgtctacgtcttcaccgaccggcttgccttcgccgccgccgactggtgtttccgcctgcacggctgacttattatgccgccgttgttgggcgtctacgtcttcaccgaccggcttgccttcgccgccgccgactggtgtttccgcctg

SEQ ID NO: 92640 - DNA, 734 bp, Oryza sativa
cccacattgccacagatgctaaacattctaaagagcaggaaccctgggacctatgttgctgtgccagaatgggaatcaattcctccttcaaaatatcttgggatgcaccggcatttttttgcattcggagcatgcattcatgtgttcaagtgctcgaggccggtgctgtgtgtcgacgtatctttcctatctgggaagtaccgaggccagatattaacagccattggtgcggatgcgaacatccagataattccggtagcttttgcttttgttgaaagcgagaactacgaaagctggttgtggttcttgcaacatcttaagtggggagtggtgcaaaaacacacatcgatatgtatcatccatgactggaatgccggtctgttgaaggcaatcaaagagctccaggaggatggtgatggtgcatactactggcctgacatgcatagccgttggtgcatgcggcacatgggggccaattttttcaaacaattcaacagccggcggctgatgaacatgttcaagcggttgtgcaaggaaaatcagtctacaaagttcgatgagctttgaaaacaacttgacgaggggacaaggacacatatccggtcaaagcagaccaacaacaacccgcaggatgtacatgtcccccaggccctggaaccaatggatgatcttattccatcaaatggaaagaagcgtgcgtcatcaaaaaatatcaaatgctttacccattggat

SEQ ID NO: 92641 - DNA, 1296 bp, Oryza sativa
aatcatatatacttagcatatgaatgatattattaaattggtaaaagctctaattaagatacgtatgtacatactgtatgatttaaaattaataaaaattgtaatcatcatatatacttagcataggaattgtattaaattaaatgttaaaaactctaattaacatatgtaaatgccacaggcatgatttaaaccttttaaaaattcgaatagtcatatataagtagcatatgaaagatagtaaattaaattgtgaaaaactctaattaacatctgtaaatgccacatgaatgatttaatacttttaaaaattctctagtcaattataattagcatatgaatgatagtaaattaaatgttaaaaactctaattaacatatgaaattgccacttgcgtgatttaaaacttttaaaaattctctagtcaattataattagcatatgaatgatagtaaattaaatgttaaaacctctaattaacatatatatgaaattgccacctgcgtgatttaaaacttttaaaaattgtaagtatcacatataactagcatatacatgatttaaacttgttgaaacctctaataatcatgcgtaattaacatatgccatacatcaattgatttatatggataatcaatacatccaaaatagtttacatcgtgtacacaataattacggcattacatcagcggtgacggttgaccgcacgtactttctcctcactattgttccctccttgtgatcgctgcgtgagtaaggggtgtcttcatttgataggaggatgctagggtcaatcgtcaccatgaaagggggttgctcatccaactgatcgtaatgctcgtcagtcttgtcgtcaactccgacgatttttcttttgcctgggagaaccacttgacgcttaggctcgtcaggccctctgcccttctttcctttgctagacatgtccttcatgaaaaagacttacgttacatcattggcaaggacaaaaggttcgtccgagtatccaaccttgttaaggtcaacagttgtcatcccactgtcatcaatcattacgcctccactagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccatcgatctcatatccctggaatgtcgcgatcgacccagacggtcccct

SEQ ID NO: 92642 - DNA, 686 bp, Oryza sativa
tcctggatcgtctcgtctaatcttgtatcgtagtgctttgcaaacagggcatgcttctaggttctcatactcctcaccgcgatataggatacaatcgttcggacatgcgtgaatcttatgaacttccagtcctagcgggcagactatcttcttagcctcgtacgttgtctcgggcaatttgtttccccccggaagaatgttcttgacgagtttcaataaatcgccaaatgccttgtcactaaccccattttttgccttccattgcaagaactccagagtggtatccaactttttgtgcccctgctcgcaacctgggtacaacgaagttctgtggtcctccaacatcttgtccaatttatgggcctccttttcactttcgcagtcctccctagcgtcctgcaacatctgatcaagatcatccgcaacgtcgttaccatcagcagctattttctcctcgcccgtttgatttccttcaaatccaacatactgagcaaagtccggaatattgtcgtcttccacttcatcttcttccatttcaacaccttgctctccgtgggatgtccaacatttatagcttggcatgaaccccgactcaaacaagtggaaatgaatagtcctggatgcagaatactccttctgatttttacacttattgcatggacaacaaataaaacccctttgcctgt

SEQ ID NO: 92643 - DNA, 3706 bp, Oryza sativa
accgactgttcatcgaagaaaaaacaaacctactcacggacttactataaagaaaatataaagccaaaaaaaaaagtacatagtaccattggaaaaaaatcaatggttaaaccaaatctataggattttttttaatatttaaagatctatataattataaacgtatgcaaatacacatggttaaaccatatctatattataaatatgaaatatccaatcaattctctttaaactttctatcttaacaaatgaggctgacatatactaattaatgttatgacaattttttaaataatttcgcatcatattttagttgtcaaatataacattatgaatatacaacactaatttaaatatacatgtttaatgaaataaaaacaacacaatttagttgttttttctattagatctgatttagttttaatttgtttgagattaagattctcaaagtgtttattgaaaatttttaaaactatttaattggtattggagaagtgagcagcataaatgttacatagatgtgaaaaacaaatataaaaaaatgttttccgacaatgatcttcctataatacaacccattaatctaccatgagatttatgatcagatatgtatgttttatatttgccaaatagttttgacaataaatgaacaatctagtaccatgcacaataaatatatatatccttatagttaaggaattccaacatgttagacataattgatggatgtatgtcttacaccgcactgacatgactataagtatactctaacaaattagttattataaataagtttggggaaataaaagtattctctaaattagtaaaggcgtctcatgtgattatgtatattatatattgaaaataaaccagtagctaaactattgatatttgtcgaaatataaacaataatatggagctctggagattatcgcagtggtattttttaaaagaattcacttttgtcccagttacatataaattcccccattgttctgggataaaatttgactccttctatttatgtggcagatggagtacaagtaagataactctatatttagttggatgaagtagtactattagctatatttttaagtagaaaatatctttcattaatatatcatagaataaaatatgttacttaaagtcatctatagcatacaaaataaaagatgttacttaaagtttggaaactccaaaaaatatttcaaaacagaatcgcacaaaatacaaataaatatgaaccaactccattattgtgatacaattttttttaataaattcaagatgtgcagttctgataatatgcccaaaccagttattaatgaaaacatgtttaaaatagagtcaaagaacataaaaaatatcatccacacttaaacatccgtaataaaaatttaagcaatattaaacaagatgcccgtgcataagttagtcttccttccttgttattcaagaattcttgtagatgatttaaccggtctaagagctgctttgcacaaattggcaagtgagaccctattcaaatttttttaacgtggcttccacagtgtgaaacttgtgagtggtgttgtggctgcaccttgtgaacaatacttgagcaataaagaacatattcaatcatcaaggcattgacgatctctaccggtttcgtaagttttatgtatatatttggttttggcattaacttttctgcgattttggtcaagttaatccatccaaaacctttttaatattttgtaaatcatatctggaagatttcgttgattggttcttgctagattcgaatttgcttaagttttaggttttgttcagatttactaaaattccgagatagctggctttagagtgtgtttcctcttaaaccgtttattattttgcaaatccctccggtggagttgtatcttggtttgtctagtttattctatcaaaatttaatttcaattcaatggttggttttggagaaaacacgtttttacagaagtactgttagcctatttttaggctgacggtcagaccgcgagagtacctgcggttagactgaccctattaggtcagatagaccgttataagtgtgttccattggattttgaggttggggtgtgttttaatctatctaatttcgattatttgacttatactgacataatgtatcattcaccccccctattggggctagtatattcgagacaatgtggtgtatgagctggcccctcataaaatggttgatgatgtgaataacattagatgtgacaatcacctctacgatagaactttccctaatactactacgtgggccttaggattctgcgccaaagttgcattgtagaactgaaataataaatattaatatggattgcagactatgttctatattataaaaaattgggaagaatgaaagataataaaggagggagtaaatcttttcccgaaataatttatcatgatttactgcgtacctccttgaaaacgacacggactgaataatcggccgagaacttttccagctccgatactcggtatggatgcccgacgcaggagcatgcaattccatggtgtcgcgtgtgcacgacgatgcagctgccatttttcttgtcaggtaggtagccccttacggcctcccagtcaaccatggtggtaacgtcctccaagaccactaggaacttctgacttaattgctgcttgaactcctcaatgagtacgtcgtctgtcgccaccatcaagtccaggatttttacagtgttgtcttgttctggacaaacatttttgtggaactgagccagcaagctccggatgaactcaatgggatggaaaggatgcaccattttcacccaggctcggcagttgaaacttttcatggtttctgtgtcgtcgtaggccttcttgatggacatcatctccagatcgcttcctgttccccacactgagatgacttggagtacttctttctccaccttcaactgctcttcacaacaatcatgataacaatcaccattatcatcatcgtcctcgttgttgttgttgtcgtcgtcatcatcatcgtcctcgtcgccgccgcccccgcctgctgttagggatggagccataaaataggaacgagggaaaggtgctaatatatgaagtattaagtaaggaacaaaattaacacttgtcattgtcttattgagttacataatgaaatttcatatacataaaaggagttcacctagcatatggcgtgcttggccccccttcctgttgatcaacatgacaagatccacttgacggctctgctttgctgcatctgtcggtgccattgcattggcaacagcttgttgatgcgcctgctcctcaggcttatgaccggagtcaccaatacggttgtaacgcaagttccggtgacccatggcctcgaccctagccttgagctgctctatattagcaacggcagcgtccaggtccttccctggtgccgcagacggcatgcaccaaggcagaatcatgcggcgccaccagtgcggcttgctgtcgaggtaaacaatggtctcgatgcaatcctccacgtctagggccgtgttgcggacctgcctcaccaaggtcctcgtcacgttgtccgtgacgcggcccttggcatcattaaggaaggagtgcatcatctcaaactcgtccgagataaccaacagatcgcgctgcacggtcttgtgcagcttctcctcttcctcca

SEQ ID NO: 92644 - DNA, 1260 bp, Oryza sativa
gtcattagtcaggcactttccaaggtattttctctattcctctctatttgataactgctagcattgcccatgggcattagccttttagaatgactgaattctgtgcctttcctgactgaaaatatcttatgcagtactccaattctgaagctgtggtttatgtgggctgcggggaaagaggaaacgagatggctgaggtccttatggacttcccacaattgacaatgacattgcctgatggacgtgaagagtctgtcatgaaaagaactacacttgttgctaacacatccaacatgcctgttgctgctcgtgaagcctccatttatacaggtaatacatatatactgattactgatgtttttaatttcgcattccactagtatagtactacatgaatgtgtttcgatcttctgaagttcattttctctagaagaaagtgttgctttgttggagactatagctatctcaatacatcagaccatggatttctgcaggcttgtccttagccatttgtgatctatgagctaattttggaataactaaggttgcattgacaaatacatctatgcatgttccataattgttcagtagaacattgaggatcacatctttatgttatccatggcctttattatttattgaggatatacacatattcctgttagccatgacctgtattacttactaactgttctgttgcagttcagtttatgagttatgacggatggtaactaacttgctagcactagatcttttagtgaatgaacatcatcaaagtggtacaatatgtgtagtttcttgtagaacactaaaaggagtccttgcttagttatgctttatgcctgatgttttctttatcaacaaaacaatcatatttttttctgcccaccaggaattacaattgctgaatacttccgtgacatgggctataatgtcagtatgatggctgattctacttctcggtgggctgaagctttgcgtgagatttcaggacgtctggtatgatgcttcctttcgagttgctattttacctttttggcctgtatttttgtaacttatattgacttctcaatgctgtgctgtgacatgaatgagaattctttctaatgtatcattatccactatttgtatttggggtttaattttttcaggattattgtttattttctttccgttcagtagcttattttattactaatttcattaatagctgactgtaccctccaacatcaagaatactagtgcaatggggatatatta

SEQ ID NO: 92645 - DNA, 9938 bp, Oryza sativa
taagggatgcaaaaacattgtgggagaagctagagatggaactggcgggtaccaaccaggaagttatggctgcggtcgactccctccgtcgaaaaggaaagcgaatcatgcggctcgcatcgtgccggcattcctcggacgtctataatccggcaacatcaacaaggacgttcgagccaatgccggagtgtccctctacctcttcccggccgtccacctcagtccgcccttcagcatccgcgcgacgatccagtgatggtcgtgcaggagtaaggtcaacttcgtttcgtgatccacccactattccgactatcccagaaatcactgaaatttcggaacgcctaggaggctttggttcaactcaaggtaaaatacgttattgcagaatgctaaaataaatgccatttgtattaaagactaatttatacgttcgcagcacaactggaacgggtacccccacatagctctacgcccatcacctctcaatggcagggtgggtttgcgttgtttgctggtacgggatagctcatcaatatgctattttttcccaattgtttatgtgaactgaataaatgatgttttccaattgatgacagagggaacgcgaatggtccgtcccgtgcctcatatgcctcctgctaggccacaaatgattcctcaaatggctctcgatgtgccaacctcacactggcaaggaggatttgcaccatttgcaggtccgtgtacattcagtaccatattggcatgcatatgtccactcgtaattttactttttgctaattaattgcacatacagggactagccaaggtatccctaccataccccaaatgtctgcagattttatcggtcaaggagggtttacgtcgttaggcggtcaatctccccttacatctaatttcatatttttattatttcaatttattaatttttcatgtatatgaatcttattgactatttacttcctgatattaacagggcctactcagtcggttccactgcatgcacctacatatggcaccaacccatggcaaggacaatccatagattacggtggtacgcacagccatcattctccatacacatatatcaatggcactttcatgccatacatgattcccacttcaacttaagacaataactccgtgacattttatatggatgcaaggcacgtcatttggtggtagagtacagggttatatggacttgttgtaacaaggtgattggctatttggtcaatattcctcgcatcctaatgaaattccatatatgcaagcaccgtcaacaggtttggattttttttgtgttattgttgtttgctccagctttgataatttcattgatatctacattgcttctgtagggtcatttcgccctgaaataatgtcagggtttagtccttacactacatcgtacgacgacatgtctagcttcggtggagggtcgtcatcggtacccaacgagcttcggacttcacaaactaatgatgcgcctcatgtgacacagcccacataaccagaggttggcgaaggaaacgacaatgacccgcatagatctaaccgtgagctccatgagccaaaccgtctgtcactctcaggcccgcgacatgccgcaggacaaaggaaaaaaaactacaaaaaagcgaggtggcacatctaggactacgactgaccatgacgatgatgacgagtagaagtgaacattatgtttttcagttcactgccaaccctatctgaaccttgctgtgattttggcttattcttcatgttatttgtactgcaatgaacattatttatttgtactgcttattcttcatgttttgtacgatgtttcgtagttcataaatatctcatatttttatgccctattttgtagccagttaacacatatgatttttggttaactattaatttttcgtacgagagctaacaaaaataatagtctcacaaactaaattaatagtgcagtttctatgttactcgtgcggttaaaattacatattacttttactttttactactatgacttaaattgcccactaatttcttttcacagagatgcaatgatacgcacctaaaatggcatcctctctttccaatcacgggacatgcgccaaagcatcaaatcattcacaattaaactttcaagatttcgctgcgctgcgccgaaagtgacttcgtcgctttgtgattaataaagcaaacagttatgcagcatgtgccgccgaaagtgacggtgtcgctttgcaattattgtcatcacgagtgaaacagtctgacgctattgaattgattagtgaaacagtccgatgcaccgtcgtctctttccaataattgaaactgcgtagcttcttgccatcccctataaataacaaccaaacctagcacacaactacatctcttcttcataaacgttctgctggttccaactttgtgttgcatattcttaggcccggtcttgaggcaggaactgagtagttggtgaactcgctctatgttgttcgttcactcgcgacacggttcctgtcccaagactgagtctgtgaatatacaaatgtgatttttttaatacattctaacacccactctttttttcaagttccagcatccgtttgtaaatatgacctactcctacaaattcataaactcggtgttgcatattcttaggcctgatcttgtggcaagaactgagtagttcgttaactcgctacgcggttcttgtcacaagaccgagcccgtgaatatgcaaaggtggttttctctgtgaatataacatattctaaattcctattctttgtcaactttgtaaaaattgctcccgaatgatctctctactcctttatatatttttaataaatatatattcaatttctgtttttctataggtaatatatgttttctttctctgatatcattattttgcaaattccaagatatttatttttcttctcgtagccgcgtacacaatctttgcctattttcaatataaacatgtttctcatgttcatttatgtatatatatgttgcacacataataaaaaaatatgaaaaaaaaatcctttctactccctccgtcttgaaaaaacgaatatagtactaagttggtattttttgggacggatggaaaaaaattatactttttactctctcagtcccgaaaaaaacaaatctagtactactttggttttttatgggacggaggaagtacgtaccaacggtgacatgaaatattagcaatttgcaaagcgtaattagctaatcgctctcgcgcacggggagagcgataccgctcacggtctcgctctttcaaagagcgagaccgaagccgtcgctgtcgcactgccgcctcccaggattagcagatggattaggggcgtggaccacgcggcaacggtatcgcggtttcaaagggcgataccgccggcgctctcgcgcgcgcgtaccgcgagaccgacacgctctcgctgagcgttagcgcgagaccgctccggtcattcctcggaccccacaggcgtcagtcggcccacgctgctacgctctcgcgtatcccggccgtgataccgcacgcgctatcgcgctttcaaagtgcgagaccgcttcgtttcccgcgtgcgtcaggcggcatcatacggaccgcgctatcgctttacaaaagcgcgacaccgcctcgctctcacgctttacgaccgcgagaccgatgcattagctctccctcactcccaattagcgatagcgccgccgctttcgcgcacgcatagcgcgatatcgcgctatcgctgtttcaaaccgcgacaccagtatatttccgcaaatccgcccctaatcagcttaatcttgcaattccggtcaagaacacgattaatttcaaatttttttccatactactcaaataatctcgacgcaaatcaccagcaaccacaaaaccaaaacaacatgaacacacacatgtggtaataataccaatacaccatcgaatggttccatggcacaacacatcttaatacaatcaaccccaaacaatgcttttctaccaaacaaggagagccacagaaaccggcctaaacaattctcatcaattctagagattattgcaaagataaattaaaaaaaacaaggggaaaatcaatcgaagggtccatatatcatgtatcgatcggtcccatgcctaagcatccatccaacatcattaaaacggaagatactatatgcaacaagctgtggccaaccacatggcatgatcggatcaactgttcttctagatctaaaaccgacgtcacaacaattctcttcacagactcgtgtgatcaccatgcatttggcgatttttttttgtggccggagagaggagggcttgtcactgtcctgaagcagtttgcagctagctctcgtggttgtgaagttacagggtggttcagttttcaggttgagcatgtcagtctcgcacgaaattggagtagttccaagagagtttttcatagaaaataatttactgcctttcaaattttgcatcatttaagttttggattgttgtatggactgccttaggtattgcttgaggttcaagaggaaacgatttgaagctctaaacacaggtctgtagccaagactgaacacatttaaaacaatttcaaccagccgaattcatatctgagtacaagagaaacgtatatcgcgtctgtgtaaagtactgaagtgtggtgcctgcacattgtggtgcatgtgcatctttcatgtaatctgaaaagaaaaggtatagtggaagtccaaaataataatttaaaaaagaaaaggaatgcaaaattaacctaacaagaaagggtgcatcttgacaagcacgttccgaaatatttgtacaccaactaatgacatttagatcgaatctaacaaaaataagttataaaattgtatgatagccataaacatcacaattaacaaccagggtatggtgtgggggaaggacacgggtagaggattgttggccatgcttctgccccacgatccaaggtagtagtacaaaccttcatagttagacattatttggaacacatgaatctcgggggagaaaacattatgacgagttcagttcctgtaggagcagatcaagttcgtttaaacatactaaacatgccgacatctgtattaggccttaggaatacaaaccctatccccgcaaaacaatataagataaaccctattaatagaaaagaatacgcaaggtgagcatagctcaactggttaagttccttatgatggaaccaactcacctaagttcatatctagatttgacgcaggtattcatatttatagctatatgtgccggcccattcctttggagatgcacattaggggtagagcgtgcgtgcgttattcgttaatctcgagatatatgccagcccagttctttagagatgcacattaaggatagagtgtgcgttaataagggtgagtgtgcatgtgtttatagagagaaaaataccttgaggagaaatagaagaattggctggcacttatttttcaaaatacaattatgcaaatggcctggcctgaacctaaggaaaaaaaattgaaaatataccgtttaatttttttctctcaaaaatattcgggttataattttatttgcataaatataccgttgatattacgatctcgcacaataaaaacgcgagaccactcggtgtcgtgcagcaagttcgcgagagtgagcggtctcgcaaactcaaccagcgagagcgagctgtctcgcagactcaagtagcgataccgatccttgccgctattaattagtgattaattaattattaattaatttctaattaggataattaagcactaattattattaattaatcattctcgcacctctgccgcgtgacaccgcgcggtctcgcatcctcttcgtgcgagaccgcctgtatcgtcagcccacgtcagtttcacgcagcggtttagcgataccggtggtatatttgtgccaaaaagtttatatcaagactatttttgagaaaaaaaatatgaacggtatattttcaaatttaagtctgaacctaagcggctaagcccaatccaggccaagtggccaacccagtaatacctttgcggaataagttcactttgactcccttaaaagtgactcgaatctaatccatgaccctaaaccgcaaaaccggatatttcgaccccgaactattgaaaccggtgcaatttgactctctatgtggttttggagggcggtttcactgacatggtggtgttgacctagtctgtagggttgacgtggcgcttaggtggcatttgaattaaaaagtatccgtgggacctgtttgtcattcacacactaaaaaattgtggagcccactgacatgtgggccccacatgtcatcctctctctttcttcttcctcccctcttcctcccttctctctttccttctctctccccttccgccggccgcggggagcacgggctggagcggcggcaggagctgagctcgccaccgccacggaggtcggcgccagcaccgctggaggcgagatcgaccggacatgcaagtgcgtgagccctgggcctgggagcccgacgggattggaccgccacggagctccgctttggctgcggcccgggcgccctagccgaatgcttcatgccgcagctcgtcagtgtcatgcgtgcagccgccgagagggtcagcgtcatgactcgtgacccaccaataaaatcaaaaaaaaaagaaaatcagccatccagtgcaaattcaccacaaaagcacggtgaaaaccacctgttaattatgaaatctccaccgcgatgcaggagatgggaaagagcatgtctcggagttctctttatataggccggaggggaggaggtcgaccgcacggacggaaaacggcgccggcgacggtggagctccctgttgaagacaccggtttaagaaatcgattgggggcgatttagtgcgggattaagtgggatttgttgggaaaattgatgcccactacacaaggaatcgatttttgcaattaatttggaggagaaacgatagggcagggagatcaacggaggtggcagtacttgagtttcacgggagagatgaacagatgacggacagaggtagaagaagctcctggtgagctaggcccgcctgccagcacatggacagcgaatggaagagaaagagaggagggaggatgaggaggatgatttatgtgggccccacctgtcagtggtctcacccatacttttggtgaatgacaaatgggtcccacacatatttttttatttctaatgccacttaagcaccacatcaacgccatgtggaaatgagaccgagtcaacattgccacgtagacgccacatcagcgaaaccgccgagggagtcaaattacactggttttgagagttgggggggtcgagatatccggttttgtggtttagggtcacggattagatttcgatcacttttgagggtcagaaggtgaacttattcctacctttgcaaggtcagaaatggaccgtaattaacttccacaagcccataacataccttgtgccagcccagctcggcccatagctcaggtccacgacactatatactctttgccagagattttcccggtgtccagattcctgaatccaacataaacttctgatcttgcagcaaataaaacagatcattacagaatatgaaggccgggccactttttccccaggtctacagacgatatacataacatgaaacacaagcaagaaagtagccctatggcacaaaattgaaccaaatcatgaatgttggttacaagaagggggtaatgatataatatcatgtctgcaaaagaatacatcaatttcaaatttgcaacaactaagtacatgttggctgtacctccagtatcctttcctgtgtaaatgtggctccaagttgacacacgttatggtgttagtgtatactgctctagggaaaataatgttctttgccagaattctccccagaatgtgccgaaagaatttcctcccagtatctacaggcaactcagcaggcgctcgagatctgtatgtccttgatttttgttttgtgttactccgattcctcaccagtttcatttaccattctagctaggtcttggacaacttcagacattggtggcctgaattgtggttcctgctccattaggaaagtttcagattttacacatgatccctagtactcaaaacgctttgtgcaaagaatgtaaagcattggaacatgtgcatgcgtaatactagtatgcttgcaaatgcagttccagtacgaatgaagaaaatacacatcaattacccggatacacccgctgattatgtcagcaaatcgtgacagtgctttctcagaacattgcccttgtatagaagggtccaccatcctggacagtgattctatgtcatgaagctgagaattggcccatctaacaagatgttgctcagcacgtgggagtgaactgaaattttttttgaggataaaacaggcatgttaatcaaatagttctttcctcgtttcgcactaaaattttgatctaaaacaattacggacagctcttgaactcctgatcaaacatcatgagagaatgagactttaaatttttcttacctgtcgtatggtttacgcccagtaagaatttctagcatcactactccaaaactgtaaacatcaccttgttctgtaactatcccagattcccggaattccggtggttcatagttcaacagtgaatgcattcgatctgccaactggaacaagaacatacaagctgtaagtgcaccagctgtcatttccatcaacataacaagatgatttcttcactgcctagcaaaattaaattagctaaatctactcatttgtgatcaaacaacaaagcatggcatcaactagtctagcagcatagtaaaagtaattgccagtgaatcaaaatttaattatttccaaccaacgggtagagaagaattctctagtaaggtttatttaaggaaatttccaataagcttagtcacacctaaggacctgttggtacctcctcaaggactataaaatgtaaatcactctttacatgttctaaatttaaatgcttcagctatggcaacttcagcacttcaataaatacatggaacaacttatcacacatattgtatcttacctgagtgacagaacttgatgccaacaatttttctagtccacattcagcaacacgcactgaaaatttattatcaaggagtacattagccggttcaaagttctgatgcacaattggaggctggaagctttcatggagatacctacaggaaaggaagtacaaaggttgaaaaaatgaaagccatacatggattacattaaacatagaaccataattttactcactctaaggcctttcctgaaccaagagcaacctggaggcgagcattccatgacagtgtactatcaactccctctctatcatgaagtgcatcatctagtgtttttgtactaaagtgattgtacacaagtaaccgctgcccatattcagcacaatatccaactaactcatggatgttaggatgcctgatatccgagacaagctgaaccaggtctagaaattcatctactgatattcttccattagtattgtcaatcttcattacttccaaaaactacacagaatagcaggaatcatggttaatattttaactgcacactgaatataatgcatcacacttctcattaggataggtaatacttagtggttagcacacacctttccttcaggaaactctgctaggtatacctttcctagtctactctttcttatcaaattctcctctctgaaactgcttgtatattgctgaagagatgccacagagaatgaagtggcagaagttggtttatttatccttggtggagatatgtatctcttttctggaggaacaacaggattt

SEQ ID NO: 92646 - DNA, 3654 bp, Oryza sativa
aaataaagccctgtgcataccgatgcaactgatacaaatttaaggaagcatccgttgcatgcacaaatttactggaagtctgaattcataggatcgatgctcactgatcaatggacgggagaagccaagaggtttctgttcactgaatcactcctcaacgggacctgaatattcaactgcggtgcatatctttcttgagattccaaagcctgatatcgccgggatgcttgacaaattatacaggagaaagttatactccagacaacctgagctgtttcatgtgattaattagtatgatcggttgctgtttatgtcgtttgactggattccattggctactaatgaagtaacccatttatacttgttttttcatgtttctttggatatatactttccttctctaagttgaaaaaaaagagaagaaaactttgttctgataaacttataggaaattgatctatagctagttttgctgtgctgtaggagtcctcaaaagcatgaaccctcttcacttcgtcagaacagagaacttttcataacagcagctttggatggttcggactgattaaaggcggccttcatgtaagaatgcaagcatgcattatgtttaagttaagttaacccgactgaagactaattagtcggtaatttaacaattcagagccacagtattctagtccatcttgcatgttccatgcaacaaaggacatcccactagcagcaaaaaatacagaggtttcacatgtggggcaggccatggatctagctaccatttgacccttagacagttaactattgatcgaccaacactgttaggcagacaaagacaacattactcctaacaatcataagatactccccacatgtggatccactgttaaaccctttgctttggactcatcaatgcaagctacataacgcctttacacatcaataaacaatgctgtaattaactatctaccaagttactattactaccatccttcagagttctaaaaaatctgttcatgcagggattggattgaagcagccagctctttaaccaaagagtaccagagtgatcttgccatgcactgtggaaacatcatgtattactttaatttatcccagtgtaggatcgaagttactacagttacctttgcagctgtggcaaagatcaagcaaaaatgtgcagagcgataatgtgtgtttgaacaaagggaatcaactggtggaatctttagtaccgccaacccaacttgtcaaataacggctgaactcttcatactcaaggccctaacctttactttgatgccaaaacagttgcagaaaaaattaaaaaattgtaatcaaggggtgtctttcctttgcatttctctctagctaggatcctacttgatctcatttccctattcttcagctctggtagttcttcaggtcttcaagaaagcccatatcatatttcttttgcattttcctctagaaacctagaatcctatttttttccctactctttcttttttgccttcttcaagaacactatatcccaagaagcacatagtagagtatcgtgatcggaagcgcgatgagcatcccaaaaataaccctgaaaatttcacatttatatattttaggctatatacttcagcaaccgtatggacgaacaaatagaaagtttaagcatgcatttcttacgctgtgctaagtatttgaggatggcaattgtactccttggcaaacacaaacgggacaatgccttgtggaagtgctgcctgtttgacaatcaattaatctataagatcaccacaatacattccaattcaccataattacaaaatttaatattttttttcttttaagatgattgcaagaaataaagaatctactgcttacctgaacaatggcaacatgcaagagtactcccctgagcccaatggcaatggaagtagctgcaataacagctggaccagtcaagaacctcactgccattgcaaatgtcgcaacggtcttgccacaagaaatgatctttggttgcagagccatgaacaagcctgggttacatatactattgtcagaatttcttggtcaaagcaaagaaaaaactcactagttatggctatagatatgtatcaaaaaggtcaactctgtacctaagctgaacatagccattcctagccctgcatctgacaatattgatattgagccctttattattgaaggcatttggatattccacctgatccaaattcacaaagtcaataagcaattaagcatatattttcacaatgtaaaaaaaaattgtatgacaagagaatcaatgctagatgtatcatgcatgtatgcaattttagatgcttgcaggcatgtgctcctccccactaaaaatgccctgttcttgcaaccctccctctagatgtgccatctaatggtaagatagtagtacaatgaatcaatgatgcatccatatcattgtacattttttgctcttcttcttgtacacatgatggatcatctagctagttgagccgaattcgccgtgtctgtcttggatggggacaaacacggcaatcgcagctgattcggtagatttggtctctgctgctaaactccagggctcacataagacctgcacctgcacctgcatctgcatacgtgtgtatgttctttgcatgtgctggaccagatccgagaccaacgtaattatcatgtgctctcacatgcgttcagaaaacactaatccagttgtgaagttaagtaagttctcatcgatcttgcctcttcctagattaaaatttcaagcaatctagcaacgaatagcatagcaaaaatatatcctttttgtagcttcgaacaacataaattgatcagatcgtgaactcaagtgtatattacttatttggtttagattactatgcagattatcgatttcattatacaaataaattaaacaatttaaaaaaaaacttaacaactagcttaaaacaagtaatctaagtaatgtagtagaagaatatttttttttataaaatacttttttgaaatggagagtaaataatctgttttgataattcggtataacttgaaaaaaagcgcccttgccctgaagatgaaccgggataagcgatctgtcatagctgtgggatgtcaaaatgtattggcagaagagtgttccatcttagagggaagcgaccgggaaagcgggcgtcgatgaagtggaactgtggaagcgagaacgtcagcttgagtaccgaaaacatcggtgagaatccaatacctgaaggagacgagggaccagacgaggccgatgaggctggagtaggtgttggggtttctgatgagcttgcgccacaccatgatgaggatgagccgcgtcatcacgctcgtcggcggcatcgggtgcgccgcctccgccagcccgggcacgtcggcgccgccgcccttcttcctcggcgccacgtacggcgaccccgacaccgggaacttcgccgccagccccgccgccgggctcttcagcccgtcctcgatctccaactcgccgccgccgttcttcgccgccggcgtgacactgccactcacccctgtggcatgcacgcaccattagacgaagccttgaacacatgtggtgtgatcggcgtcgtgtgcgtcaatggatggatgagagagtacctttgggag

SEQ ID NO: 92647 - DNA, 3754 bp, Oryza sativa
gatgtgggtaaggttgacaaaatcattagacaactggaaggaaaatcactatcttacaagatgtttgcacgtgatacacaagcttcacgaagtgtgtaagtttataactattgtgtatttgtgtatttttcaagtacaaaagtggttctcttgctgttttatgataattaatcacctaggcctgacatatttgttcatctttgttggaatataacattattgttttccttgtaaatgaccatgtcactatttttatgctcgccatcaagttcaaccaaaaaaaaaaaaacttctgttgatgttttgttgttttgcagtggtccacctacagagtgtttcatgttccattctcgagctgcagtggccaaactacacactgctgatgaggtgatgctagtctaatacattgaacttttaaaccagaaaataacaatgtaacttttgctggtaatatactatgtcaggaatcaggttacttcccagtgcttccattctagtactgctaatctctacataaaagtaacagtattattttgtggtatcgcgtttgtaaccttaactttagttgctggacattggcatagcttgagtatggcattatgacgtgtatgcaattgtggattatatagttttgagttgctgatatcaaaactaaatatattatgtggactcataaaatttagcatcatggctatgcaatcgataactccctaatctgttttttttttcaattagcattctgcatgcacatatatcatttcaactggtaataccatgttccattccgttttcccaatttttgcagaattgtgaagaaggcaccaccagggccatatgcattgagctagtcgcaaacaggtttctgcgcaaggtattatacatcaagttgtttcatggcattgtaatttatccagtcgtcccccgaattctagttaatattagtaaatttcattgaacagatggttagggttcttgttgcgactgccataagggaggcagctgctggtgctgaagaagatgctttgctgaacctgatggaagccacttgcaggcgagctactgctcccccagcgcctccagatgggctctgtcttgttgatgttggatacgaggatttcaatagacaaaggtgtttcattgttgattaaacagaacagtcatattcctgttggagcagaacaagatatactgattcaacaatcgaaaatctgaatttttggattcccgagatgaaacttagatcattctggttgaacagtgaacctataagcagcactctcctgtaggaaatctgacctgcttcctagtttccatgtatccatcaactggaattttttgtattatctgagactgaaagagtgttgcttacaccattcgttcaactacggtcaaagtctctctgaactaaactctgaagaaagaagaggccgccgtgcatgctttttcaggttttcacactgtaagttttcttcaacatatttacattatcgaataatttatgatccgaaggtagaacaatcggtggaagttctactgcagatgtcgaatagaccaatgcatcttcctggaccaatatttgctgtcaaaacaacaatatcacgaccaaaatcaaggtacattccaccattttatatgaatgtgacatagaaatgggcatatatagctgtcaagttcagatgattttcagagaacaaaagcatatcaacttaaggcatatcccagcagcaacaacatcatctacaactattgctaatcacatatataattatccctaggccttgttcttgtcgtgcgataacttttttttgcatgatgtatgtgactatgttctatgtgtgtatatactataattcatgggccacgtactcgtgatttttctcttgaatcgtgggcgcgagttggcggcacgaaattctttaagacagcgcgtttgtcggtgggcgcatctcttgtgattaaccaaagcttttgtcgcgcatttcgcttccagaagtgaaaatgttgtgattaattcggcattaaaggtgtgcagatcgatgtgtcactggcaaaaatagtgaaaatggagagccaaacttgccgatgtgctttagaaaaaaaaaagaacaacttgccgatgtgctgctagatggacaaagagtaaacatcatacagctctgaactgagagagagggtcctctgaagtaccgtacgtatacgtacatacagtaccgctcgctgacacatgggtctcacagattcttagactgacatgtcagtaccgtacgtatacgtacatacagtaccgctcgctgacacatgggtctcacagattcttagactgacatgtcagttagcaatactgcacgtacagtactgcaaaggatctacatatagcatacaactacactaggcccttgtttagttccaaactttttttttcaaacttccaattcttctatcagcatccaaaactttcctacacacaaaaactttttaactttttcgttacatcgttctaatttcaaccaaacttttaactttggcgtgaactaaacacaccagaattgaggcttagactattgttcttctttaaccgttttgttaaactattatttggtatccccatgtatttggtatccccatgtaatgggttgagtcttatgtactcttgattgtggtttgggttgtgtacaccttctaaggtgtagaggccgggttaatataatccattatctaaaaaaaggaagacaacttggctggtaaaagaaaaatcagacaactttctcaacattcttggcagcctgcatggtttggttatgaaaattattgtataacccaagagattatcacgtttttaaaggtactttctttttaataaaaagtcatatatattttttttcgtcattgagctttgctggaggtctattgtcttcaccctaagtaaaaatagttatttttcgctccagacaattttaaatccaaataaatgctatcttcatttttaatatataatgccgttgattttttatatgtttgcaccatttcttttaattatatatgtttgcacaatatataattatcatttattttattgtgatttgattaccattaaaagttctttaaacattacttattattgtcatgtttgtacaaaatttagttaaacatatctctaaaagttaacgacatcatatattaaaaaataaagagaatatcactcaagtagggaaaaacaatagtagtgtggtgatttaagttgatgtataacttaagtcactaagatttacatcctatttagccataaatgttacatataagcagaaacaacggtttccaaatagtctttgaatttgtttggagaagcgttgtttccaaatagtctttgagtttgtttggagaagcttctagctgatacatcttttccaaatagtcatttttctgttcggattataaaaagctgtggttgtagaatttagaaaataaattagaagtaaggagctgagaaatccagctcccaaacaaaccctttgtcaatgtgcgagcaagcagccaaataagccattgccaaccgaaacaaagaaaaaacagaggtgatgaacaagaaaacgttgcagtctccagcggcgactcccacaccaaacgccagcttttcctcctcttcttctccctcggggtctaagcctaagcctaagcctcccgccaaataccaacacacacacacacacgcttcccgcgctattcttagctgctctctcccccacctcgcgatctc

SEQ ID NO: 92648 - DNA, 2926 bp, Oryza sativa
gacatggcgccgctcgccgcgctccgggggctccgcgccctcagcatcgccaacaacaacctcacggggccgttccccgacgtgtccatgctcccggcgctcaagatgctgtacatgtcgcggaacaagctcgacggcggcatcccgcccgccgcgttcgcgcacatgaggggcctccgcaagctcttcctctccgacaacgcgttcaccggcccgatcccgacctccatcacctcgcccaagctgctcgtcctgcagctctccaagaaccgcttcgacggccccctgccggacttcaaccagaaggagctgcgcctcgtcgacgtctccgacaacaacctctccggccccatcccgccgggcctccggcggttcgacgccaaatcgttccaaggtgagcaaattatggtgaatttatacattttttaattaaaaaatggtgaaattttgctacctgcctgttcatgcattcgtgcatgcacgaattcctagtgaattactggactagtacatgtttgatttgcaattaggacagaacatgcgatcaataaaaggatttagggagtaatggaattttgttgagatcatggtggtgttcttttctcctgaagatgaagattaatttttttacgtaaaacgaggtggtattaacgtatgattaattaatttttaattattataaatttgaaaaatagattgatatgatattttagagcaactttcatataaaaagttttcgcaccaaacataccgtttacctgtttgaaaaacataccacgaaaattcaaaatttcacccaactttcatatgttgctgttttacacatttgtctagtcaattaaggatttctttaagcaaatccagattgatgtctcactgtctcagaatccaagaataaaatgggctgcaagaactatgtaaatacaaaataaaacaaagtactattcctaccaactactgtaagtggctctttcgaggttgtacagtacgtcatgaccaattaagaaacacttacatgaagatgttaaactcagaagtcaacatccaacatgatcaaacgtgctaattaaactaaccacataaaagtattagattagtgcactgtaatataatactatccttttgctagtgtacaccaaattgcagtattcctgaatgcattgcaatattctacctttataattcttcttttttggaagaacaaaaactatagagcatatttatcaagcacatcgattcaatcaaaaatccaaacccttgattggtcgcactgtttgggctacttgtgaacgcatgatttcataggattttcgcacgaattagttcaattcctccaaaaatccaacaaaaacggattatacaacataccatgataccactgttgttctaaaataagtttatttttcacccttcccatacatatatgatatatataccaatataaaaacaaaagattaaaatactgtcactttataaaatatccatgcaactgtcccatactatctctactacaattcatttgtcttttacttttacaaaccacatcaattcgtactgcttgggtactttggaaaacacgaatttagttcaatttctccaaaataaagtcctctaaaattagtttatttttttgctcatgcaccatctgatccaaacctctccccatggaaatattcaggaaacaaaaatctctgcggcccgccggtcggcgccccgtgccccgaagtgccaatcctcgcgtcaccttcgccatcgccgctgtcgtcgtcgtggtggtcgcctcgcagcttgaagatcctcatgatcatcgccctcgtggtggtcgtcgtcggcgcgctcctggcattcgccggcgcgttgacggcgatgctcgcccgacgccgcgaggccaccaccgaaacccagggcggcggcgtcggcggcgccgccgccaacgccgccggcgccaggatgaaggccacgcccaatccggccgtcaccgtcgcacacggcggcggcggcggtggcggcgagcagcagccgcacgtgacggtgtcggccgtgccggcgaagcgcggcgggcggcgggacgaccacggacggctggtgttcatccaggagaggagggagaggttccagctggaggacctgctccgggcgtcggcagaggtgctcggcagcggcagcttcggcgcgtcgtacaaggcgacgctggtggaaggccagtccatggtggtaagcggttcaaggagatgaacgggtcgggaggcaggacttcaacgagcacatgcggcggctcggccgcctcgtccaccccaacccctccccgtcgtcgcctacctctacaagaaggacgagaagctgttcgtcaccgagtacatggtcaatggcagcttggctcacctcctccatggaggtaattaaccacacaatccttcccatcttgacacaacctgcattgcatttatttgatttatgttaatgtcgccggcgacgcgtgatcggtggcgtacgtgcagggtcgagcatggcggcgctggactggccgcggcggctcaagatcatcaagggcgtgacgcgcgggctggcgcacctgtacgacgagctgccgatgctcaccgtgccgcacggacacctcaagtcgtcgaacgtcctcctcgacgctgcgttcgagcccatcctcagcgactacgccctcgttcccgtcatgacgccgcgccacgccgcgcaggtgaggcgatcgaacgacggcggcggcgacgaacgcccgcggcgtataggccggcacgcattgactggggatggttcgtgtttgcaggtgatggtggcgtacagtcgccggagtgcggggagacggggaggccgagcaagaagagcgacgtgtggagcctgcggatcctgatactggaggtgctcaccagcaagttcccggcgaactaccaccggc

SEQ ID NO: 92649 - DNA, 1130 bp, Oryza sativa
tgcaactcttagtattgtgcaggtaaggaaactgctagattaatccaacctttgaattaaattttcaaacctttctaactgcatgttcattgtttgataatcttaactcctctcaattgcaggtcttttggggattggataagaagctggctcaaagaaagcatttcccatctgtcaattggctcatctcttactcaaaatactcaaaggttattcctaacttccctatgatgtcaatacaattaaaatcgccattttacactaacatactatatcctgtactgtaggctctggaatccttctatgagaagtttgatcaagatttcattgatattagaacaaaaagctcgtgaagtgttacagagagaggacgatctaaatgaaattgtccaggtattttttttcaccttgtgcaaggatgatctgttccctagatttagtcgtagaagcaatagtttgaacttggaccacttaaacatggtgtttttgttttccaaggtcctcctttttggtctttcacaatatttgttttcttcattagatttggagtttctcaaactattcaatttgtattttattgatatatagttgacccttcttgctttgtgtaatattattggggcaccatttggcctaatatcttcaccaaatttcaggcttgttggtaaagatgcactggcagaatctgataagattacattggaaacagccaagctactaagggaagattacttggcacagaatgcatttaccccgtgagtcataccctagttttttctgatttaatacagatttattggttgtctctattttaatgattaaccattttctttagtctgatcatctctatataatgaaacagatatgacaagttctgtccattctacaagtctgtttggatgatgcgcaacattattcatttcaatacattagcaaatcaggtaaatctaacgtgtttttaccactcctttcgtccttgaaccttaaattactcaagcaactttgatttgaaatttgaagtatgaacctgtgaagaatgttttctatagcattagtaagattgatcttgttttgaagttttttattgctaatgacaattttactttaaccaatgtggattgaaatattgt

SEQ ID NO: 92650 - DNA, 801 bp, Oryza sativa
cacaagataatttggaggacgaattgactcccgtatcctgcacagcaacataggtcctagggttcctgatcttcagaatgttaagcatctgtgacagagtgtcgtatgcttcctcaaatgtcccatatcttttctccatggccttttgtttcgccctccaagccttgtggtaactaattgtgtattgttcacctttctccaccagttttattatgtgccgcacaggcaggtcatcaccttcaataatttccttgtagtacttgttcgcaacgtatgccgcggtcaggttgcggtgcgactccctagtgttccgaatcagacaggagtgttcctgcagtttggacagaatccagtaagactcgtactttggcacgtgaccatgaagacggaagacgaccgtgtactcagtcttgttagacttcacaaccctgaactgcctttgcgtcttgaatgaccatgacttcactgcgtcttgcaaccccgttttgtcacggaacattgcacccagattgatttggccatccccgtagaaccatattgaatcatgacaagagttttctgcaatataaccagggtcttcaaggttccacgaagcaggcataggaacttcctcaacttcttgttcatcctcgtcatcattctcttcagcagcgaggttttcctcatcttcgattgcatgtcggtccaccctctcaatttcttcaactatagcaggtatgtcctccccttcatcggcttcaccagtaggatggcggttgaccacttcatctccttgtatggatagattttgaatgtcaggac

SEQ ID NO: 92651 - DNA, 1786 bp, Oryza sativa
tccccagatgagctgcaacttgggatttcgaggcttcttctggttagatgctcctccctgaggaatcacaacttgctccaagcctttgcgcacaaggtgttcaaccaggagttcctcgctgcaggtttccttatgagcatagacctggagatacaccacaaattactgacctggagatacaccacaaattactgccttaaacctcctcctgaattcagaattccaagtctccaaggcccaaaattcccacatcgaaatctactagaattcgtcgcgggcacgattaggcggatgaactcaccgtatgtgcagtgacagcctttgcaattgaagggaggatgtcttcaggtttcccatggcggatgagcaggtcgagaccttgtttcgtcaggttgcgcttcaaatcctccaagcactctatcaggaattgcgccctcaatgctgaaagaaacgaatcaaatcaacgcgtttccctcatgaacccaacgaacatgcagccaaaatcacaccaaaacataaaagtaatctgcacgaagcaaactgaatttcagtcagagattgacgcccaattctttcacctccagtcttggggaaaccgaagtagtgggtgctccccgcggagatccggggatcgacgcagtagacggggaggacggcatcggaggcggcccacgcgcgcaccaccgcctcgttgtcgagcacccggaggtcgttcctgaaccacacgatggcaaccccgccgccgccgctccgccgcatgctcggcgaggtgtacctcaagaacgcctcgtccgccgccgcgccggcctcgtcggcggagagggaaggcaccgccgccgccgccagcgcgccccgcgacgacgacgacgacgaggagctcatggcggagaccgggatggataggaggacgcgcagcctcgcggattgcctcgggaggaggaggaattggggattgagaggggaggaagaggagaggaagtggagcatttttgagatgggaggttggtttgcgagacgtggcgggagggagggaaaggtggagggaagagtggggaggggtgccacgtggagggatgtgagtggtgctacgtggctcgctcgtgggcctgaggaaacgggtttaaatggattttgtgggcccgtgaggggtggacccaattacccaaaggtcgatgtacagtattttggaatggataaaggatagtagagatatatttatttacgcaggaaattggaagaaatttcactaggatatttgatacatttgaaaaagacgataaaataaataaagttgagcaaataggatcaaattggtagttaaaatttcaaatagggtctaagggcaccagctgtctgctaacatgatatagtactcctttttaatgagaggatatggatatactacatctcaaaaaaggttcatttgttcaaaatttatcttacagagactatatttttagctagcatgatgaggtttatctcattaattccatacctgtcccaagccagtacccttctctcattgacttgttgaggctgtttggtagccagtctttgcggctgcagcaactgccgtgcatgtggcactgtttctaaggctgttatacctaacctattttaattagagatcctgacatttcttaatattactaatcttaataagaattgctagaagtgtactcattttcggacaaagggagtataaatatagagcttagatattcatttgagtgcgtattacagagcggagagcgcattcactgggtgtgtgtagcaagtttcccaa

SEQ ID NO: 92652 - DNA, 768 bp, Oryza sativa
cggccctcgcgaccatgtcttcagccatcttgacctgggatcgaagccaagaattggtaagtttggagagatgccggaagccgatcatcagaaacaattaactatttaccactcttacgagtgacaatttgcaattggactcacatgtcatagacacataaagtgataaagacccatatgttgtcatagactatgggtggtaaattcttaattacctcatcttaaaagtggcgaaaagttaaatgcgccgataattggtggctgaaggagagtttggtttctaattaccttgactcttaaggcctctacatccgatttgaggatcctgttgtccgtgaccgctgtattgaactgctggctggactctgtgagctgcttgaagagggatgagttttcgcctttgagttgctcgacctgatcatagatggattgctgtaagatcacactgatatttgcatcaacgcatctggaaatttgaactttgaagtttataatacctgtgattcgagttcagataactgtgcctgctttctcctcctggatcgtcgagcggactccctgttggacaccatcctgaaattcgaacaagcagttcataagaatgcgttctctgttcaaatttgttgcatttgctagaaatcaagattgatcgatcactatgtaccttcttattcgctttgtttctgtggatttcgtgccacgcaggcgtggactcctctctgcttctaacagcgaatcgcaatcggagtccgagtcgctttcaggcgc

SEQ ID NO: 92653 - DNA, 2448 bp, Oryza sativa
ccctgttacagaagtatcaatggcaggtgaaactctccaagtgttcatttgctcagcaacaacttacctatctagggcatattatcagtgctgctggggttgctactgagccaattaaaattcaggaagttgttaattgggttactccagccaatcaaaagaagttgaggggattcctgggcttagctggctactacaggaagtttgtccaaggatttggtatcatcagtaaaccattgacaaatcttctgaggaaaggggttccttacaaatggactcaggaaacagaattagccttccaacagctcaaacaagctctagtttcagcaccagtcctagcactacctggctttagcaaaccatttacagtagaaacaaatgcttcagattcagggattggtgcagttttgtcacaagacaaacatccaatagcttttgttagtaaggcacttggtcctagaacaaaaggtttgtcaacctatgaaaaggaatgtatggctatacttttagctgttgaccattggaggtcctacttacaattgggagagttcataattctcactgatcatcacagccttatgcacctatcagacaagaggctacataccccttggcagcataaagcttttactaagcttttgggactcaactatataatctgttatagaaaggggacaagcaatgctgcagcagatgcactgtcaaggaagttccaaggagatgcagaattgtctattatatccaactgcactccaagttggttactggatgtggttaaggggtatgaacaagattcccacgctaccgaattactgacagctttggctctgcaagctgactctaaaccaggttaccaactgcaatctggtgttatcaaatacaaggggaggatatggataggtaataatgctcagctacaatggaaactgttaactgaatttcatgccagcccacttggtggtcactctggtttcccagtcacatatagcagactcaagaaattatttgcctggccaggaatgaaatctcaagctaagaaatttgttcagcagtgtcaaatttgtattcaagctaagccagatagagctaaatacccaggacttctccaacccctgcttgttcctgatggatcatgggaagttatatccatggattttatagaaggtttgcccaggtctaagtcctttaactgcatcctggtaattgtggataagttctctaaatatggccatttcattcctcttgcacatccttacactgctctggaagttgcaaaactctttatgctgcatatttacaaactgcatgggcttcctttggtgattatctcggatagggacaagatttttactagtcaactctggaaccacctgtttacatcttctggtacacaattgcatttgagtacatcttatcacccatagtcagatggtcaaactgaaagggttaaccaatgtcttgaaatctatttgtgttgttttgtccatgcaaatccctccaaatgggccacttggttacatttagctgagtattggtacaacacctcttaccactcttccgtgaaggcatctccgtttgaagtcttatatggtcatgctcctcgtcactttggtatttctgtggaagcatgtgcaatcccagatctgcaggaatggctcaaggaaagaaagttgatgcaagccttagtgcagcaacatctgaatagagctaatcaacaaatgaaacacatggcagacaagaaaaggagtttcaggtcgtttgctgaaggtgattgggtatatctcaagctccaaccatatgtgcaatcttctgtagccactagagctaaccacaagctttccttcaagtattttgggcctttccaggttctgcagaagattggtatagtagcttacaaattacagcttcctgagactagtaatgttcacccagtgttccatgtgtcccagcttaaggcagcttgtggttttcaaggagacatccagtctactttgccttcagctctttctgaccttcaagtgccactccaaattcttgataccagggtgatcaataaaggtaattcagctgtatctcaggtgctaattcattggtctggtacttgatcagaagatgccccctagagatttggaggaactccgtgctcgttttcagcgactttccaaattccaaggggaggggattgtcaaggatcaggcggtacctgacgatgttccattgactaaagttggggagcaaaactctgacgaagctgaagatcgtcaagttggagctgtgcagtcaaagggaggcaatatgcgtcgtactacaaggcctgttaagcaaaacccccaagtactgtgggcctaactggaccatgtaatagaagtccatattgtaataggctagcgtgaacaaggggaaagaagagagagataggagatatatatatatatatatatatatata

SEQ ID NO: 92654 - DNA, 1002 bp, Oryza sativa
acactggaactcatcaccaatgtcgccatatctgaggtggagatcaaggagaagggtggcagcgactggagggggctcaaggagtcatcggctaacacctggaaaatcaaaagtgatgcaccgctcaagggccccttatccgtccgcttccttgtcaagaacggtggctatcgcatcgtcgacgatgtaatccccgaaacctttaaggccggctccgtctacaagagtggcatccaggtccagtaatggacatgcatgtccttgcattaggtcacatggaaattattagcctctaaataattatctattcaaaagagagaccgagtctgcatgtgaacacgtcaatagttaaatttctattgttattttgtgacaacagactattgacaaaatgaagcataccatgtgcccttcccacatattggtatggagctatatgtgcacacgattttgaatatattgtttatgtaggatttatgggaaaaggtatatttggccatcattcatcgagatggttgtgtacatttgattttccatagttctaatatatatggttgtgcactaaactacaccttggatgcgcaccccaccccctctcccctcccgcaccttttctgttcccacatcttcttcccgcaccttcctaccatatatcttccagcttttgttaataaataaattactctaaactagtctttgttaagtaaataaattacttataagcaattgatcttgccataaaatctgcatttgcgtccctttcaaccttcattcagtaaataaattactcctaactagtctttagtcagtacataaataacttaaaaacatattggtcttaccacaaaattttcattggcatcccaacctttcttatcacttggcaaactatctgcattggcatcccatcatttctcatcactcggcaaaatatcttctcattatgcatcgttagtaaatattttactatcagagattaatatcattagtaattcttttact

SEQ ID NO: 92655 - DNA, 1316 bp, Oryza sativa
tgttgatgaaaatttccatgtaacaagtgatgacaaagtaagtacaacaattctttgtcagtaatagcaactgaacaacatcacattaattacgcatgttaaatgctgttcatttacttcatcttggattatcatgttacatatataagtgcccttggttgccaattttaccatggactcattgatttcattgctcatataatgcatgaaatgtgaaactggaacagctagaaagactgacttgcttttttttcgccttccttttgtagaaacttatgacacagaagccatgcttatggaatggatcgaagagaccatgctatctttttgctaggaagttctaccctgaaactcttgacaacctactgaagctattcaccagctatacatctgtttgagctccatcaaattctttgtccttggcatatggtctcaaaatcccatgggcttttttttgctgtttctgtaaattgcaaaatcaatacctagactcttacacatggatctggacctagagactacaagactacacacgcagatcgtcatcgcagcaactgtgacggcttggagttcttagtcactgggaagggctgtggcgaaatttgtagcaatgacactgccctcactgtaatttattgtgctctctgtaatttttccattgatggttcttagtccattgactccattcctgttgaagaacagataattttccattttgtcataccattattatatgatccattttttatatagtcagataacaagagaagtacctcatcctatttttgccatgatgtgcatcttttgttgattttgtttgccctctttccgaaattaacaatatgttaatatgctcaaatgaaaccattttttcaagattacatggacggcgcacaccactacacaacagggtttaccttaccgccggtaaccgcgcggttaccgggcttaccgcgggggtacgtaccggcggttaccgggcttaccgcaaggagtacggtaatataaatactgcggtaacctccttaaattcaaataaatttaaaaaataatttaaaattttaataaattttgtacggttttgtacggtggtttgggaaacttgctacacacaccccgtgaatgcgctctccgctctgtaatacgcactcaaatgaattatctaagctctatatttatactccctttgtccgaaaatgagtacacttctagcaattcttattaagattagtaatattaagaaatgtcaggatctctaattaaaataggttaggtataacagccttagaaacagtgccacatgcacggcagttgct

SEQ ID NO: 92656 - DNA, 594 bp, Oryza sativa
atgttggagctatacatgtcctaaaatcacattctttgctttcgtggtggtttcatgccttgtacacacccaaccatcttgttgctaccttcccatcctgtaaaaatataatgatcaagatcatgattagtcatgaacatctgtctttgtgaacatccacttcttttttcttccctgtttttgtgttctttcagtaagaattgggagggagcaagaagacctttggacatgttgaagccgcgtttttcgagctccttgtattcttggcatagcgcacaactatcgcagaagaagtggacgcagcagtccaagcagggcgactgttgcaagttgtactgtgcccgcattgaggatcgtttggtacaagcatacagccattggcagcctattgtcgccagcaaaacatacaaggtcccgtgcatgcagcacgctggaaacagggagagtcagcatacaagattgatggttttctgtgcttgaaccaaagcgcgaagtgataagttaatatgcctacatgttgagcctttgtccacaatctcagcaatgcgaccgaacgtaatgcaggggcaccagcaagtcaagcagcctgtgtag

SEQ ID NO: 92657 - DNA, 1801 bp, Oryza sativa
  unsure (1)..(1801): unsure at all n locations
ggctacagatatgtagcttgctgctcttctctcttatcttttatctcattaaaatatgtttgtagctggctaatagtctgctattgtacctgctcttaggattgacccagtctgggcctcttgggtccatataggaaggataagttcactctaggtccctcattttgtcgtcgagcctggaatttgtccttaatcgaaataccagatataatggatcccttaatttataaaatctgatcatccgatatcgtagacagtatcatgctcggcttttagctgacgtggcaagccgagtcaacgtgggacccatgcggggcccacatgtcagtggctaacactctcttctcccctctcttccctttcccctctcttctctctctcccctttgccctgtaaggtgacaactgtcgggaaggacggcatcacgagtggcggggaaaaggggcggcgcccaacggtcaacgggagaggagaaggacgtcactcgatagagagaaagatggcatggagaagtgtgtggtggcttgcggccttctctctggtgcctctacccgccgccctctccatcttgactccatccgcgtccccgtcagccgttgagcaaggtcattgtcgatgtcgggtctgtcggtagcacacttagctgcttgagctacgcacaccgagcttcttgacctccaccttgagcaacttgaggtacctgacggccttgtggaggacggtgggcgcgtccatcttgctgccgccaggatgatccccttgagtgtncgcataatattcttcatctgctccttcttcctttcatcacctccggcgccggccctaagcttccgaccaccactgtagtcagacctcgacgcgtagatgctcaccccgtacctggacaagcacgtggagtccacgaagcccccagctcggcaccctggcatgcgggccgtgctcagcatggcctctactccgtgctaatcagcgcgtctttcttgtccgtgatcagcatggactgtaactctatatagttggcttagactccactgctatttctttctggctctttgagacgtccctctcaggcattcggtgaacaccctccacgcgtaccatatggccccgaacctgacgagcgtgctcagcatggtgttcctgaggcagagaaccaagctcgggtgctcggcatccacatgcgcacaccctgcatcccaccgtcgaccgcgcggtgccattcgcggagccggaacagcgcgacgtaggcatcctcgtcgggcggctccgaggaggactcgaggagccagagcgcgcctgcgccagctggccatggctacagagcacccgcagtgtggtgctcctgtcgaagtaggtggcctccgcagaagcggtggctgtggcgatgcgctggcgaggttggaggagaatgtcatggtgaggttgttctcccagagatacgttccgagatcaacctttccgctgtgttcgtccatcagcttccgcacggtttccttctcctcgccggtgagctccagattgccagtacagctcctggacagtggttttccctaccgtatatacttggcacggccatgatgccgtccatggttttcccactgttaccgctccaacgcccaccctatcgcccattgccacaccactccggctgattgccagcgtcgcacaggcagctgcagtcgaaagggaagagaaagggcagagaaagagagagggagggagggaggaggaagaagtatatatggccaaaaggcccgaggcccgacggcccggcccatggcacggtattttggcccggccc

SEQ ID NO: 92658 - DNA, 1361 bp, Oryza sativa
ttctcttagattttcatagttttcttttggtgttcgctagatgtggcgaaccattgtatattcggcaatctgccgcaaacccttttattgtaaccgaaacaggtggccgttgggcgtttttaaaatttgtataacagacctacttttcgccatttactgtcggtccaagtctttgacatattattatttcgctcatttcgcattatgccatacctcccccttcttccgcctattcctaccatgtaagctgtgttttgcttttttctgcactgtctatgtcacatcctgattttcgtttcaggatttataaattatttaataaattattaatagaatttatattaaatgttctttaatttacaagtgaagttaaatgtgggaaataaaatttcctaaatctaaagcatggatggatttaatttttattaaattctccatgattaattatactctctgaaattttctcgaatttttcggagctcaattcctaaatgatacaaagaacagttcagtaattatttgatcaataatgatctaattataattattaagagcttttcttgtttaagaatccttaaattataaattgttgtttaaaaggaattattagaaatgattttaaaagcctaaaagagaagatctaattttaatttgttaaatctcaatataaaattgggctaaataaaattttgttaaatactgtgcttaattctataattcctagatttttctgggatttatttgagctaaggaagtatttttaataaatggaattgcatttcatgaataatttaaattgaaaaaggttttaaaagtcttcttttggctttgggccgaaagccggcccaaaaccgctctctctctcctcctcggcccagtccggcccagtctgccgagccgccgctctcctctctctctcgctgtcgctgacaggtggggcccgcctgtcggacccgtcgtcttcctcgcgtcggccgccgcccgaaaccctagccgagccacgccgccgccgctttccaaattcggtcgatcctttccttctccggccgaattgattgaggggaaacaatctccgggatctcctccaccttttcccttttggaatcatcctctacttcggtttggaaatcgatggattcgagtttgttttggattcgttcttcccgaagtttccttcgccgtcgccggtcgccgtgggccttcgccgccgccttccaacccctatataaggatccccgagctctcctctacccgtcgcctcctttgccttagcctgccgtcgcgtctagcgccgcctccgcgtagcctagtcgccgccgtcgttgccgtcggttcagccgcgtcgcgccgccgttgcagcc

SEQ ID NO: 92659 - DNA, 2174 bp, Oryza sativa
tatcagaacatttatatattgcatcactttgttacttatttttccttttcatttcctaacagaaccgccgatagagaaaaccttgcgggcttccattgctgagatatctgttgttcttttgttcagtgatgaaatggatgctggcaattccagtgttcctatcagtcaattcaatgacatgagaaattctgaaatgttttcaagctgcctttcctttgcacattttgagcaatcaatgatatctcctgctcctgctgccagcttgaatatgcatcacgttgaagccaagtgtcagaacattcatctttccctggaggtatggtctgcttccaccaatagcactttttcgtagtttatatctcctaattttatgaagcttgattctaatgttatgttcttgatgtttgcagacatatcctgaaaacctaagtctcaagggatcaattgctgctataaagcttgatgaatactatggcagtaagaacaatgattcagatcatccaaatcttggtgctgctttcttgaacaataatttttgcagagaagttcaagcttctctccctcaatctgtatttgcttatcaagattaccatgaggaaacatcacgccgtcataccaacaattcaaatgacctcactaaggtcgaattgctaaacacgtttggtgagtgcgtattccactatgatgtcagttcctcaggtcaagatggcaacccagtaagctcaacttcactatcagtctgtttggctcctttggtttgctgggtgcactttcacacaatatatatgctactgaattttatcagtaaaatcgagtctgatgttttgcatggggaggataaaattcataggaagaatgacgaaaaaaatgtcaatttgtctatgaagtcaaatgtttctttgggaggaagccaaaaggttcagatagccctgtcgcctgcaagagtcatcttttgctttccttctgaatcatgggatttgagctgcccatccatgctggataagttccttgtcattgaccacacaccatctctgaaatcaggagcagattcatctccacatcaaaatgaaatgcctaatgatgtcaatgcaatcacaccatctactttggtccatttggctacagggaactttgacatctatttggttagaccagttaatgatgaactgaatgctagaacctgttctctgagtaggcaaactttctcttctctgaagattttctctgttaccggatccaattgtcatgaaactggcattacgatgctctggaagaagtatcctttaaaagaccctgagatggtgagcaaaacttggagtttgccaaacctgcatgagcaaaagattgctcagaacaaaaatggtaaatgggttggtgtttcctcttctacaacctcagaagatcttgaggaatcaagttccagtatacgcagggagctcctccggagcacagagtttttgttgcacattaaactttcttgtgtctcagttcatctcagtaagaaggactgtgggatactaaaccatttgctaaaaaacatccttgatggtctttcagatggagcaactggaaattttgaaaatgacagtgacaattgtatgccaatccatgatactgctagccaaacatctgtcatttttgaatgcagcatcttggatatctgcactgaattggatgaaactgttgaagttggtcctttattgcagactgaactagaaggttcctggaactgtctcaaattgtcaatttcaaaattttctctgctatcctcttctaatgttggcggggttaacaatgccaattttctttgggtcaatcatggtgaaggtgagctctggggctctattactggtacggatgactatgaagaaagcaaagatgttcttctagttgtttgcaaggattcggcaagtagacgaggtgatggtgaaggtagcaatatcttgtcttttggaactgcgggctgttctgtgactcatatcatgaacccaaagtttcagaagaattatacttctatcaatgttcgttctgcaacagccgttgcacctggtggccgcatggattggataagcgcgatttgcctattgtttagttcagcttcagatggaactgaacaaccagctaatagtagcacaatgaacgattcccagggtggtgaacctttttcatcactg

SEQ ID NO: 92660 - DNA, 4172 bp, Oryza sativa
tacttgggcaaaactaagtattgcttaagcttgtaacttgagcatacccccgaaggggtcttagtgcatcagtcaatctacacacagaaagtgttagaatgatttggctttgaaaagacatatctttctaaaacccctatggtcggaaggtcactccaagtagaccaagatccgtatagaccaagagaagaagggaaggaagtcattggattagaatatccgtacttgagtgcaataggagtgctcatgtaccttgcaaattgcacaagaccggatatagcatttgtcgtcaacttacatgcaaggtacaacacagagcccaccaagaggcattggaagggcatcaaggacatcctccattatcttcaagaaagtaaggacatgaaattgttctacagaaagaaccaggacctcaccttggtaggatatgcagatgctgggtactctctccgtcccaaaataagtgcaaccataagtttcaatgtccaattttaattatccgtctgatttcaaatttttttttgaaaaaaaataaaaaacataagtcacgtataaagtactattcatgttttataatctaacaacgataaaaatactaattataaaaaaaattcaaataagacagatgaccaaagttggacacggaaactcatggctgcacttattttggaatggaggaagtacctatcgaacccacacacagccaagttgcaaactagttatgttttcctatatggaggaacaaaaatttcctagaaatcgtcaaagcaaaatctagtagcaacttcgatgaaccacttgaaaatcatcgcactatacgaaacctctcatgaatatgcatggtttcgtcgaatgattcaccacatttagcaatcatgtgaattgaacaccatccagactcctataattatctatgaagataatgcagcatgtgtcgcacaaggacaaatgggttacgtgaaaagcaatctcaccaagcatatataccccaagttttttttatgctcatgaactgcataagacgaacgaaattaaagtattgcatacaagtcatgtgaaaatatcgtagatttattcactaagtcattaccaacatccccttttgaaaggtgcatctgagggatcgggatgttgaaacttagagaaatgtaaaattcaggaggagaatttcactgactcacttgccaaacttagtccagaatgacaaagtacctaataagaataattggaggggttgtactctttttcccttagataatttttcccgcatttctttatcaaagtttttaatgaggcaacccgtgccacacaaaccgtatgttatgtactttttctctattttttttccactggctcaataaggagctttatgaggcataagcaatacatggtgacggctcaggagagtgttgaaaaacttggccaatgaacgcccaatacactaatcaggcctcaccctactttacatgtataagaattggctatataaagaaaaaagaggagaggctttatgtaccatgtataagaattggctataaagaaagaagaggagaggctttatgtaccatgtataagaattggctatataaaggaaggagaggagaggttttgtggacagttgaaagaatgtgaatgacaatactgtaccccttctcatatctcgtatctccaattttctgtagattacataaccctcaataactacttcaggtagcagaagcgttgcgtaataatttggacttccatcagttactacaaaagatcatctccagacacgcacacgcgaaacaagcgcttatatctcattgcagcagcacaaaacctgatgatatttacacttgtagagtgagagttacagtgagcagtttctcaaaccaacaaaaacgtaaatggaaaaccgagaaacaagagagatatttacatttgcactactcagtaatcaccaccaaatttatgtacaagagccaccgagccaagctccctgtgaccctctctctctagccaaatcctaagcaaggagtcaacaaaacttccacccgctccgggtggccacgtttgtgattacaaccgtgatcgtgtgctagtaatttacagtatgaaggttttcgacgtggcatctgaaactgtacacctgcagaggagatggattatgaactccaacaagaacatcggagatggcactgattcacaaatggttggattgctagtgtggaaatctgacttatcctgtacaagtttgcccaccaccctttgatgagattgcacacatgtgctcttgaaccagttcttccaggtaaatacgagatctcgcaaaagaatgaacagaccacctcttctcaatggaagtctacaattgaggaggcccgtggtatttgtacatagattctttcttgcgttcaggatcaaggctgtgaatgtagaagaaaagaaaatattagcaaaccaacattagcagtctgtggtcatgccaaaaatgaagtatgctcaagagttgtaacattcgcataggacaaatatgtattttcaccgatgctgatcggaagagaactcaattccactaatattataaatcaaaccaagatcacaattagatttttctgtagattgttccatagttacctagtcagttgcctagcctaattcatgcacattattatttttgcaattcgtaagagcctagttaaaaatcattggttacaagttctcccagttaagtgagctggggtcaatgtagggaatgccaagccccttttgaccctcataagtcctcggtgtaaataaactgtttttgctcaaacacatattttacccagagtaacaaatagttttatcagtgcacagactgataatatttaggacgataaatcaactatattctcattcttttgcatagatatacatttttcatttggggcaagtcagttacagttatttagctacgaagttttattgattaatcctaagctgtccagatccatgaactttgttaccttccgttgctaacttcttccagttccaacagaagacaaaaatatactaatacagtaaattgcaagtcaatatatttctattttcaaatctttttaatatctatttgtattactccctccaatctcaaatagaaaactattcagaatttgtgcaatcagaccttgagatcttgctcaccattatatgggggaaaaaagagagaggagattttatttttttatttttattttataaatactacctccgtttcatcatattataagtcgttttgattttttttcctagtcaaacttcttaaagtttaaccaagtttatagaaaattttagcaacaactacaacacacaattagtttcattaaaactaacatttaatatattttgataatatgtttattatggattgaaaatatttctatcttttttataaacttaaaaagtttgacttaaaaaaaagtcaaaacgacttataatatgaatcggaggaagtatatgattacaaaatgtaataactccattttttaatagatgacgtccttgacatttggaataacgtttgaccatttgttttattaaaaaaaatagtgtaaatatgctaaagtataaatcatactttcatgataaaacatgtcacaacaagataaatgatatttatataaattttttgaataggacaaatggtccaaagtcaacggtgtcatctgttaaaaaacaaagggagcattatctaacatgtgcatggagactttgctgatatatcataaataaacaagtaaaaaaagaaaacaagttagattagaaaatacaaatttttatgccatgttttgagtctagctgatggtctcatgtcacatgtgaaatgtgatcagaaaaacttagtcctattgcatcgagtaaatgataacagaacagaccgaggagtcaacagtgagttgggaatggtctggactgatttaagaattcaaaataaccgtagagcttcacaatgtttgctgatttgaaggttggaggtgaatggaatcacctattccttataccaagaagtgtataatgtgcagcacgaaaagacgctgattatggagccactgcagcacctggagctccacagattgcagtaaccaaagctgatccggcaccagccccacgattataaactttaataggatttccaatcaaagcagagg

SEQ ID NO: 92661 - DNA, 3298 bp, Oryza sativa
aagatggagcagttttatgaaggattggatggtccacctctccgagtccttccaataggtggccttggagaaatcggcatgaattgcatgctcgtagggaactatgaccgttacatattgatagatgcaggggtcatgtttccagagtatgtattctgtttctgttgcttgctgctgcttacattactgtttgattcacatcttttttgtctgtaattttcatgtgtctatttgcaactttgcattttgtgaatagcgtttattttggcaaaacatgtatacaagtgaggactttgatagataactgctcacttattcttctacactgtggcatgatcatgatcgcttggcatttatagactttgatagagttcctgcacacattttcctgtctacgtgtatgctaatttgtttttcctgtctactgctatattttgactgaagtgaattcaatttaaacttgtgtcagctttgatgagttcggtgtgcaaaagattatcccagacacaacattcatcaagaaatggagtcacaaaatcgaagctgttattataacgcatggccatgaagatcacatcggtgcgttgccctgggtaaatgattcttctgttactcatacatcattcatcgttactgcttggctatgactgcacaacaaatgccaaaaaggcttcggtcacatgcaactaacaacctctacagctatttgagacacaaatgattgtgcagaagatggtagcagagtgccatactgtaaattttaacaacatgagtcaactgctgcaaaaaagtcagaaaaaagataactgatttgaaggatataaccttgttcttgtgtcaaagctaacattctctaaaactcaaagctctcagcatatctaagtcagtaacaagaaactttcttcatttaaacttattggggctcatgaaagatgcattcatttctctctaacaagatacgcgttcattcttatgttttccattgtatttgctgtccacaggtaatcccagcgctggattcaagcacaccgattttcgcatcatcttttaccatggaggtaacagtcagttcttttgactatgcatgttctgcattgttggccgttattattacatataatttgtttcgttaatcttcagcagtactaagatgtagtttttcatatttggcagctaataaagaggcgtttgaaggagtttggaatttttctctcgtccaggcttaaggtttttagagtaaggaagagatttcaggctgggccatttgaggtggagcccctccgtgtaactcattcaattccggactgctgtggcttagtgcttcgttgtgctgatggcataattttccatactggtgactggaaagtaagttatataaggaatgattgcatactcaatttctttaattttggtgccccttttaactaatttttcaataaaagattgacgaatcaccagtggatggaaaaatatttgatcggcaagcattggaagagctctccaaagaaggcgttacacttgtaagtttatacaatatcagccatgcatccggaccagtacttttcaatggtttaagttattgtcctacgttgcaccttatactccccccatccatgaatgttgtcactcacttttgttcacaaaatacttgatatttcatgtttcccagtgcatgtttttccgttttctatttttttttctctctttttcgttgtcctttatcacatatttggtgggtccataatttattggttagtttggaagggcattatgggcatatcatataaattcaaatggtttcctatgtgtgccatggtcagaagtgacaaataaacgtggacgaagagagtaccatgtaggacggaaagaaatgatgatgcagtgtcacatattaaaagaaactattgtcagatcacttctgtactggcacgccgagctatttgttgatatgttgctaacattatttctcttctctttctggttatttttgatgcaagatgatgagtgattctacaaatgttctatcccctggaaggtccatcagcgaatctgttgttgctggttcattgttgcgacatatttcagaagcaaaaggaagagtaattaccacacagtttgcttccaatatacatcgtattgggagcatcaaagctgctgcagacttaactggtcgaaagctggtagaaattgcttcaacatatagtgcaactctaccttgtcttgtttgacttggatgatgtttttaatagtttgtacttttgataaactggaacaggtatttgttggaatgtcactcaggacttaccttgatgctgctttcagggatggaaagtcaccgattgatccatcaaccttggtatgcaataatattattagagttattcaatagtctttgtgtggaattgctacactattttgttgtaattggaacttaatgatgcaatatatggaacaatgtcttttactgtcctggtgatctatgcaattggcatcgagataagcacatccttaacaatttgtttccattaccatttttatagctatcgacattgcatctcaacatctttatagcttctaaatattaacttgtttggctctcctgggtgctacttgcagcagttctgacaaaccgtagagtaatttgatgcttgattgtattcttcccggttaattgccacatgtatgccttgacctatactttttcgtatctcttaataaatttatctggtggttctgatatatttgtcttggacaaggtgcacttaatagaatctaggttcttgctgaaggtacttgagcttatggaaacagtaatatatggtgaaacagctataatatcagaaaatgctctgagtcttctttagatgtcttaactcttaatgattgtgagtagtgctgtaatgcactagtttgagagttgagttatttttccgtatcactctgttggtatgacgtgtgatgatatcacggaatgtagtcctccttatttcatagtagtcgttctgcaggttaaggtagaggacatggatgcctatgccccaaatgatcttctagttgttactacaggttcacaagtaagtcttacagcctaagagatctacaattttcagtagcccatgcaccaccttataattctttcaaatattttcaggcagagccacgtgcagctctaaatcttgcatcttttggaggaagtcatgcccttaactatccaaagaggatgtccttctgtattctgctaaggtacttcatcattgtcattgtcatcatctcttcacttctattgaccttgatacat

SEQ ID NO: 92662 - DNA, 555 bp, Oryza sativa
gaagccacgcgacgacgccggcgagatctcggccgtgtacacgggcgcgatcatgatcgcgtaccccacgccgacgcccgccacgaagcggccgaccatgagagtggcgtagtcaccggagaaccccatgagtagagctctggcgaagaagaaggcggcagcgaagacgacggtgaaccgccggccgatccagtccgccgtcctccccgcggcgaaggagccgacgagcgagtagatgttcaggatgcccatcaggatctccacctgcacgtcagtgatcttcaggtctttcttgatgtacagcgatggccgctcatcaccccgatgtctgcaaaattttggcgcgaacttgaacagtcagtgctcgctgacagtacactacacttctgaaaacaaattcagaccacatctgaagatttttctttttttttttttttgagatgatgtgaatacgattgtactacgagtaccatagccgagaatgatggaggccatggaggcgaggatggcgcaggtgaatgcatagctggcgttcttcttcttggggtcgacagc

SEQ ID NO: 92663 - DNA, 597 bp, Oryza sativa
ggcgctccctgtgacgttcgggaggcgagtgaacagatcgttcgtcgtgacccctgctcatccggctagatcctgtaccgatgatgctgaggcttggctgatgataatcatgagatcggagatgagggactcggctaccagtcggagtgcgggtgcttgcggagttggctggaaccgaggcagcgatcatggtcttcatctggttcaagatgttgacaacatgatcagcttggttgagtgcgtcttccttgaggagggtgtcgaggagagtgattgctgcaaccgcgttctgctggggggtgtgaaagaccgctgttccatcgacgtcttgttgcccaatgagctctctcgctcgccgcccagattccaaggcgcgttgtcgtcgatcttcagcctcctttgcaatctgttcgtgatcttgttgctcacgctgtagtcgttctcgctcctgtcgctgtcgctcttcctccagtcggcgacgttcagcttcttgccgtgcgcgatcttggtccgcttctcgggcttggcgctgttcctccgtttcgttgtcagccatgaatacgccgaagaagaggggcgtgtagttatcctcatagc

SEQ ID NO: 92664 - DNA, 720 bp, Oryza sativa
acagaaaagaaactaataaaaattttcttgtgtacatagggggttcaggttgatgcaacaaattgtggcttatttagataactgtgtaggatcttccaaatatcatcccaattgccaaatcaaagcatatgttgcaccatttcaagtgatagatgacccatacctgaaggttaaagctaaaagaatacagaaatttactgagataataccaacaaaatgatgcatcatgacatttattccaaaattaaatagtattcaggcgattgtgcaacaacaaagcagataaaacatatatgatacaatgtgaaatagagtatgtcagaccttcttcgccatacttgccagcgaggtgctacttttatcagagagtttttcaccgttgctggtgggatgaggcactggagtacaatctccttctccagaatcctccctttcagttgcaggagcaaatggctgaggaacagtgtggtttgactcttcctgttcagctataccatggtttattggtgaactgggaagagaagacttctgctgatcaaccagcttcagcacatcttgatctgcaggcactccatcctggacattcccattcatatgtgagtctatagtagaaggggtttcttgccctcttgaagaatcttcatcatgcctgccactcataacttctgtatgaccagctttcccatttgggggacatataaccacacaatctgattcatc

SEQ ID NO: 92665 - DNA, 550 bp, Oryza sativa
acaggagtactcgggaagaacaggcttggggttttgaacataaaaccagtttgcgtgctagcctttatttgaggtcttgaagggcatggagaagtatttttggcttagtgttcccctgagttggaaaccagcacccccaatgatgcatggtttgatcttatttggctagggcttgaggaagaagatgcggcggaacaaggcgaaatgaggcctaatgcccagaaaagcttcgcaggcatgaataaaattggcaatatgcactatggagtttggattcagatgatgcaagctaatcccgtagaaattcagaatgccccggaaaaatcttgaggttggaagagaaaatccgccatagaagaaatgagcaaataccatgatttcgtgtgtatcgggggtcaggaatgcctcaccaaatgccggtcgccacccgatgatctcttttgctggaagaacgccgtgcgccaccatctccttcagattgtcttccgtcacatcggagggcgcccactgactctcgaagctttctctttcttccgccatgaatgtgaac

SEQ ID NO: 92666 - DNA, 897 bp, Oryza sativa
acatctcgactaccgggccgcagctcgtgtagccttcatttgccctagagatgtccatcggaccccaactttgtccatctctatccgtgtacttttgcccacgaccagactgagccacaaagtatgccttacccactagacatgtggaagtacggtagtgctttgcaacagaggcccgaagaccggtccttatgatggccgaggtgctactattaaaaccatgcacctcgagccagcgtaaaaccattttgggggttttgaatagagggggaggtgtgtgtccaattccacataagccaaccattccataatgtccaaatgatatgagaattcccaaagtctaaagttataaatccacctaaagtttgtctaatttaaatagcgaagcttctacctaaaaatggtactagtgagaccatagtacggtaaacactagtggggttttgtttactctagggtgaacaaggtaataataacaataacaataataataagatcataacaaaggtaaatatgcatggctaaataaaacagtgataatgcgggaatttaaataaagcgataatgcattaatttaaaacaaaataattttaaagcatgggacaaaaatatgttcaaaggagatatgacttgccttactcgctttcccaaatgtcggcttcaacctcaatgtagagcggatcttcgaagctacagcgtctacacaaccaacggataaagaaaaggcttttactctaataaaatccatttaaccaaaagaaacaaatcacaaaaatgggttcttgacctcttaaggaaaaattagagacttgaatggtccaattccgagttcaaatggccaagttatggccatttgaagtttatatgctctttaaatgaatatttgcgaatttctcc

SEQ ID NO: 92667 - DNA, 508 bp, Oryza sativa
gctcacggccatggctgtcgaccccaagaagaagaacgccagctatgcattcacctgcgccatcctcgcctccatggcctccatcattctcggctatggtactcgtagtacaatcgtattcacatcatctcaaaaaaaaaaaaaaagaaaaatcttcagatgtggtctgaatttgttttcagaagtgtagtgtactgtcagcgagcactgactgttcaagttcgcgccaaaattttgcagacatcggggtgatgagcggcgcatcgctgtacatcaagaaagacctgaagatcactgacgtgcaggtggagatcctgatgggcatcctgaacatctactcgctcgtcggctccttcgccgcggggaggacggcggactggatcggccggcggttcaccgtcgtcttcgctgccgccttcttcttcgccagagctctactcatggggttctccggtgactacgccactctcatggtcggccgcttcgtggcgggcgtcggcgtggggta

SEQ ID NO: 92668 - DNA, 705 bp, Oryza sativa
cagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaagaccccggcggctcccaccggtaactggcgaggtgaggccaagcagaaggccaccgccgaggacatcgacgatggcgacgatgacctggggttccaggagcctgaggccaccgtcgccaccgtcgatgggggagcgtgcgctcacgcttctcgccggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcaatggtggtttcccccaccgtttgcaatgtgaagttggggcgtgtcctcaaagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggatttcgatgtggcggaccttagtctgcccta

SEQ ID NO: 92669 - DNA, 1768 bp, Oryza sativa
taacgcttctccgaacaacgcaacaagatctccgacatcaccgacgacgtcatcatcgccgccttcactaaaggcattcgccacgaggacctagtcggcaagttcggacgtaaacctcccaggtcggttaagcagatgttcgaaaaagccaacgagtatgtcaaagccgaagatgctattaccgcgtccaaacagtcgggcaccacttgaaagccaaagaaggatacgccgaccgcaggagagagtggaagtaacaaccacaaggatcgcaagcgtaagcccgaagaacttgtggcgaccacctctccatcttcctgacaacgttcccgcatcaacaccttcgacaagataatgaactcccaatgtccgcatcatcccaactccaaccacatggccaaagattgcttcgtctacaaccactttggagcaatacgtcaagaacgcacgtaaaccttcagacggagatcaaggcacatcaaagaagaaagatgatgaagacgatgccccgactggttttcaagatcatcgcaaataacttaatcacatcttcggtggacccctggcttatgagtctaagagaaaacagaagctaacataatgggagatcaatgcggtttagcctaacacgccccaatatcttcggtagttagaaatagcaattaagtttgaccgctcggatcatcccgaccgagtgatccacccggggcggtaccccctagtactagacccagtggttcgcaatgtcaagctccgacagactctcatcgatggtggcagcgcactcaacatcctttttgctaagaccctggactatatgcagattcctcgcacggaattgaagccgagtaatgcacccttccacggtgttatcccaggattgtcagctacaccactcagccaaatcactcttccagttaccttcggcactcgggagaattttctcacagaaaatgtttgtttcgaagttgttgatttcgagacagcatatcatgctatacttggacgaccggctttagctaaatttatggtcgtcccacactacacctacatgatgatgaagatgcctggtcctcgaggagtcatatcactacggagcgacatcaagcaggccgtcacatgtgacaaagaaagttgcgagatggcccaaacccacgagactactctcacccgcgaagagatccgactggctgcgaccacggcaagcgagggagaagtgcctgcaaccaagctgacgaagaccgaagaacgtgatgctaagacgaaaaagattcccttagatccctccgatcctgataagactactgtaataggcgctgagttaaattgtaaataggaaagcgcgctcatcacctttcttcagaataataaagatatttttgcatggaaaccatccgatatgcctggtatccccagagaggtgattgagcactctttacatgttaggaagacgccaaacccatcaagcaacgactccgccattttgcacaggacaggaaggatgcgatcaaggaggaattaaccaagctgttagcaacaggcttcattaaggaagtccttcatctcgactggctggctaacccagtcctggttcgaaaaaagacggggcaatggcacatgtgtgtcgattataccgacctcaacaaatcttgtcccaaagacccttttgggttacctcgcattgaccaggtggttgactcaacggccggctgcgagttactcagcttcttggactattactcgggatatcatcagatccgactaaaagaat

SEQ ID NO: 92670 - DNA, 4712 bp, Oryza sativa
caccactccaccagttttggcctcgccacatccacaagagccgctactgttatatgtgtcggcgacctcccaggttgtgagtacggtcctggttgtcgagcgtgaagaggaaggccatattcaaaaagtccaacgtccaatttattttgttagcgaagttttagccgactccaagacaagatatcctcaggttcaaaagttattatatggtgtcttaattaccgttaggaaattatctcactactttcaaagtaactcggtcacggtggtcacatcgtttccactcggagatatacttcacaatcgcgaagcaaatggacggattgcgaagtgggccttagagttgatgtctttggacatatcgttcaagccacgaacttcgatcaagtcacaagctttagctgatttccttgccgagtggaccgagtgccaagaagacatgccagaggaaaagatggaatattggactatgcattttgatgggtcgaagaggcttacaggcactggggctggggtcgtcttgatttccccgactggagaaagattgagctacgtattgtggatacatttttctgcgtcccataacgtggcggaatacgaggcgctactccatggattaaggattgcaatctctttaggcattcgccgattaatcgtccgtggagactctcagttggttgttaatcaagtcatgaaagagtggtcatgtctagatgataatatgaccgcttatcgacaagaggtatgcaggttggaaaataaattcgatggactcgagctcacccatgtcctccgatataacaatgaggcagccgacagactggccaattttggttcaaaacgggaagcagctccttcagatgtgttcgtcgaacatctttacgaaccgaccatgcccagaaaagagacagtcgaagccatggatacccaaggcgtaagcatgatcgaagctgactggagagaaccgtttataaaatttttgagcaaacaagaactccctcaagacaaaaatgaggccgagcggatttccaggcgcagcagactttacattatccatgagactgagctgtacaagaaaagtccatcaggaatactgcagcgctgtgtgtctttggaagaagggagacagttgttgaaggatatacattctggtatttgtggtaatcatgctgctacacggaccattgtcggcaaagcttaccggcaaggttttttctggcctatagctgtgtccgatgcggacaagattgtgcggacatgcgaaggttgtcaattttttgccagacaaactcatttgccagcccaagagttgcaaaccatcccgttgtcctggccgtttgcggtctgggggcttgacatggtcggcccgtttaaaagggcagtcggcggttacacgcatctctttgtggctatcgacaaattctccaagtggattgaggctaaaccggtcatcacgatcacagcagataaagctagagatttcttcatcaacattgtgcatcggtttggggtacctcatcggatcatcactgataatggcactcaattcactggcggagcatttaaagacttttgtgaagacttcggcattaaaatttgttacgcctccgtggcacaccctatgagtaacggacaagtcgagcgcgctaacggcatgatactccaagggatcaaagcatgagtttttgaccgactacgtccctatgctggcaagtgggtagatcagctgccgtccgtactttggtctttacgcactactcctagttgggctaccggccagtcgtcgttctttttggtttatggcgcagaagcaatgttgccgagtgaagtggaatttgaatcactacgattttggaacttcaacgaggagggctatgaagagggccgagtagacgacatcaatcgactagaaaaagcccgagaagcagctttaattcagtcgactcgatatttgcaagggttgcgccgttatcataatcggaatgttcgatcgcgagcctttttagtcggcgacctggttctgaggaaaattcaaacaacacaggatcggcataaattatctcccttatgggaaggaccgttcataattgctgaagtcactcggccgggttcttatcgactcaagggcggagacggtactctcatcaacaattcttggaatattgaacaccttcgtcgattttatgcttaggcatttcgtttgtatctttcctctttgactactaacttcaagtttttccttgaagttttcagtcagggggctactatgataataatggagtgtgatttttatcaattcaatttgcttacttgatttatcattgccatgtttggtctttcgacttagccaatgaggactaaaggtttttaatagcttttgcgggttttaggctcaataagacttgacaaaggcttttaagaaatcagaagctaagtatggaacaccaagcatagcataaattcatcagtattgtacaaattgagcctccaccgtcattgatcatcaaaatcattgttatatcaataagtatcagttttttcatcatcagacttatcagacccagtcagccgaaggtcgatatcttggaatctctcaactacatcagcagcaatcttgtcagcggctttctgcgcatcactgatgaggtcaagagcagcttcttcgctcgtcccgtttgcaaagccatcaatggcatccatatcaacccttggataaagggatttggtcatcgccaacgccagacttgctcccatacttccagcttctttgatgttcttgaaataagtatctggagcgactctcagcttgtcaaagatttcggtagcatcaagtgtactcgaaccggcgttattgaagaacatggcctggatgagtggagtagcggcattagcgactttatccctggctccttcaagcttgttgatcttgtcaactaagacatcaaactgtgcttgagacttgatcttgcggtctccatcaacagattcacattaatgaatcagcatatagaagataatggcttttgaagtattgattattggtaccttcaacctcttttaaaaccgaatccctctgtcttgccagctcagccttgtcattttccagagtttggatctgcttctctagttgagatatcttggcagcttgcactgcattaacttcggttaatcaagattacagagataatagcacaaatcagttgggcagagtttgcgcgaacctagccactcagttcgaaattggactcctggagctcagcaatccgatccctcagatcgtgttcattcttcttggcaagttctctggcctcgtgcagttgactcctggtggcttcgagggttccaagatgaggaactagtctctctagggttgcagttttcgcctcgttcctaagatgaatcctctgcggagcagtttaatcagcgctcgcgccagatggcaaacaagatggctgaggtcaggcgtcaaggaacttacatttacaatgcgagtcgcttggttgagtgcctttttcagtaggcagacctcttcgtcttctttttgccggtttattacaattccttgaggttgcaagttgtcatcccaccacttgaccagaatgggagggcacgaatcttcggctgctcgtatacgggggatttcttcttcatcaccaatcattggtcctaatgtattcactgacaaaggttagacaattgatcagagttatttgggtcaacatggtttcagataaagtgtttacccgtaatgatttctggacgaggacgagtggatttggatgcctttaaaggagatctagatctctagttattgctggcgttttgtccgcgcgggctgtctgcttgggtttcgacttctggaatctcttggcttggccttgcgtccgactggtttccagtcgggggctcctgattaactccggcttcggcttcggccgactggtttccagttgggggttgatcaccggattctacattatcggttgccggctgattgtcactcagatgatccccagcagttggcccggtttctttggacgaacttgtgttcatgttagtcgggtcagagtctttcccagacggatccatatcaaatggtttcctgcaaatttaattatcagtattattgccgcaatgggtgcgcatcaatacaagagagatcgttatatgagttgcacctagaagacttcctgatctttggcacagggcgattggatgttttcttccttggagtagcctgttttggtagtttcttggttgtctctcggtcttcaggcctcctggtggtatcatcggcttcgtcgtcacttaaaaccagcttcctctttcgataatcggactggccgactagatcagaagcacttggttgagtttcagaccgaattcttggtcctccgctcccttgcccagtttggtgacggggagatcggcgttgagcgattgggggatccgacttcatcaaagcaaattcctgggtgtaatatccttcattgttaactgattcaacaagaaaacaagatcatattttgagaaaggttgaagtgtatgaatatgtaccggtggaggaggattgaatgcattgaatggtacgactggcagcaagtgtgagtagctgacaacgatggcgtttgagaagatcttatacatcctttccttcatgaccttgaagtcaagagaatctggatcttcacggtttgggtcatgcttgccgt

SEQ ID NO: 92671 - DNA, 874 bp, Oryza sativa
ggcaaattgaaataccaagaacgggcgatgccgtctagagcgagatgtattacctttgctttggtattttcgtcgccatgagccgcttcgatcgcggactcataaatggagaggaattcctttgggtcagtttcgcctgagtagcgtgggacgggtgggaacttgaactggggtgggattggacgggtcttgattcccccacttagcggtagccccttttcgccccctgccctattcacggcaccttgctgcggttacggcgaggcgaagggcgaaatcacggcttgcgcgtgaggttgggccatggcattcggttgcccggctccgattggtgatgcttgctgagctgtcatggatgggtcgaaagttggctctgaccatgtcatagcgacctggtttggtgctcggtttgctccgaagcctggcgttggtgcttgcggccaaacggttggtgcctaagcagcattgatgaagtcgaactgcggtctttgactccacggtgaagcccccagacctagctgattcgacggcaaccaactaggcgcaccttgacttgtattcccctccgggtgagccgaaggggctgtacctgaaatgttgtggggttggctgagctgctgaaggaaagcttggagctgtgcctgcagagccgaagccccttctgccattgtttgtggcacttggccaggcagttgagggtgtacttgggcagcgaccggttgagcttgcagttgcacgtgaggggccggatgcgctgctgcggtcgatggctgcccagcgaagtacattggcgcttgcacaacttgtggcggaaagggttgggtcggtacttgtggataaacttggggtgggacatagcctgccgaatactgga

SEQ ID NO: 92672 - DNA, 688 bp, Oryza sativa
gctgcttcacgaggtgcttcaacagctgctccctgctgcagccttggatcttgcacgttgccacgttgccgaatgtttcggcattgctccgtggtgtgcgaagagcgtccgtggaaggcgcagtagaggtcttttcggaccttgcggacaggctgctgatggttgcttgcttgctgggcgtcgaactccttgcggagggcttgcacttcttcgacagccatcacagccttgcccgcacggtcggttctgaacttcctccaggtcatgggggcttgaccttgtcttggcggttgtccttggatcgccggctgaggctggcgaacagcgagaggaggtggttcggcaacttgaacttgtgcttgggcttgggcagcggcgacgaaagccttatcatactcagcttgtattgcttgccgtcgcttggaatcctcttcgccccttgcgtacccgtcaatgatgcgaagtaggtgctcaagcgtctgtggttccttgttggcgatttttcttgtgagttcgccctcaagtagaccggccgaagcggcgtttatgacagacgcctcggttatgtcttgaacttggcaccgggcttgcgagaagcgacgcatgtactcccttatcgactcccccggcctctggcgaatgctgagtagatgctgctgcgtcttcggctcctcataggtgcctcgaa

SEQ ID NO: 92673 - DNA, 1350 bp, Oryza sativa
atcgccgaaagcaagcaaaagttttgaacgatatatcactgcatctgcatggcgaacactacattattgtactactcgaaattgctcgtgaggtgctcggcctacgagaaagatggtagcggcggcggccgggtgagggtgaacggcgcggctcaccgcgtgccgctccaggtcggggctgcgctggagacgaaaatcaacaggtcgctggccgggctgatgaggccgccggtgctgtcacagccgccgacggaggaggaggccgagggcaggaggagccacggcagaacatcccgagtgagaagcagacggtggacccgttccggcaggcggtgatcgtggaggggggcgtgcggtaccggcagacggtggtggtgcggtcgtacgaggtcgggccggacaggacggcgacgctcgagacggtgctcaacctcctccaggagacggcgctcaaccacgtgtggatgtcgggcctcctcggcgacggcttcggcgccacgcacgccatgatcacgaacaacctcatctgggtcgtctccaggatgcacgtccaagtcgaccactaccccatctggtatattatattagtatttgtgttcgtccatggcgtcctgttcgttcagagaggccggggcaagaaaatttatgctcatcaggagaggttggttgcaggggagaggtgctggagatcgacacgtgggtaggctcgtcggggaagaacggcatgcggcgcgactggctcgtccgcggccgcagctccggcgccatcttcgtccgagcaaccaggtatgtcttctagagatcatccgccagtcttaataattagttatactagaaaatatgggtgccagttggcgcgccatttctaatagtagtctgtttagggtaatgtgaatattttaatgtgttttcattttttcagttagccaataacattgtttcgacttaaaatattcctcaactttttcattgatttttataccattcaattagattgacttacgaatacttgttgatttgaccggttgatcgtgagtagataaacttttagcgttattttttacataacatcataacagatacatttaaatatattaaaaatgtaataatacaacttggatgctacaaaatttgattgtttaaattagtgttgatcaaagctcagcacttcaaagtaaaaaccaacaagtattaaagtccaaagtgttttgtgtttttacccttttctgatttttctattggtgatcattagtttgtgcactgtttcctggaattttttttgctctttattgagtggattttataataattggctatagcttactggacgtaaaagataggatttattcc

SEQ ID NO: 92674 - DNA, 895 bp, Oryza sativa
gagaaaatagtagtagtagtagtagagaagagtagagaatactgagcagagatagtactagtatgttcaagcagagaaaagaatctgagtagagatagtactagtatgttcattttatttgtattggtatgatttttcttgctatgattcactcagatcaaatatatcaattaaaaaattacccgttaaaattatatctcttaaaaattatttatttcgaaattttatcgcgataaataataccgttagcatttagtcgttcaaaatatatctcttaaaagtataagattagttggaagatattaataaaatataggaggatgtgatatggatgatttgttagagtagaaagagatatgaatgaggaatcttttttaaatagctatccatatggacatatgaaggatgatatttggatgagctcccgatgctctaaacaatccctttgtattgactagggggtggggtggtacggaaaccctatcaccagggaagaggggggcgggggcgcacagcaaatttcctcctaatccgtttctcccttgggcgatggcttccatcgctatggctgcctcgttgcgaaccttcctccgccctcaccgttgccgtctcctcctccgccagagccgcagcctctccgccagcgccgccccggccggtgccgccgccgcatccacggttatccggcgcagcgtagtggaggtgctccgggagcgggggctcgtggaggccaccacttctgagtctctggggtcggcttcagcgagccctagggagctcaaggcgtactgcggcttcgaccccacggcggagagcctccacctcgggaacctcctcgggctcgtcgtgctctcctggttccgccgctgcggtcacaacgccgtcgcgctcgtcg

SEQ ID NO: 92675 - DNA, 977 bp, Oryza sativa
tcatattgatgttaatgaatgtgggaaatgctagaatgacttacattgtgaaacggagggagtactcaatatacccagaacaagatttcacgaacatatatatgaagctcaaatgaatcaatgaaagctcacggtcagcaactattgcatgttaagcgacttgttaaatctgtagttggtattgctatgcaaaactgtattcctaatctacagtttcattgcgttgattgttaaatctgtagcacgtatggttacaccaggaggatgcctgaagttctactaagtttcttcattcccttcgtaacattttttttctcatgatttttagcaagcagctgtccagttcccagttcaatcgcaacacttgttccagccaaggaaacggctcgctagtgagtacttgaggtaccatcggcaacataaagggagaaggataaggggcacaccaggttgaggagatgggtcctcgagggctgcgccgaggctgcccgacggcgactcctccctctgaggtgcgggcggcgagggacgctccgtctcccggccggctcccccgtcgacggcggcgcagcgaaggtgccggccgtggcgacagctgaggggctcgggcgccggggaggggaggagcggtacgcaacggaggacggagagacggtggtggtgatggtggcgaggagggaatccgccgagccccggaggcgagtgcgagagcagcgcccccgcgctccccatggtcggtcgctcctacacctccgaggaccgaggcggggcaagctggaggcggatagagtggacgatgataattatctcgctcgctagtcgcttccgtgttgcctggcgtgttgcactgttgcttgcgccgcttcacctcgtcttgctctctctgtggaagtgtggattatgctcacgcaccgagtcacacgagtcacgaccacacgacacagcaacagcaaagcagcggcgcaccgttaacgggt

SEQ ID NO: 92676 - DNA, 1411 bp, Oryza sativa
aaaagacagaaaatctttctatagtgcaaacaaaaccccagctgataagcaatagagatgcatgtgatgctatatgcttggtcaggtcagtcataagacgtgaaggctatctacaactggtcttaactctgtagttatgctaaggaaatctgctctgaatatgtagttcgtacaacggtacaagtgggttccaaatctagtcgcttttgttcttaacccatctttatgatcacccattatagatgtcatttgtataatcacctgttagagttccaacattttataaaaccattgatgatctattatgcatttaattttgttttccttcacttgatagttactatttttgaaacagttatgctaaaattaagttgtcaccttatcattgtatcaggatttagtgaaccatattttgaatagcaatgctatatcagaagggccatttagtatgagaaaagctagatttttaggctctgcttcagcctttagtgttaaacaaactgagtggccatgtgctacaactgactcaaagaaatgttaccgtaagttgctaagcacgataaaacaaagtcagttaatgtgtaagcacatactttcaaaacttcaactcaaagtttgcataatatagtaacttaaacaatgaaatccatcatgcagacataattgtcatttagcataatatattttgcataatatagcataattgtcataatatccttaaatctggaagttaggtaaaaactttcatccaatccacaagccacaacagaagaacccctaagtcctatgtgtgtatgcttccaaacatccacagaagaatcagatgaaattcatcatcaacactagctgtgtcttttgtaggagtaaaggaaacaactggaagagttgaatggatgaaacttatacagttttagatttgttgtggctaaaatctttaggctcaattttctagaagtattaaagaaaaatctatgtcattgcattgtacttatcataactattttattcccattgtgtatttttctggtgataactgctacatttatattcattgtacaaaatgcccttaattagtattatacgttggtggagttcctttttagagtacttgacaactcaaatttaacttgtacagtccaaaatggatcttttggaggtatcacagaggatgaagaacagagtagcctgtacaattttctttatccgagcaaagagctacttcctgatgataaggagatgagtatatttgatcatctagaggaacttcgtgacaggatatttgtctcagtattggctgttggtgctgcgatacttggttgtttcgcttactccaaagatcttattagaattctagaagcaccagttagtgttcagggtgttcggtttctgcagctctctcctggagaatttt

SEQ ID NO: 92677 - DNA, 610 bp, Oryza sativa
ttgcataatctactcggttgccaattggtgttggaacctgtatgcttgaacaaatcattatttgatctaactgtttcaatgctcattgacttgttatctggtgctaatataatcatcaattaaatggctggtgtggaaacttctctagatgttagtgatctgaattatcagtctgatttactgccgaagataaagaaagagaataattgtagcaggaccatctcattagaatgaatatatcccctctcaaagctgaatgaacataatatcttgtatatttttatagtttccatgctattttttccaggtccctgttatccagctactgctggggcaagtcggtttggtttctagtgaccaaatgctttccatctggagatatgttgttgttggcgctgtagttgctgctgctgtgcttacaccgtcgacagatccgttgactcagatgctcttggctggtccgctgcttggcctgtacttgggtggtgcttggatggtcaagctaactggtcgataattcctactagtattttgtattaattagcatcatagtcatggcggtggttctggacaaatcgcattccccattgtaacatagttgggctgcagg

SEQ ID NO: 92678 - DNA, 1633 bp, Oryza sativa
atcaaatcatgcatatatcaagttagagatttacaatcacagatttacaaacaaatgaataattattcaagtcaccaattcatcaagttacagtctcacagatttacaatcagttcaaatcaattcatcaaatgcatacatcaagtcatctactattttccatcaagtccatctcagagtctcagacaatcagacttacagaaatcacataatcataaacaaacctcagaaagttagaatataaaaggggtttatataagctgtgattgtgcaatggctgcctcgttaaaaacctttataggtaaaaactcacacctcgtgagaaaaccctagaaaggaaaagagtacaacccacagctaaaatgttcacatcaattacaatcatctagttcaagggtttacatcaatttcatcatcaagatacatattctcataagcattttgaagctccacattctcagtagtatgctgaccttttgcatctgctagctcccagtccttgatcactgctagaatttccaccagcctagggtttagacgccgccgacggtcctcgatgatcctgccagttaagctaaaagtagactcggacgatatagtagaaataggaacagtcataacatctttagctaagattgaaagaacaggataagttagtttgtgttgttgccaccagctaaggatattgaagtcatcatcatattggttgacagtgtcactgtcaagatatgcagacagttcagaagaattgagattagcagttgaagaagctgcctgaagcaaagcagtagcagatgtcatcctaaataatgaaccagcaccaagcccagcacctggactgacaccagcattaccagcaccaagcccagcacctggactagcacctgcattaccagcaccaagcccagcacctagactggcacctgcattaccagaaccaaaaatcttcccccatgcagtccttttcttactagtggaagggcctagaatagtggaactacgcaatccaacagaaccaaactttctttcatacttagcaaaagtatcagacaatgaagccctaacagttgttaaataagcagagtaatcatcaccaatgagttgagccataatctgaagcactttactaaaccccctaatcttggccctagggtccaagataaatgcaaatgaataaagaattggaattttagaccagtagttcataaacttagttttcatgggaccaacaacatttgcaaggttttgaacattgccatatgtgtttagatgtccagcaatctttaaaatgtgatacatgattaatggagatgttggataataaacaccagacaaaacaacagttgaatcataaaattgttcaaggaaacacaaaacagattcagcacatgcccaatgtaagtctgtgagtaatggatggccattaacaaaaggatgttgtgtactaataaatactatgaatggttccctatgtggtatgagatgcttaagcattagataagttgaattccatctaacatccatgtccaaaccaaacatacgaggacgataacccgcagcaatgcaaacatttttatatgtagcaatacgctgattagatgcattcaagaatgaaatggcagctctaatgtca

SEQ ID NO: 92679 - DNA, 2300 bp, Oryza sativa
caagggatgtcaagattgtcaaaagtttgaagcatttcaaagggcaccagcatcggctatgaaccctatcatcaagccatggccattcagaggttggggaattgatatgatcggtatgattaatccaccatcgagcaaaggacacaagtttatattggtggcaaccgattaatttaataagtgggtagaggcgattcctttgaagaaagttgattctggggatgctatccaatttgttcaagagcatattatttatcgctttggtattcctcaaactattacaaccgatcaaggctcgatctttgtgtccgatgagttcgttcggtttgccgatagcatgggtattaagttattgaattattcgccatattatgcacaagccaatgggcaggccgatgcatctaacaagagtttgatcaaattgatcaagagaaagattttcgattatcctcggcaatggcatactagattggccgaagcattgtggtcctatcggatggcttgacatagttcgatccaagttcctccttataagcttgtttatggacatgaggctgttgtaccatgggtagctagtatcggctcaagaagaacggagttgcagaatgagttgtcagccgatgagtattataatatcatgaccgatgaaagggaagatttggttcaatcaagattgagagcccttgcaaaagttactaaagataaggaacgtgtttctcaacatgataacaagaaagtggtagccaagtctttttcgaaaggtgaacttgtgtggaattgattttgctgatagggactcgagacaacaaattcggcacgtggtcaccaaattgggaagggtcgtttcaaatccataaagttgtgtccaaaggagcttacatgttgcaaggacttgatggggaagtttatggacgagcgttaaatggcaaatatttgaagaaatattacccaagcgtttgggttaatgcatgatcggctggtattgccgatacatgatagccgatgtgttcacatcgccttgagatggccgatatagttgtatcgcccttagttattttcatattgtaatccattgtgttttgccgatgtacaatggccggtatggttatatcgcccttagttgttttcatattgtaataggttgtgttttgccgatatacaatggccgatatttttatgtcgcccttagttcaacttataattttatcaatgccttcgtcattataaaattaggggggcacatatacatgtaaaaagttgcaaaattttgagcaaatataggaagtcatattaattgacggatgaagtatcaagagtttcttagccgattacaaaattttcctaagtcctattacatagaaagtcgctgagataaatatcgttgtattgccgatacagcacgttgtctgatttgttccacttcttcgattgcttgggcatcttgtgcatcggttccagggacgattttcaaggacttagtcatatcggcaacatttctgatagccgattttagccttcgggagatcggctagtttcttttgctccaaatctagctcggcgttacattcttcgagttgtgctatgagttcaattttggacttgatcggaccttcagacaagagatcaagcttggacttttattcatgcactaactgccgattgatttggattgtagcctcaatatccttgcactcctgatgatcggctaatctttgcttggctttctccagcttgaattggtgttgctcgagatagacagctagagtaacaacgtcggctagctcatccggaatttgagattggatctcatgtagccgagtcctgattgacccacaatcgaccactagattgtctagtgatgatgcctctagccgatgagagatgtcttgaagttttttcttcacatcatcagaaagaggggccaaagctttgttagtggtgtctttttctatttcatcaaagtaatctttgatatcaaaagaaaacagatcggctagggcctgcaagacagcaatttgaagacagttagatatcaaatggatatagccgatctaagaccttgtgttaaagaaagacttactgggatggcaggagcggctggttgttcctcttcctcaacattatggcttcctgcaaccgatggagttcggtcacttgacgtttgttgtacaggaggcgaagggggaggaggaggctgaaaggacagacaagtgttagttcatatgggctataattagaatttcgaaagacaattttaccggtggagctggtttgagagttgttgctgccgatttcttcct

SEQ ID NO: 92680 - DNA, 608 bp, Oryza sativa
aaacacgttaactacaaaatgacgtacccatatgcatgcatataaatttattagttcaaatggacctaatttaaatacaagaataaacacatattagtttaaatgaagcatctctcctttaaccgtggcaaccatactgtgctagcatcattgtagttgttgcgtctgtagatcatctatgcacctttgcgtatcatgtcgacgctgatcgacttgagcctctcaatcccatacctatgagccgcgacgagcagattctgagccatgaacgccgtgtctcccttgtcgatcttaggcagggtatcggtgtagatgaactgaagcatggcccgaaacaccctcaaatccatatcatcaatccgaataacgccattgccagttgccgcagcagcagccttcgcctccttctgatctttcccgccattattgccgaagagctccgccatgaacaccggcgaccgtgccgcgagcacgttcttgtgcgccgcgaacagcttgccgccgaccctgatgcgcacgtcggcccccaccccgctgccgaagagggcggcgaggtgccggtgcaggtccggcggtggcaccgccaccgccgtggtggccgcctcaca

SEQ ID NO: 92681 - DNA, 1833 bp, Oryza sativa
caattattagtagaatgagacccagagttatgccacttgcaataccttctcttgcccaattcttcagacgatggtatgatgtgaccagcaggaagtttaatctgtttttcccgaagtaacggatcaaaaatcttatcagccttggtaatatcaaagtcatacatctcttcttttccagaactctttacccactggtatggtataaccttcttgcttctgatccactcggcagctgctacttcggaatcatcatcatcatcggatccatacatgtaaggatagacatgattgatctttttgaagtttttcttggcttctgcaaacctctgttcatgtagagttaccttctatacaagatgtgacaaactatcaaactcctgggataagaatttctccttgattagagctatcagaccttgaaaagccaaatcggctaactaggcatcagtcaaactcaaattgtagcacctattcctcatctctctgaatctctgaatataatcctgcacaggttcatcatgcctttgtctaatcgctgttagatcagacaatttcatctcatgaactctactatagaagtaactatggaattgcttctccaaatcggcccaactgttgattgaattgtatggtaaagaagaaaaccaagtaaaagctgatctggacaaagacaaaggatgaacctgaccctcaaggcgtcaacagccgatgcctcaccacactgagctaagaatcggctgacatgttcataagttgagacattgtcttgccttgagaattttgaaaaatctggaactttatattggttaggcagctgaaccgtctcaaaccactcagggtatggatgccgatataagtttctagtgtccttcggcttaagcccgaattgctccctcatcacatctgcgatcaagtcgacccatggtctctgctgaggcaccccctacgcttgttgtggtacgggcttgaattgattgtattgaggagcaaactgaggctgagccgatcccccttgctgatactaaacctgtggcgatggagactgatattggtaattcaaattgcccccttgataattctgaaagtttggctgtatgttgcgcaccaaatgttcgggaataacttgagctatcaccgattgatctggttgcacattatgaagaacttgagttacgacgtgctgcctcggctgattatcaggcgtcctgaacctagccgatgcatttagcgaactttgctgctgaatcggctgactaatctgctgccttagtggcgtctgctgaatcggctgttgttgtactaggtcgacagtaggctgagttggtaaaaacatagcagcaacctgttcctgagttagccgattaatattttgtcctgcatgcgcggctgctctcttgtcaacaatcgaggattggtcagttgccttgacgccgatgatggtgcagcaagtacaagcgccgataccggtgctgtcggctgagctggtggcatattggaggtactcggctgactgtttgggaccaagggccgatagtttgggaaaataacccctggtaaatagactggtcctgtggcctgatactcagctattgaaccatcaactattgacttcaccatgtttgataaggtattgactaatactccagattgattgatcaaagcatgttgcacggcgtaatcaatccgattttggaaattattaaactgtagttgtgttatattgccatctggactgagatcctcaacttgcaccccctgagagccgtcacctttatctcctgagccctctgcagcgcctttaccgcatgattcagttgtaccggccggaacttg

SEQ ID NO: 92682 - DNA, 1242 bp, Oryza sativa
tcacaggtgaggtcacgtgggacggccttacagttagagcccgtcacaggtgagtttgactacatggactacaatattttatttaattttattctatttcacttagttcttttattttccttaacatatttccacatacactacattttttattttattttaattccgatggttatacttgcttaattattttatttcacttctagtggattcctcacttaattattttatttgactatttcataagcaatatactattgatcattgcgaacatattagagtcatacagataacagacatgtagacataaactacatagataaattacaaaaataatccttcctcatggtcgacgcgtgcatattaaacgtcatcttcttcttcctcctcttctagaggtattttttgacctatgccgtggacgtgctggttgtaattatcctcgtctgcaatattgtctaatccaacaattctccttttcccttcacgaacaacatgtagtttcttgttacatgggtcaactatgtagaacacttgaacaacttgtttggcgagaacgaacggttcatccttgtacgcgttgttagccaagttgacagtggtgaaaccttcattgtcaacttttacattgcgaagattgacccattgacaacgaaacaacaggactttgaacattcaagtaatctagctccaaaatttgctcaactctaccatagtattgatcacgcctaccaccgtcactaggagcctcgatgcgtaacccactgttttgcactgtgcatttgctgtcttgctttaccgtgtgaaaggtgtatccatttatgtcatatccttgccaggtggtggcactccattcaggaccctgtgacaaccactgaagtgtttgactagacaagttcggcaacttggcaatccggttcttcagccactcattgaaagaagacatgtgcttatttctgacccaactctctgatcggcctaggttctcctgtcggagaactgcaaggtgttcgtcaacgtacggcaccacctcagtcatatgctgcagtaccgtgaaatgagctttatcgtacaccttccgatccaacctagcagtctttcttccaacagtaccaacaccatcaagtctcccttcatgatgagatcgtggtaatccaattgaagatgtttctaacatgtagtccacacaaaaatcgatgacctcttcggttgtgtaactctcgatgatactcccctcggggt

SEQ ID NO: 92683 - DNA, 611 bp, Oryza sativa
tggagaggactatagccaaggaaagcacaccggattgatctaaaagaaagcttgcgatgattatatggtcgtaggtttggccagcaggcacacccgaacacgcgcaagtggctgaactcaggagttgcagagaaaagttgttcaaacggcgttttgaatgagatagcagaactaggcaacctgttaatgagatatgtggcggtaagaaaggcttcatcccagaattttaaaggaaccgaggcttgggatagaagagcaaggcctttctcaactatgtcacgatgcttacgttctgctgagccgttttgctgatgcgcgtgagggcaagaaacatggtgagttatgcctatcttctggaaaagggagtttaatttctcgtactcaccaccccaatcggtctgcatggtgagtattttggttttaaactgtcgttcgacatactgttgaaagtttaggaaggcttgaaagacatcggatttctttttaagaagatagatccatgtgtatttgctaaaatcatcgatgaaactaacataataatcatgtcgcccaacagaagtgggcgccggtccccaaacatcagagaatacaagagcaaacggaacattaga

SEQ ID NO: 92684 - DNA, 2272 bp, Oryza sativa
gaggtgagaacacttccacatttacaggttgttcaatgataacaaggggaaatggactcttcgctccgaggggtactttcaggaactaggatggagcttagagggggcatttgatgagagtgtccttctctggcatcttgccactgatttctgctattacactagtggatcatatggccgtgaaagatcgattcaccacaagagtgctgttcagtgccgagaactatccaactacatgatgtacctgctgtttgtgaatcctgagatgctgatgccaggcaccaggcgaaacttattcacaaatgcctacaaccaactaaaggacatcatcaaggatgagaatccttgattgaatgaaaaagaacttgtcttgagaatatttgatttcgtgcagaacccagtagagtcagcagacgctaggcgaaacttcttcacaattgcctacaaccagttaaaggcatgtatgcagagaataatcacttggatgcagcaggaacggttggtacatagaaagataagaaacactttggtgcatgagccactaagggcacttaggcatcgaataaccgccttgattgagaaggcacttgtggcacgaactacgccaaattttgttagaattgtctacaacaaactggaggcatttattcagagaataatcgcctcgcggcagcagcccctcgaggagataaccaatgaagacacaccaccatccgatggaacagggctcatcgatgacgcttggtccattgctgaagagctcctgaagttagatgacgaggagaaaatgtggagggtgattgaaggcgtgtgggtggagatgctctgcttttcagctgccagatgtagagggtacctgcatgctaagagcctcggcacgggagggagttcctgagctaatatctggttgctcctgcattatatggggatggaaaccttggcagagaagctgtcaagagcagaccttctaaacagagaattctttagctaattcatccactacccatgttggtgagccctccggcataattgagcgagttgctggtccattgacttctcatgatagcagatctcattgtgatgaaagagtagcggatccatctgccatcggagagataagcgtcattggggaagaacatgtgtgatgtatcacatatggtggttatgagagcagtgagtcccattttgtcacttttattgcacatcatgtttcaattcttctttcaatgctatgttttgtgtgattcagtgagtcatgtatcctctctaatgtcctgcaactctgtaaatattgaacctattttttggatgcctaatgtcctacaactctgtaaatattgaacctgttttttgaatgccatgtgttagagtgcgcagcccagcccaccaactatgggccaccccaggttatattgagcctgctccaccacaggcccaaccggagctacaactttaggtcctgagcctacacaaccagaaagactagtctaatggatgaggaccgccccaccttttaagtcgtgctccctcatcatcaattaccgatgtgggattaaacacaacaatctcccccgtcacatcaaccaatgtgaccccgaagacttgttacctgagcctcgggtctaacaatctcccctgtcacatcaacccatgtgaccccgaagacttgttacctggcctccccaccatgtgacccatggaaatcgttccgggactaaacccaacaccatgaaatggaattagcaaccatggttgcattcagattcagaatcaagcaaaatttgactgcaattcacatcttttctgtttattaggcgtaaaactgaactgtatgtgaaaaaaacactttaaaacctacttggggtcgaaaactgtatactacctccgtcccagtatagttgtcgctttgagtttttgtttgtaacttttgatctttcgtcttattcaaaaaattatggaattatcatttcttttgtttatgatttgctttattatcaaaagtgctttaaatatgacttttctgtttttatatttgcactaatctgttaaataagacaaatggttaaacattacaagaaaaagttaaagcaaagtcaaagcgactaccattttgggatggaggtagtactaaattaagtagtactactaacatatagttgtagtgcagtcaagagatataatcgactcatgaaccacatgctgcaagtatgataaaaaaatcaagttgaagatgccggtaaaccctagccgccgctaccgccaccaccgagtg

SEQ ID NO: 92685 - DNA, 748 bp, Oryza sativa
gatctgtgtgactggcctggctttccacaacgcttcggagccttcctcgacagaaacgctctcctccgaacggtcggatactagagcaattaaactaaatcaacaaaacagtgcaaaaacaagcataaacagtacatgtggatatttttaacatgtagatcttgattttagaagaatttagaaacttgagccacctgagacggatctacggttatttagttatgattttccgaagttttaatctattagaaaatcgagaaaaagaaaagggaaaggagatgatgacgtcatgctgacgtcagcaatggcggccggttagggtttgcgagctcgccggagctagggcggtcgaccgggtgattggaggacacctacgcgtagaaaacatcgagacgaacccgatggtactcaccacaacgtctatcgacgaacggtgatggccggcgacgaggaggaaggcggtggcagctcggcttgacggcgacggcggagctccggtggtcggcggcgaaggaggacgggcggccgagcttcctcacctccgtgcgcacctaacggcgacaacggcaagcggcggagacggcggacgcgtcggcgcgacatggccgaaagatggccggcggcggcggcggctaaatgcacgtggcggcggcgctacggtgcacgggagaggacgagagagggggcaaacggaagaggacgacgaggggaagctttataaagcattggattgaagagatcgaactcc

SEQ ID NO: 92686 - DNA, 2191 bp, Oryza sativa
  unsure (1)..(2191): unsure at all n locations
agtcccggttggtagcaccaaccggggctaaagatcccggtgatctttagccccggttggtgctaccaaccgggactaaagtcccacccctatatatatgtcttcttcctcctccagctgcccgagtaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaagtttttataaaatagttgagaaggaaaactctagtgaaaattaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtttgttggatttgaaggaaatcaaacgggcgaggaggaaatagctgctgatggtaacgacgttgcggatgatcttggtcagatgttgcaggacgccagggaggacagcgaaagtgaaaaggaggcccataaattggacaagatgttggaggaccacagaacttcgttgtacccaagttgcgagcaggggcacaaaaagttggataccactctggagttgttgcaatggaaggcaaaaaatggggttagtgacaaggcatttggcgatttattgaaactcgtcaagaacattcttccggggggaaagaaattgcccgagacaacgtacgaggctaagaagatagtctgcccgttaggactgaaagtttcataagattcacgcatgtccgaacgattgtatcntatatcgcggtgaggagtatgagaacctagaagcatgccctgtttgcaagcactacgatacaagattagacgggacgatccaggagaagttgacgggcagctaacaaagaagagaattcctgctaaggtgatgtggtattttcctataataccacggctaaggcgtttgttcaggaacaaggggaatgctagaatgttgcgatggcacgctgaagagcgtcaacatgacgggatgctgagacactcagccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaa

SEQ ID NO: 92687 - DNA, 2001 bp, Oryza sativa
aggagaagacgttggcttataccccagttgagctgcctgtgggagtggagccggagcttcgctagattttattttccgctgcagttttcttcttggtgaggactaagtgcctcttaagtaagtatttatcgatttagttattatgatggatttgtatattaaattgtcagtttgtgtacctcggctgattcctggacgaggattttatgcacaaattagttcggaaattactagtgaatttccgggcgtgacatctaacttgatcaaacagagtaggtttagcttgtaaagcggccacaaaacctttgttgactattcccaagttcaagttttcaaattcttggcataactcccaaggtaaacgtcgaccttctgacatattacagtagcttttcctgctaagggcatcggctacaacatttgctttccccgggtgatagtggatttccatatcatagtctttaatcaattctaaccatcttcgctgacgcatgttcaagtcaggttgagtgaaaatgtacttcaaacttttatgatccgtatacatctctgtacggttaccgaaaagataatgacgccaaatcttcaatgcatgcaccacagctgccaactctaggtcatgcgtaggatagttattctcatgaggacgtaattgcctagatgcataggcaaccacctttccttcttgcatcaacacacaacccaaaccgagtcgggatgcatcacaatacacttggaaacctttcctcgaatcaggcaaaattaacacaggcgcagtcactagccttttcttcagttcttagaaactttgttcacaatcatccgtccacttgtacttcacttccttctgaagcagacgagtcattggtctggcgatctttgaaaagttctcaataaaactgcggtaatacccagcaagtccaaggaaactacgaaattctgaaaccgtcttgggttgcttccaacttaacactgactccacattgcttggatctactgccactcctccagacgagatgacatgacaaagaaacttcacttcggacaaccaaaattcacatttactgaacttggcataaagctgatgctcacgtagtttctctaaagctagacgaagatgctcttcatgttcttccttcgtcttggagtaaataagaatgtcatcaataaacaccacgacaaacttatccagatattccataaacaccttgttcatcagattcatgaaaaaggctggggcattagtgagtccaaatgacataacggtacattcgaacaaaccataccgagttgtgaaggcggtctttggtatatcttcctcacggattcgaagttgatgatatccagaacggagatctatcttggagaaaactgtagcacctttcaattgatcaaacaggtcatcaattctgggtagaggatccttattcttgatagtgacctcattcaacgctcgataatccacgcacattctctaagtatgatctttcttctccacaaagatgactggtgctccccatggcgaagtactgggtctaatgtatcctttctgaagcaaatcatccacctgtctcttcacgtcagctaactcattagctgccattctgtatggtctcttatggatagggtttgttccaggtaccaagtctatccgaaactctatgtctctcttaggtggcatacctggcaaatcctcgggaaacacgtctgggtagtcttgtactataggtatctcttgtagaacaacttggttcaaggtcacaccatgagatttaggagaggacgcaaagaaagaaacagtttccccattgctactggttaaagtcaccttacggttggcacaatctataactcctctgtgacgagataaccagtccatccctaggataacatctagatctttggattctagcaagataagcgaggatgggaaaggaacttcttctatttctatagtaacagaaggacaatactgtgtcgaaaatacttgattacctgggg

SEQ ID NO: 92688 - DNA, 947 bp, Oryza sativa
caactcttgaaaactctgctcacattctactgaccacttgtacttcacatctttctaaagcagtcgtgtcatgggcttagcaatcttggaaaaattctctataaacctccgataatatccagcgaggcctaagaaactgcgaatctctgaaattgtctttggttgtttccagttggttacggattccacattactgggatcaacggcaactcctcctgctgagatgacgtgaccaaggaatttcacttcagacaaccaaaattcatacttgctaaacttagcatgcagttgatgttctcgtagcttctccaatgcaaggcgaagatgttcttcatgctcttctttggttcgagagtagataagaatgtcatcaataaagaccaccacaaacttatctaggtattccataaacaccttattcatcaagttcatgaagaaagcaggggcattggtaagtccaaaagacataacagtacattcaaacaatccatacctagtgataaaagctatcttaggtatatcttcctctttgattctcaactagtgataccctgatcgaagatctatcttggagaaaacagtggcacctttaagctgatcaaacaaatcatcaattctgggtagcggatacttattcttgatagtcacatcatttagtgcacgatagtccacacacatcctctgggtatgatctttcttttccacaaaaataaccggagctccccatagagatgaactcggtctgatgtatcccttctgaagcaaatcatccacttgcctcttgacttctgccaactcattggctgccattctataaggtctattatggatcggagttgttccaggtaccaaatctattctgaactctatatcccttttgggcggcataccaggtaaatcatctgggaacacatcgggatactcccgaactataggaatctcttcca

SEQ ID NO: 92689 - DNA, 1147 bp, Oryza sativa
cggcgaccttcacccggaaccaaaggagaaaggaagccattacttgagtccagccagctacactcttagcaaggtagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttcaagacaatgtccgggcaacaataacaaagctatgtgcattcatgaacgcaatttcgcagaaggtcatcgatccggatagattagatgcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgctaagggttatggaacagaggaggtcatcgaattttgcgtagaatttatcgaagaccttcgcccaatcggggtacctgaatcacgccatgaagggagactacggggaaagggaactctcagaaggaaagcaattatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtcttggtcgatcgcgacattccagggatatgagatcaatgggtacacattctacacgagagcccaagacatgaagagcacgaaccaaaacagcgctgtttgtgtcgatgccatgggacacgatggaacaactgccacgtattacggtgccatcgaggacatacgggaacttgactatggtcctctcaaggttcctctgttccggtgccaatgggttaggttgactggtgga

SEQ ID NO: 92690 - DNA, 1896 bp, Oryza sativa
tagccgatgattccacaggacaaaaggtagaggagatcccggagattgtttcccctcaatcaatttcaccggaaacggaaaggaacggccggatttggaaaggaacggcggcggcagctcggcggcggcgcgctagggtttcggcccgaggaagacgacggacccacctgtcagcgactgaacgcgcgcgcgcgcgtgggcggctgcgaactgggccgacttgggccggggagagagagagaaggttttgggccgactttcggcccaaagccaaaagagaactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttcttttcaagacttttaaaattattttctagaaattccatttaaacaacaatttatataatttgaatttttagggtgtgacaaacctaccccccttaaacagaatctcgtcctcgagattcggaagaactggcgaacagatacggatgagctgacttcaattcatcttctcgttcccaagttgactcttcttccgagtgattactccactggactttgcaaaaacggataactcgattcctggtccttctctcatttgtttccaagatacggattggtttctccacataagtcagatcctcttggacttctatttgttcaagattagcttcttcggtaggtacccttaaacatttcttcaattgcgacacatggaacacattatggactcctgccaaagattgaggtaactccaactgataagcaacttctcctcttctactgacaatcttataaggtcccacaaaacgcggtgccaattttcctttggtgtgaaaacgatgaactcctcgaagaggcgtgacacgaagatacacataatctcccttaggatacaactcaaatctctgcggtgattgtcggcataactcttatgacgagactgagccacacgcaatctttcttgaatgattttcaccttttcttctgcttcccttaggatatctgtcccgaaaacctgacgttctcccgtttgatcccacaaaagcggagtgcggcacttttgaccatacagtgcttcgtacggagccatctgaagactagcttgataactgttattatacgaaaattctgcatagggtagattcttatcccaacttccaccgaaatctaaagcacaagctctgaacatgtcttccaaaatttgattcaccctttcggtttgtccgtctgtctgcggatgataagcagtactaaagttcagcttagaacccatctcttcctgaagtttcttccaaaaatttgaagtaaactgacttcctcgatcagacactatcttcttagggacgccatgcaaacacacaatccttgccatatacaattccgctaagcgacttccggaataagttgtctttaccggaatgaaatgtgccaccttggtaagtctgtcgactattacccaaatagagtcatggccagatgacgttctgggcaaaccagtgataaaatccataccgatttcttcccatttccattcaggaatcttcaaaggctgcagcaaaccggcaggtttctgatgttctgccttgactcgttgacaaacatcacatagtgctacgtattctgcgatttcacgcttcatacttgcccaccaaaatctttccttgcgatcctggtacatttttgtactaccagggtgaatagagtataaagtatcatgggcttctttcagaattgcatcttttaaatctttgttgtcggggacacaaatctctcacc

SEQ ID NO: 92691 - DNA, 1362 bp, Oryza sativa
gttacttgagtcagtcttgaccttaaagactcagaagacaatgcatgaacagttacaactcgaccatcattgctggagagagttacttttctgttggcacagtctatcatacctttatgtctagctaaccaatccatccctaggatgacatcaaggtctttggattctaacaagataagattggctagaaatggtactcccttaatttctattctgacagaggggctacgttgcaaagagagtgcttgattacttggggtactaaccatcaaaggacgtctaagatcttctacttccatcccatgatttcccgcaaaactcatagatagaaatgaatgtgtagcaccagaatcgaaaagcactgttgcaggaactgagttaacaaggaacgtacccaaaatcacatctggagcatcttgagcctctgcagctgcaacatgattgacacgagcctctgatgctggtgcggtagagttgctctggacagggacaaccttcacgcgtcggggcttcggacacttgtcagcgtaatgtcccgggtctccacagttgaaacacaccacgggcttgctaccttgctccctcttggcaggctgttgttgtgttggagctgcaacaggacgtggaacttgattgcggatgttgttgccaacattgttgttgaagaactgacgctgcggacgaacgacagacgaagaacctccatgtggcatagactggggtcctaaagtaagacgcggcctctgattattcccctgttgcgtcttgaattgagcaatctggcgtttcttctgctccatgcgattatacttgtcctcctgacgaatagccttatccactaatttctggaaatcagaataatctccagtcatgagtgggtaagaaagctcatcattaagtccttccaagaacttctcctgacgctcttcatcattgcgtacattttccggagcataacgggctagacgattgaactcgtgtagatactccgtaacagtgcgagatccctgggtaagcgacctgaactccttcttcttgagagacaccactcccgatggtatatgcgtcttccgaaaagcagcggtgaattcaagccaagtgataggttcagcagtagtcctattcagacggaagtgatcccaccattcagaggcagggccatgcaactgatgcgatgcaaatgagaccttttcctgatcagtgcactgaagcaaatccaacttcttctctatggcatgcagccaatcagcagcttcaacaggattagtggtactagagaaaataggcggcctcacacgaagaaattctgctaacttattctgaggaggtgcatggttatttccctggttctgctggttctga

SEQ ID NO: 92692 - DNA, 1166 bp, Oryza sativa
gggatttgtaccaggagttgcgtacaatgtcctttgtcattggatttgggactgcccctttttatgcccagattcctcatgatcgtcatgaagagaggtgccgagtcaaagtcactttgaacagtagtagtgaagatattccatcggtgatgttcgaagctggaggaagaaactatatccacgcatgtcaggaggtggcaaggatcgccataggagagctccgtgatcgctacagtgatcagttggccgacactgagtatcgttaccatccccgccaaccccaggggagtgaccgtggcagttaccttgagactgaaggaattgagaatgatgttaccaccagacatttggttgagatgctgtgggctatggatgaaagtcgtgcggagactgtgttagtagctcaagatcgtgaagattggaatcgtggtaagatttgcaagctagaagacaaggtggatcgtttggagaaggaactagccgcgttgaagggagaagcaccgccgcagaaggccaagattcgtcttaccgcaaggaagagagctttatttgtcccacgctatcaattggcgccaaaggtccgtgtggtggagaaagaagtagccccagcggatcctccggtcgtcaatgtaagtgatgatgaaggagaagaatcgaagcgcacccattccaagatcgagtggggagcaactcaagatgatgaagacgagccgaacgagccttcaatcaactccgatgctcggaagaactagagtgccttgttaagccgttgtcttagatcgttgtgttagtttgcttgttttaaatttgcttgtgtgggtcttgcatgtgatttacatcagtgatgggatgtaagtgcatgcgtttgtttgtttttttttttgagtgttaggaagttggtgagtttagtgttgtgagagtcttcagtttgtaataatgaaactcagttaagatcaataaaagttaaagtaattccctgtcctaagtagtttttccccggttcctcttcttgtgccctgtccatgccagatggtgaacactcgcagcaacgggaatggtcccaacctcaacaaccccaataacaacaacaatggagagaatccaacccttgctcaagttcttgcacaacagactcagttaatgaacatgatgatgcagcaacttca

SEQ ID NO: 92693 - DNA, 2859 bp, Oryza sativa
atttctgcttgatggcttgaaggctccaattattgcgtttaggttctttctctgtgtgacaatccatctctcatagacagagacgaagctcgtgcattattcaggttggaccaaatagacaaacagtataaccttactttccctatgtaatttccaaagttttagctttgtacagtctttttcccactatattcaatgaaatgggcacagtctggtgccgattcgttttaaaaaaaacttagcatgtgctctctccatttgatattgtaagacatttttattttttttctaagtcatttttttaagaacattaaccaagtttatgaaaaaaatgtgatagcattttcaacacaatatagatatagtatcaaaatatattcaatgctagatttagtgaaactaatttggtgtttgtagatgttgctatgtttttctatgatatggttaaacttaaggaagtttgatttttaaaaaagtcaaaatgtctcataatataaaacggagggaatatatatcaagcattgcaaattattttcacttcttgtgtggcaataaatttttggcctaaaaagaaaatgactgacattctttcgatctacaaatgcagtccatgtgcgctaaaacgagccaggaagattattgaatcacttccaggcagagattctggttcctatactagtagtcaggtactgtaaatacatgctccttatttacaaataacaaaaaaaaagttttttacttggcgttgtcctaggatgatttttaacctttttcattgtgcattacacttgttattacatatatcagggagtcagaggtttgcgtgaagcagttgctgatggaatagctgccagagatggttttccatcaaaaccagataacatttttctgacagatggagcaagttcagcagtaatgctctgcatttccaagctccattagtacagaatgatgcttggtctatctggatatcttcaacttaattaccctcctttttcagatcaacatgatgatgcaaatactcatcaggtcccatgaagatggcattttgtgcccgctgcctgaatatcccttatactctgcttctattattcttcatggtggaacaatggtacggtgctagcatttggatttttcgagaaagtgtccattgatatgccaatggtatctcaaacttccaataacaacttggagtatcatgccaaaaaaaaaaaaacacggagggctaacctcaccttatacagttctttttcctttttttaatgtttcttccctatttcttattttatttcccttttgccttttcgcagtctctttttgaactctttgactcaccatcattacaatggttataagttagagtatgcaccttttccacgtccgaaaaacacttccaagtggatgaatgttcaagtgttattatatgcaagaaataacgaaggatctaaattgaattgaaggtaccgtataatcttactgaagacagtatttgggggcttgagattttcgaagtcaagaggtgtttagaggacgcccgtgcatcgggtttgactattagagctatggtggtcataaatcccggcaatcctactggccaggtgtgctgaatattttttattttatcttacagtttcatgacttgatagaataatgaaggaaaatcaaaagatttctcgagaattactgcaacctatatcctatatagcaccacataatgctagtaagtatctaactgttattcaggtcattaaagaagtttcttgttccacatttgcaacccttgttgtaggtactgtctataaccaaccaggaggagattgtggaattctgtaggaaagaagggttggttattcttgctgatgaggttcacacttgctgattgtttgatatttcaaattagattcatcgtgttgaaaaaaaaaactcggttatatcgaaggtaattgtcttgcagattagtgatgtaaatgcatttacaggtataccaagaaaatgtctatacagagaataagaggttcaattccttcaaaaaggtggccagatcacttggttatgatcaccatgacctctctatagtgtcatttcactcggtctctatgggtaagtcttcatgtcaaccagagtatcttccaaaaatttgtcttctgatttctgaattttgcaggatactatggagaatgtggtagaaggggaggctacatggagatttgtggttttggagatgatgtgatcgatgagatgtacaagttggcttctctaactatttgtcccaacatagctggccaaatccttatcagccttgttatggatccacctaaggtttcctaaaagatgctttcgctacaattttcgtctttagcatattagtatcttcacaatctggttgtacaatagaagtactttgacggaggtttgctgaacttttttatccttgtgaagttctcccttgactcttgcctataaaatttaagaaacagaatgttttttttagtttataggagaaccatagagaacttattacaccttacaccttcaaacttgtgttttaactgacttgtgggtgagatttgcagctaggggatgaggcttttgagattttcatggtcgagaaggaagagacttattcatctctactcaagcgcgcaaaggtcaggaacaaaatacacatatcagcaaatttatatcagatatatccaatttgcatcacacaatgtcaaaaaccagaatttgtgtgctagaaaaaaaatcctcttctcccaccatgattaacccgcgtgtgtcatggtttgaaacttcgtttcgaaatttccgaaatttcggtaatccccccccccccccaccggcaagctcatatctcgc

SEQ ID NO: 92694 - DNA, 2120 bp, Oryza sativa
cctttttgtctcaagctggtgcatgcatttgcctgactaggatttggtctcctcctgcaaaaaggtttccgggacattgcacatccggtgcaccatcctccccggcgaggagacgatcacggcgatggttcccagccttcaggcgttccatgaggcgttcatggacgagtttcgcggctgatcgattgagctttgtgaagcaacagaatttggcagatcacaagatcggcagctgtgccatgccttgagttacacaggagatacagctagcggagctgttgcttgtcgtctggcttgcttagcttcctgtttgtgtaatgtccatcggtccattggactccatgcatgtgtgccgtattataactgcaagtgcgttttagttatgcgcctatatgcaaaactcgtggaattggtgttagtgtttgatcagtttgttactatgatgtaaggagttatcagactacgatctagtactgtatggctgtaataatcaagtaatcaactaccccttgagggacaagtcctatttgtattgtattacaccttagtccactgtgtgtacaggctaaaatgggttggattaattccgaaaaaaaagaactactccttccctccctttagtcagatagtaaaataaatatgactattaatcaattttaaaacacttagtttaaaaacaaacaaactgatgtgaattaatcgtttaaagcacttgcatagcaccataaactttgtccaaaaaataaatattgtcctaagaccagagaaaaaatcgaacgtagtaccattccctctccgcataaccaaaaacagaaatgtttacatttttaaatggttggaatgtacttttatcagaggatgtaatacaatatcacggaattattgtattttaaagaatgaaataaggctctatttatcagttagtgtcaacaacaacaaaaaaagcctgagtgcaaattaagcacaatccttgtgtcaggagaaacaggagatacaaccaaaacatatatcaacaggctcttaacttaatttgaccagctaccgtagtagcttagctgtgttgtcagttgttacattctatataaaacttaagcttcctacgctgaaccaaattaatagggtaatacagatcacaacactacacaccttcctctctctatcagcagcctgcctattctctactctactgggctcttctccccgaaacacagggcaaaaaagaagaaaggaaaactaaacatttcgtgatacagacactgtattcgcaaagccattagctaccttttggggaggaggtttcttcttatagtttgctagactacagtgagggcagatgtattccagcccatctgtctttgcataatcctgtaaagaaggtgactcatataagatcaagctatggccaatagaaaaggactgaactaaaagttttttttttctaaccttgaaagtgcctaggccttgtcgtctgtcacaaccaaaatgtgcccattcaccacacaaaccacagttcacccaatctccaggagcgctactggaattacacaggagatggtgttagattcgattatgacaaaccataatcgcaaattggggaaccaaaggaggcatagaaagggatgtcctcaaacctgtggcaaagcaaacagcattccccgtctacatcatcatgagctagctcatattccagtaaatatgtttcgtaatgtcttttcagtgtgtttccaacaccctaaacattttaggacaaatgtgtacagttaacatttaacatttcacttaacagaatttgttgaaggtagtagcagagataaataaggtggcactttatgatgaatttacatcaaaatgaactactactccgtatatatatttcaacatagatgaaagacaatgatgctgaagctgagtagtccatcaattagttagtagcttttaccagactcaccaacaaaggaaatgataaatttaatacgtgaaagtagtgtgaacaaaatggcataaagacatatgttagtggcactaagataacagcaaaactatagcatgctaaaagtggcacaggttaagatccaataagaaaatgccttcaaggttacgcattctatttgtcacagtag

SEQ ID NO: 92695 - DNA, 2460 bp, Oryza sativa
aagttaaattgtctaaatgttcttttgctcaacatcaattgtcatatttaggtcatattatcagtgatcaaggagtcactactgatcctgctaagattgaggaagtggttaattaggcagttccaaaatctgtcaaaaagctcaggggatttttgggtttggcaggttattataggaagtttgtcaagcaatttgggatcctttgcaggcctttgaccaacctgttaaagaaggatgttccttttgtctggtctgtggaggctgatcaggctttcaaggctcttaagcaagctttggtatctgctcctgtgttatctcttcctgatttttctttgcctttcactgttgagactgatgctagtgatgaaggtattggtgttgtgttatctcagcatggtcatccgattgcctttcttagtaaggccttggggggttaaaactaagggtctttccacttatgaaaaggagtatttggctattttattagctgtggaccattggagatcttacctgcagcagcaagagtttgtcattttaactgatcaccatagtttaatgcacttgaatgaacaaaggctgcacaccccttggcaacacaaagcttttactaagttgttgggccttcagtttaagatttgctacaggaagggatccagtaatgctgcagctgatgcactttcttgaagagttatctgaactacatgtggtttccagttgcagtcctgtatggcttcaggaggtttctgatggttatcttcaagatgccttttctactcaacttttgactgacttgactcttaatgctgagtctcggcccaatttttctttgtgtaatggtgtccttcgctttaaaggcaaagtctggataggtaacaatccatctgtgcaggataagattatctctgcgttgcacagtagtcctttgggggggcactctggttttcctgttacttatagtaaaatcaagtctctttttgcttggcccaagatgaagaaacagattcatactactgtcaagacatgtggtatttgcatgcaggccaaaccagatcgctctaaataccctggtcttcttcagccccttcctgtccctgatggtgcatggcagattatcaccatggactttattgaaggtttgcctaagtctggtcaattcaactgtattttagtggtggttgacaagttttccaagtactctcatttccttccattgtcccatcctttttctgctattgatgtggctcaatcttttatggtcaatgtttacaagttacatgggttacctaagttcatcatttcagaccgcgacaagatttttactagccacttttgggagcagttgtttttgagatccagcacacaattgcaactaagcaccgcttatcacccctagacagacggacaaactgagcgtgtgaaccaatgtttggaaatatatctgcgatgttttgttcatgctgttcctcataaatggagttcttggttgtatttagcagaattttggtttaacacttcttaccattctgccattcttcagtctccatttgaagctctctatggctatcctcctggtcattttggtataagggatgatgcctgctcagtacctgatttgcatgagtggttaaatgaacgtaaggtgatgactcagttactgaaacaacacctgaatcgtgcccagcaacaaatgaagctgtatgcagacaaaaagcgcagtttcagagaattttctgatggagattgggtctacttgaaattgcaaccttatattcagtcctctgtggcaaaaagagcaaatcataaactatcattccgttattttggtccttttcaagttttacatcgggtgggcaaggtggcttataagttgtctcttcctgcagagagctccattcaccctgtttttcatgtttcacagcttaagcatgctgttgggttcaggcattctgttcaaccgtgtttgcctgcatgttctgaccttaaagtttcagtggttatcttggcttctcgtcagatcaggaaaggtaactctgtgaaagctcaagttttaattcggtggtctagaaatgttgcaggacaggaaacttgggaggatcaagttgagttgtgtcagcgttttcctaatgccttggcttggggtcaagccacttctcaaggagagggggttgtcagcagcacagctataccggatgagctacagaacactgtcaagaccaaggaggttaagcagactaaggaaggaagacctgttaggcaccgagtatgtaatcctagagtgagtgggccggaatgggccatatgagcaccatgtccaggctgtcgatagttgcgtgtgagagagagagcatcttaaaactaactctgtattcatttggatgagttgaggatgaactacgcggcgaaggcggcggcggcatcaaccctgtcgggttggtgaaatccatctgtgtgtgtgtatcg

SEQ ID NO: 92696 - DNA, 3088 bp, Oryza sativa
atagtgatccatgtgttcggtgctcatgggtcaccatccactaattaatctttcggtccgcacaaattactacttcctccgtttcatattataagactttctaacgttactcacattcatatatatgttaatgaatctagacatatatgtgtgcctagatttataaacatatatatgaatatgggcaatgttagaaagtcttataacctgaaacggagagagtactactagtctctccatttcaaaataaatgatatgcccatattattagtagagattaagatgtaagaagaaaataatatagcgtttcttattaaatatgatgtactaattgttggtgaaagggtggttaaagataatataatgataaatttaataacaagtaattgatgggaccaatactacttaaaatagcactatttttttaaaaaaattaaatcctaaataaacaccaattttggggctgaaagagtagacacagcatagaaaagaaaacgaacttttcaattgctaatcaatggttgaaccgaaggggaatttttttttaaaaaagttgtccgatctgtttcgttgcaacatccagaatttatcagctactaaagactaaagagtaaccaacattgttggtttcttatcgtaactcatcctaacttattgattaaatatggagaacacacattttttaaataaaaactactaacactatcagcctacacacaaacccctataacacattttttttccaagggactcctaaaatgttgagaacatatatactcccaccattctcttttatgtgacctccaactccaaactaaaaaaacataggtataaatcagcagctaagatagataaagcacacacacataacagaatccaacacatctaataaatgtctcaattcaaagatgatacaatccgaaaccatccaaccatctatgtctttctttccaacttttcccagcaacccgctggaagcgaaaagaagcaaattgcacagatccacacatcattcaaccacgatcgatgaattaaaccgctaagaaatccaggtaaattcgattaagtaatctagtcgaccgacggatcaaactttaaattaaggaaatagtttggtttagcgaccagtaaacgcatgcagaatctgctgggggcagcagctaatgttcgacattgtccatgcatgcatcagcctccagcttagctccttcttcctcggcgccggcgacggcgagatcgattctgcaggtgatcagggcaccagaacgacgccgagattgtcgaggcactggcatttctccttcccctccagcaccgctcctatctggagcccacaaaggtagcagaagaccatgcggcaccttcaaaataaaccgcttgttaattaaataaaaaatgtatgatatgtgtgttagccacactaatacacacacaaacatatacacaaatctgaattatgataacgcatatacataaaagtctattgctccatgtaatctggcaaaatcgtattcccattaaatatataaacatacacctctgtaaaaatcttcacagcaagtttttgaattcaatgtgcttccatatcttggttcatattcaaatctacgccattgaacccccactaaagccattgaacgccagtttacttactacaattaccactcaaaagttcatttaacctggagaaacatcctaatgtgtacgctaaaaccatatcaaaccaaaactatcaagtataatgaaacggattgagagttggagggagtaaatatatatacaccactgtacaaagatgtaattatcattaaacacgagttataccaaacttctaccatggtaaaaatgtttcccaagcatttaatggtgcaaacggaaaaacaaaggaaccaaatatggattagacacaaactaaagcatgtcctaccttgcaatgtaacccaatatatgttgttaacactttctccctacgaaaatgttggataacgaatctacagacaagttcaaacatgaaaaaacaaatgtcccccctataaaaagttagaggacgaatctacaaacacattcaaagatgatacaatcagatgctttgttttttaaaaaccagatgagtgatgtgcaccaaaccgtatacgctatatattactccctccgttttaaaatgtttgacaccgttgactttttagcacatgtttgaccgttcgtcttatattaaaaaaaattgtgaaatatgtaaaactatatgtgtacatgaaagtatatttaacaatgaatcaaattatatgaaaaaaataaataattacttaaattttttgaataagacaaatggtcaaatacgtactgaaaagtcaacggtgtcaaacattttgaaacggagggagtaacaaaacttctgccaacaacatactactttaaaaaaagcgccttgacaaccaaagaaaaacttgacgtcgaataattaagaagaataattaaaaccatatatttgtgctctctatgctatctagcacatagtactaaccacgtattttaactccctatgctatcgaacgcatctcaaactatatgtgggagatacattttctccaaattatgtactacattttcctcaaaaaaaattgtgtaactacatttgaaatgctcgtgatggattaaatagagtaatgaagcaaatgcaagaacctatgaaatgctcatgatggatcataataaatagtagaataatgaagcaaatgcaacaacacaagaagtgaaatgaagtagacagggaggtgagcacagtagtgaagtgagttgagtacctgcaactcatgaccctgcagccggctgtcctctcaaccagcatcctgcatttggggcacgccttccaccgccgctcgtcggcgagcttcttcaccatggcggcctcgggccccttggagcagtcccggtggtcggcgtcgtccgccgtgctccactccccgccgcacgtcgcgcacagcaggtgctggcacgccgggcacgccgccatggccggctccgcctcgccgctggtctccagcaggatcccgcaccggcggttggggcagtacgcccgccggtcgtgcgg

SEQ ID NO: 92697 - DNA, 680 bp, Oryza sativa
ccctttcccgtctccggatactcatgagattgtggtcttctcgcatttcttctacggcggctttgctcttccgacctcaaaatttttccgcgggatcttgaatttctatggaatcagcttgcatcacctaaacccgaattccatagtgcatatcgccaatttcgtccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctacgttcagaatcccgagcctgctcttcccgggtactcttgtcttcctccagtgtaccaagatacttggaactctcttccaatcggagatgaagcagtacaagccttggagttgttggatcgtatgttaaatcttaaagaacaaggcttacagggagagcagatcactcggcacttcatcaaatgccgactggcgccaatcaaggaaagatcccgcccagcattcgagttcgacggcaaacatgatcccaatcgtgaagaaccagactccctggatttcaaaatcatgaaagagaggatgtataaaacttctcaaa

SEQ ID NO: 92698 - DNA, 792 bp, Oryza sativa
agatgctcatcataaatgtgttttgcagatcgcaagatcaaatctcaagctcagtttgacgtcctggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctagcatggccttggcgatgacaaaatccttgtacccgagaattgaagtcgacaccattgatggatttgcagacgggacaagtgaagaagctgcccttgatcttatcagcagtgcgcaaaatgcggctgacaaaattgcgagtgatgttgtagagcaatttcgcaacaacgacctccagccgagtaatgaagactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaagaagctattaaaaactttcagtcctcgcaaactaagtagaaaaaccaaacaaggcaatgataaaccaagtaagcaaactgaattgataaaaaatcacactccattattatgataatagcccccgactgacaacttaaaggagaaaacttgatgtttgacagtccaaatagggaaatacaatgataaa

SEQ ID NO: 92699 - DNA, 1529 bp, Oryza sativa
ccctatatccatccattgaacaagctctggatgaagaagaaatcggagaagacgttgatcaagccgcagccgaagtaagcgatactgacaacaccatcagcttcacctaagcagacccctccaactccttctgctccaactccctttacaagagtaagcacccttctttaactatttttgtaatcatctcactttatggccgattcctcacatactcggtaattgcagaaaaggaaggctgctgtaaagaagaaatcgactccaatgacatctaaaccagctccaccggtacaataatcttacttcttttattaattaatgtcagccgattttatataacacttgtttattttcagcctcattcccctcctattcaacaagcatcaagcgatcgaaccccatcagctgtagggagtcatcacatagaagaagaagttcaaccaattgctccggctattccagtaaattacttataactaacatatgcagatcggctatgcctgtttgatctctaaccctcttcaaatcattactgcaggtcttagccgatcttttctcctttgatatcagagattatcttgatgaggagatagaggatgacactactagcaaagctttagctcctttgtctgacgacgtgaagaaaattcttgaagatatttctcatcggctagagacatcatcactagacagcctagtagtcgactgtggatcaatcaggacttggcttcatgaagtccaggctcaaatctcagatgagttagccggtatccttactccagctgtttatcttgaacaacatcaatttaagctggaaaagtctaagctaagattagccgagcgtcgagagcgcaaagacattgaagcaacaatccaggccactcgacaacttgttcatgaagaaaaagccaagctcgatcaattatctgaaggcccgatcaaatccaatattgactggcttgaagctcgcaagattgaactcttagcacaacttcaagaatgcaatgccgaactggatttagagcacaagaagttagccgatctcccgcagtcgatcgaagaacaaaaagcaaagttaaaatcagctatcaagaatgttgctgattgtcacgcccagaaattcccgaataggattccaagcagaatgtgtattaaaacccccgtccaggaccagccggggtacacaaacgacaatgttgacatacagatccacgtcttacaaacatcataaaggtcttacagaaatgcagtggaaaacaaaagaaactggagctaagccttgacttgaactgcagcgggaacaccactccacaggcatcctcgacggcacggacgaagcctactcctcagggaaaccttcatctgacacatacccgtcctctggggttgggaaaagtagagcaagactgagtactacccactgtactcagcaagtcataccggaataggggtatgatgcagggaattaacaagaagagctagagtggttcatttgcataaaaactggcatttataaacaggaattgaat

SEQ ID NO: 92700 - DNA, 3938 bp, Oryza sativa
atttcgacatgtagaactcaagaaaaattccacatgtcaatccgattattgtttgcattgtttcttagggttttatcatgatttcctctgcattttcttggggtcatttgtaaattacaattttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaaccgggtgaccttgtttctggttctcctttcactggtatcaagtatgcgaaccggcttctccacatatgtcaggtcctcctggatatcaatgtgttccgaatcagcctgttcttcgggtacccttaaacacttctttaattgggacacgtggaacacgtcatggatgccgatcatattggatggaagttctagctgataagcaacttctccccttcgttccaagattttgtatggtcccacgaagcgtggtgccaacttgccttttgtctgaaagcggtgtactccccggagcggggtgacacgaagatacacgtaatctcctgcctcaaaagtgagctcccttcggcggttatccgcgtagctcttctgtcgagactgagcaattctcaacctttccctgatgattctgactttctcttctgcttccgctaatacttccgttccgaacagttgacgttcgcctgtctgatcccagaaaagaggtgtgcggcacttccggccgtatagagcttcaaacggtgccatctgtagactggcctggtagctgttgttatacgagaattccgcatatggtaagcttttgtcccaagctccaccaaaatcaagagcgcaagctcttaacatatcttccaggatttgattgactcgctcggtctgaccatcagtttgcgggtgataggccgtgctgaaattcaaacgggtccccaattcttcctgcagcttctgccagaactttgaggtgaactgactacctcggtcggatactatcttcttgggtaccccatgcaaacacatgatccttgcgagatacaattctgccaatctctttcccgtataggtggtatgtactggtataaagtgagccaccttggtgagtcggtccacgactacccagattgaatcatgtcccgatgatgtccggggcagtcccgttataaagtccattccaatctcctcccatttccattccgggatttgaagaggttggagtaaacctgctggtctttggtgctctgctttcactcgctggcaaacatcgcagagtgcgacgaattcagctatttctctcctcatgctgacccaccaaaacttctctttgaggtcttgatacattttagtgctgcctggatgaatggagtactgggtctgatgagcttcggtgagtatcagatccttcaattccttgtcgtccggtacacacaatctttctcccatccagattgtgccatgctcatcctcaaggaaatcccgagcctttccgactctcatgttctttttcagttctgctatttccggatcatttacttgagcggctctaacttgatccacgagcgtaggccgtgcctccagagcggctacgaacccgtgttcaacaattcccatgttgagatgttcaagctcctgtcgcaattcctcacacatgtcctcgatgcatagagcagtgcagtaacttttccggcttaaagcgtctgccaccacattggctttacccgggtggtagtgaatactcatgtcatagtctttgattagttccaaccatcttcgttgtcgaaggtttaggtctggttgggtgaagatgtatttcagactcttatggtccgtatatacttcgcagcggttgccaatcagatagtgcctccagatcttcaaagcatgaaccactgctgccaattccaagtcatgagttggataatttccttcgtgtggacgcaactgccgcgaggcatatgcaaccactctgccctcttgcattaggacacatccaagtccgtgacgggatgcatcgcaatagacttggaagtctttcgtctggtcgggcaggatcaaaaccggtgcggatactaatttccttttgagctcctcaaagttcttgtcgcactcagctgtccatttaaacttctcgtctttcttaagcaactgagtcatgggtcgggcgattcttgagaagttttcgatgaaacgacggtaataaccagccagtcctagaaaacttcgaatctgcgacactgtcttcggtggggtccacttggtaaccgactccacgttcgatggatcaactgctacaccctggggctgtaatgacatggcccagaaatttgacttccgtcaaccagaagtcacacttgctgaacttggcgtatagctggtgctccttcaacttttcgagtaccaaacggagatgttgctcatgttcttcctcggattttgagtagataagtatgtcgtcgatgaacaccacaacaaacttgtccagaaattccatgaacactttgttcatcagattcatgaagaatgcgggtgcgttagtaagtccgaaggacataaccgtacactcatatagcccgtaccgagtggtgaaggccgtcttgggaatatcctcttcccggattctcaaatggtggtagcctgatcgcaggtctatcttatagaacactttagctcctttcagttgatcaaataaatcgtcgattcgcggcaaaggatatttattcttgattgtgacctcgttaagtgcgcgataatcgacgcacatcctctttgtcttatcctttttatccacaaaaatgaccggagcgccccaaggtgaagtgcttggtcgtatgtaccctttctgcagctgttcatcaacttgcttcttgacctccgctaattcgttgagccgccattctatacggtctcttatagattggagcggttcctggtgccaaatcaatccggaattcaatctccctcttgggtggcatggtggtgaggtcttcggggaacacctctggatactcgcagactatgggtatgtcctccaattttctcaagttcttctattcggtgtccactgggatttccgtctcaatctgattcaacgaggctcctttctttggcgagactagagatttgtacaccacggtttctcctttctcattggtcagggtgactgtgcgattcgcacaatcgatgactcccttaaacttggtcagccaatccatcccaagaatgacatctaggtctttggattcgagaaggatgaggttggctagaaacggtgacctttgaatttctattgttatagaagggctgaattgaaccgaagtggagctattccctggggtatgaacccgcatcggtgtgctaagttcctctcttattaacccatgcatcccgacaaatttcttggagatgaaagaatgcgttgcaccagaatcaaaaagtactgttgcagggattgagttaacaggaaacgtacccagtacgacctctggtgctgcttgtgcctcctccgcagatgcgtggttgacacgagcctggataaaccttggtccggcacgcctgggcttcgggcatttgtcagcgaagtggccaagctcgccacagttgaagcaggaccctggttttgctcccgtctccttcttggcttgtgcgggctggcctgactgtgccggtgccattggtgggcgtggagctgcaccgcggttgggctggcctccatggtggttctgactgccactagtgccctgatggaagttgctagggttgaacgggcggtgctggcggacgatcatggtggtaggtccaccctgctgtccgggagtgaagcgcggtcggtgctgactaccttggttggaccggaactgcgccgcctttcttt

SEQ ID NO: 92701 - DNA, 1829 bp, Oryza sativa
  unsure (1)..(1829): unsure at all n locations
gattgattgccccagccgccccatcaagttgaccaatgcaaaagaagaggtggtaaccttccagtctccagtgccgcggaagccagggattagtttaaaccaggctgctggtgaagaacaagaggtagcagtggagaaaaccactaagaagctggaggatattcccatagtcagagagtatccagaggtttttccggacgatctgacaacaatgccaccaaaaagggatatcgagttccggattgacttggtacctggaactgcaccgatccacaagaggccttacagaatgggagccaacgagttggcggaagtcaagaagcaagtgatgaacagttacagaagggatacatccgcccgagcacgtcgccttggggttctccggttatctttgtggagaagaaagacaaaaccaagaggatgtgnncgttgactaccgcgcanctcaatgaggtcanccatcaagaaacaagtatcctttgccaaggattgatgatctgtttgatcagttgataggagctactgtgttctctaagatagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatactaatctactccaagtccgaggaagaacatgagcagcatcttcgactggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaagtggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattggccgcagtcgttcatgctttaaagatttggtggcactatctcatcagtaaccgttgtgaggtatatacagatcaccaaagtctaaagtacatcttcacccaacctgatctgaattttcgacagcgaaaatgggtggagcttattaaaaaatatgatttgggaatacactatcatcccggcaaggcttatggggtagcaaatcccttgaccagaaaaagtaactgcaccgtccattggttaaaggaactatgctgtgaagttccacatgaattggaacatttgaaccttggtatagttgagcacggattcgtggctgccctagaggcacagcccacactggtggagcaggttcgcatagctcaagcaagtgatcctgaaatagcagagctcaaaaagaacatgagggtcggaaaagcccgaggttttgttgaggatgaaagaggaacaatctggatgggaaaaagattgtgtgtacccgaaaacaaggaattaaaagacctgatactaaaccgaggctcatcaaactcaatattccattca

SEQ ID NO: 92702 - DNA, 1361 bp, Oryza sativa
gttccattttaatcggttaaaattatttccaaggttttgaaaattccactaaaaatcctgttaatatattgtgacatgtagaatccaaaaaaaaattccacatgccgattgtgattattatttgcatttattaattagggaattagctctaggttaattaagataatttcttcggacgatttatttagccaatttttaaagcaagcaaaggggggaaaacttcagggcgtgacaaacctaccccccttaaacggaatctcgaccccgagattcggaagagctggcgaaaaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaatccgatatggtcccacaaagcgtggtgccaactttcctttggtttggaagcgatgtactcccctgagcggagtgacacggagatacacataatcccctacttggaaaacgagctcccttcggcggttgtctgcatagcttttctgccgagactgcgcgattctcaatctttccctaacagctctgactttctcttctgcctcatttaaaacttctgtaccaaacaactggcgttcccctgtctgatcccagaagagcggagtacgacaccttcgtccatacagtgcttcaaatggtgccatctgcagactagcttggtaactgttgttgtacgagaactcagcatacggtaagcttttgtcccatgctccaccaaagtcaagcgcacaggctctcaacatatcctctagtatttggttgacccgctcggtctggccgtctgtttgtggatggtaagcagtgctgaaattcaaccgggttcccaattcttcttgtaatttctgccagaactttgaagtgaattggcttcctcgatcagacacgatcttcttaggtacaccatgtaaacacatgattcttgctagatagagttctgctaatttctttcctgagtaggtagtgtgcaccggaatgaagtgagccactttggtgagtcggtcaacgactacccaaatagaatcatgccccgatgacgtcctgggcaaccggtgatgaaatccattccgatttcttcccacttccattgtggaatatgaagtggctg

SEQ ID NO: 92703 - DNA, 1788 bp, Oryza sativa
gcagatactaaccttttcttgagttcttcaaaactttggttgcactcagctgaccacttgaatttttcatctttctttagcaactgtgtcatgggtctggcaatctttgagaaatcttcgatgaacgacgtttaataacccgcaagtccaagaaaactctggatctgagaaactgtctttggtggggtccacttagtaactgactccacatttgatggatccactaccatgccttgagcagaaatgacgtgacccagaaatttgacttccgataactagaagtcacacttactgaacttggcatataattggtgctccttcaatttctcgagtaccagacggagatgttgctgatgttcttcttttgactttgaatagatgagtatgtcgtcaatgaacaccacgacaaacttgtccaaaaattccataaacactttgttcatcaagttcatgaagaaggccggtgcgttggtgagtctgaatgacataactgtgcattcaaacaacctataccgagtggtgaaagctgtcttggcaatatcctcttcccgaattctcaactggtgatagcctgatcgcaggtctatcttggaaaacactttagcttcttttaactgatcaaacaggtcatcaattcttggcaatggatatttgttcttgattgtgacctcattacgggcgcgataatcaacgcacatcctcttggtcttgtctttcttctccacaaagataaccggagcaccccaaggtgaagtacttgatcggatgtaccctttctgcagctgttcatcaacctgcttcttgacctttgctagctcattagctgccattctgtacggactcttgtagatcagagcagttccgggtgccaaatcaatccggaactcgatttctctctttagtggcattgtagagaggtcttcaggaaacacctcagtatactcttgtactataggaatatcctccaattcctttagacttttcttcactatttctgtctgatcctcaattgcagcctgattcagacttgctacagactcctgcgacactggagaaaggaaggtgatcttttcccctttgtcgttggttagggtgatggtgcgacttgcatagtcaatcacccccttgtgtctggtcaaccaatccattccgagaatgacatctaggtctttggattcgagaaggatgagattggatagaaattgtgaccttttgatctctatagacattgaggggcagtagtgtgcggtgttcatgtcatctccaggggtatgaacccgcattggtattttaagttccactacggataatccatgtgtcccagcaaacttcttggaaatgaaagaatacgaggcacccgaatcaaaaagaactgttgccgggtgtgagttgacaggaaatgtgcccagcatgacctctggtgctgcctgtgcctcctctgcagacgcatgattgacccgggcctgaacgaacctaggtctagcgcgcttcagcttcggacacttgccagcaaagtggtcatacttgccatagttgaagtagggtcctggctttcttgcagactccttcttgagctgttttggctgagctgacacagctggcagttctgactgagccggtgccattaatgggtggggagttgagttgtcgttgccctgctcacttctgtaatgactgccaccattgtagtcgttgttgaagttactcgggtagtagggacggtgctgtcagacgatcagggtggaaggcccaccctgttgtcccatcatgaagcgaggcttctgatcg

SEQ ID NO: 92704 - DNA, 4812 bp, Oryza sativa
caactattatctgtgctctgaaaattccactaaaatttgagggctccttttagaccaaggagaatttaacaaaaattctccgggccacatttgaatttttcttgtacgtattttaaggtttgccaatttcttttcgaattttaattaattctattattccttttagaagatgatttttattttgggatgaatttatcagggcgtgacaaatccaccccccttacaagaatctcgtccccgagattcgaggaggctagcaagaggataggttgggcggtcttctcttcttgtctgacttcttccgttgcgtcttgacaaacttccagcaaaactttaccactcggaactgcttggcttgacctcctgttgcggatggaatcttctcttcacctgacttggaccagggtgcaccttttggctgactcagactaggttgcggtagttcagtgatgcttccgttccagaacttctcatgattcatatcttcggagtcaacctcggacaagttatcaacttcatgtcatgcgtcaacactagcttgtcattactaggatactatgtttgtcatcataagaatatcatgcttgttattcacttctaacttgccatcaactgtctcatattagctttcctggtctccggtgctaggtacttcggctattcgatgcaagggtcaaccactctaactataagttatgcttcccaagagaaccaatttatcccacttgacatacttcgacgtcttctccaatggctttattgctggatttgttattgtctaatcattatcctgccaaatctgaggcttcgctgttacatgtgattttaaactgacctctgcagactatcttcgaacatatcacttggttcataactgggaatagctcccacgaacaagcaactcagattcactttctttatgttcagtttactttccgctattctcttcatgttgtcatcagttagcactcaacgtattcctttacacctttaaccttgatgagttctttcccgttggatcatctcccaggacgtggcgtcgcctggtaaccggtgcttgcatttttcactccgtgtagcatctgataccgagtggaagatttcactctttgccttcatagaaacacttttacctaggtcatcttgctgacttaatgacaaggtgactgttgcggggcaattacaatcaggggtcttccttgagcgatgcagagcatgtttctgtttatcaatcacctttcggcctacttctttcatgctagagaacatctttgccaatctctttttatcaatcatctttcggcttatctctaacaggtggtattctttaatgtggattgcggacgcttctggggacgatgaggtcctttggcttgctgcctttcagtgaaaccttgatgtggttcgtcaaaaagctgcactgactaccttcagggaaatacattgcttgctatctgtatctatgccactagggtttagtgcttcctcgagatggggagcatccatattgttcttctgccatatcacctttgaccgttttctgatacctgatcgactaattaccaaccatcgactattatgttctagaatattgatgtcttcctggatcttcttaactgtttgcaggtatatccgaacctttcaatgtagaggcatggcgggtacacttatgggtttcattcaacaatccttatcttgatctgtaacaggcgtatccaaactcctgttccccaactactgtctcattggctttttaacccaacacagtttaattggttttcttttccatcaacaggttggttattaactcgaggttagaacatagttcctttgaaatgagaccctaggtctcctttatcagtaagcaattatacacataatcacatattcgcatcttccaaaagaatcctcatggaacttgtctgtattacacatttctccctcattacatgaatatgaggcactgccttaaacaaaaagggacggtgcttaacatcggtacattgtatcctcaacatgaatcatccataagcatagcaagctcactgtttatagacatgaatatatttatgtattgcattattgctgcaaactttcgattacaccatgataagtagcgaactgaaaaccacaaacatggctgctcattttgattccggagagatatagctggcattgttctagtgactgcatccttgattggttctgtgatgatgtgataggactgcataatgctatcattcacaggagaagcttccttctgattgctggttgaagcggatgacggtcttctgctgggtatcgccctccggaggttgattgcccttggctcggcctggagtaggtcggggagagacacaacttcttccatctacgacaattctttgctgaggctgtcgatgcagagaatggttgctatgatttattgccgagtcaggtgcagcaggaggagcattggtgcattgtttctgctatgggttctgattatcacgaggccttacgggtacggcgtttgctccagtgaccacaatacgattggaatgtctgcttcgtgtaaattggcggtaatgtggaggtcgattttgccttggttggggacagttttcggagtaatgcccttcttcactgcagttgtaacaaacaataactttcttacactcgggttcttcatcttgtacttgatttctcagctgctgtattggaacttccaaaggtacaacgcagatactggcctctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgtcgtgccggcagctatgtttctcggttttgggcacttgtcggcgaaatgacccattccttgacaattgaagcaacagatgtcttcccggactcggcattttcttttctcatttcgattcctctgtcctggcactggagttaggctggaactgtaatcttggcgaggattggtgttgccttgatgcttctctccgttggaactggcgggttggttagccatcttcttcgtcagcagaaaactgaattgacaatcttttggtacatgatcagttccttcacaaaagaaacaagtgatcctgctcgttggacacctgtcgggtggatggtcttcctcgcaatgaacgcatatagtggcacatgagctggcgacatgaccgatttctccacaacgagagcatgccttacgttccatttcatcttcatcatctgaggagacttgatctgaatcttcactatcagacactctacctccattagctaaaagatgttctgtcaactgtggtgcacctcggaaggtatttcttctctgacgtctggtcattcctggtggaggccattctgtgctggtaatgatcatcttacggacttcatcttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgtacttgaggttgcatccgactcgggttcaaaattggcatccgatgctgctgtagtatctctataagcaatttgttctggttaatcaggtgttggaccactgctacacaactggtgtctggtgcttcattcactcgggagcttgaggtaccaatgtcctgacttctgaccttattgcccttctcattgtcagccatctgttgcaaaggtttggagagggagagagggaaaacaaaggggagagacagattagaaactaaggataggaccttaaaggaactaactcttcttgctgatgtgttgtttgtttcacttattctgcaagttgattaagcaaacaacctagcatggttacatcacaccccactgatgcaaaccacgcgctacacacacaaacaaggaaacacacgactaacgactctaccctagagggcggcttaggttctgcgacgggttctccaagatcttcactcctgcttctcagctggcttcactgcttcctccacttcgctagcggatcctgcagtcttctggagcttcggcaaacaattgacgacatcttcttcttcgcaaacctgaccatctagtactagttgaaatctgaagaaggaagaagggagtaaaccttttgcaaatagcattaggggaaggagaaaaagaggagctttcgcaaatagtttcatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattacatcgatagtatttacattattacaaaggcgctccaggcctgacaatcaaaaataaacagcagcggactagcgggcctacggctccatcttcacaggcgctcaactggggtataagccaggactccacctaagacatcttctccaaagcttctcttactgaaaaggggaaggattgagcaagaatgagtacaaccacagtactcagcaagccacaccggagatgcataattaatgccaaggaggtacaagggaataataatatagggattaa

SEQ ID NO: 92705 - DNA, 7805 bp, Oryza sativa
ggagacttgatcttaattttcactatcagacactctacctccattagctaaaagatgctctgtcaactgttgtgcacctcggaaggaatttcttctctgatgttttgtcattcctggtggaggccattctgtgctggtaatgatcatcttacggacttcatcttcggttcgcattggtgcttttcttttctgctgaggacagttccttgcgtagtgcccttgctcatcacacataaaacagatgatacttgcttcttttgggtcaacctgtggcatggcatgaggggccttctgggatgttggcggtgcgctgacttgtggtgtgagtgctgggactgcctccaactgcacttgaggttgtatttgactcaagttcagaattggcgtctggtgctgctgtagtatctctataagcaatttgttctggttaatcaggtgttggaccactgccacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttcagcgacaggttctccaagatcttcactcctgcttcacagctggcttcactgcttcctccacttcactagcagatcctgcagtcttctggagcttcggcaaacaactgacgatgtcctcttcttcactgacctgaccatctagtactagttgaaaatccgaagaaggaagaacggagtaaaccttttgcaaatagcattaggggaaggagaaaaaggaactttcgcaaataatttttatttataaaatatgtccttgggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcggcctacggctccatcttcacaggcgctcaactggggtataagccaggactccacctaagacatcttctccaaagcttctcttactgaagaggggaaagattgagcaagaatgagtacaaccacagtactcagcaagccacaccggcagatgcatgattaatgcaaggggggtacaaggggataataataggggttaggttttgcagtaaacagcatttaaaagtcacttagttgcccaaagttattttataaagacgatcctagagctacacaatattattaatcaaggccgtggacccacacgaacctgccttaacccaaggcctacgatgattcagaccgaactggcaacccaacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgagcttaatccttatagtggccggggtgctacttcccacaactggcatgcacccaaactccaccgaaaacaggttttaggggttttgaaagaggaagagaggtgtatgtccaattccaccataatccaacaattccatagtgtccaaatgatatgagaattcccaaagtctaaagttataaaaccacctaatgttgcctaattaatcagcgaagcatctacctaaatttatactagtggaaccatgaatagagtacccactagttggggttttgtttattctagggtgaacaaggtaataatatcaatagcaataataataaggtcataacaaaggtaaataggtatggctagataaaacagtgataacgcgggaatttaaataaagcgataatgcaataatttaaatcaacataattttacaaactgggattcaatatgttcaaggatgatgtgacttgccttgctcgctttcccaaacgccggcttcaacttccacgaagagcggatcttccgaagctgcagcgtctacacgaccaacggaaaagaaacggcttttactctaataaactccatacaacaagcaggaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaaatcgggtttattgcgtcagccgagggagagggcgcgcggaccgggtccacgggagtggggcccacgcgtcagcctctcggtccacggtggaccgggagcacgcggctggcggcggccggcgccgtgggtcccacgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaacggcgcggcggagcggcgcccaagagagaggagggaagggggaaacgaacggagcggtcctcggctcaccccgggacggcgaaggcggtggaaacggcggccggagcggaggaagacggcggcgcggctcgggatgacgatggcgacggcgctccgacggtcggcggacggagcggagcggcggacggggtcggcggcaacacggcgaagcggacggaggtgtcgccgagtaaggaggaagtccggagcggcggcggcggcggaacggagctcggcggcgatggcggagagaacggagcacggcgcgagcacgaatccgacggcgagggcgagcggcgagcggcggaaacggaagagcggagctcgggcaacgtttaaatagcgccgggggaaggaaagagcggccggagagggaggaaacgggcgcggagatctcggccgccattgatggcgccggcgaggtttgcgggagcgattccggacgaatccgagggagagagagagggaaaaacggggggaaagagagagggaatcgcggggaatgattcccccctcattatggcgcgcggggacggcgggatgcggcggaatccgcggcggcggcggcgctagggcacgggcgagcggcgggagcggcgggaggaaggcgatgacaggtgggccccacccgtcagcgagggcggcgggcgggcccgcctgtcagcggcgcgcgcgcgggggaggtgccgatgggccgcgggggagaggagagagagggagggagagttgggccgagccggcccaagagaggaagggggggaaaagaagacttttagggatttttctttttataaaccttttcaactttgtttatttcttaataattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattattccttttagaagttgatttttatttcgggatgaatttatcagggcgtgacatgggacccacctgtcagcggctgcgagggcgcgcgcgcgcgcgggcggctgcggactgggccggctgggccgaggagagagaagagaggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattaaacttagatcttctcttcaagacttttaaaattatttctagaaattccaattaaacaacaatttatatattttgaattttcagggtgtgacaactaacccaaggtagctggtggcaagcaagtcaataggaaaagcgacaccccaccacctccaccaatacataattgatttttttttgacgagaccccctataggtgggccatacttgctcccgcctgcaaaaatcgtttccctaaggcccatttagtggctgcctgcaaaaatacattttcaaaggcaggcctttaagagacctgcctacgagtctgacctccatcctctcttccctctaaacatctttaatttcttccctcaaaaaacatttttcatttttttcaagtcacatgcttatctctttaccttctctctctccactcatttcccctctctctctctccaacttctcccctcctctcccattgctcgggctagcagggacatggctgggggcgacggcctagacgaatggtggtggggagggctcgggtggtgggcttgacgatcggacgtcacggagcggaggatccattggccgcagatccggtctgggcggatccaccggtgataggcaatggcgacggcggaccactctgcctctccatcctccctcccacggcttctaaataacatgagagcttcctaagtgcccaattattataggtctagaaagactagaggcaagccatctaaaaaatgtggcagcacaaatcataaatgttcaacaatgcaatagagaatactacaacaattataaaaatatgaaattatgacctccatgtaattcagcattattttgtgtaatagtatttggaacagcttacagtagcacatacaactaggcatgcatcatgcatgcacatttataaaatgacaactttatttattctataagtaacacctcatggagctctagctctttgcatggctcaggtattacttacttgttggcttcctttctttcatattgagttattaatagaatagcagaatatgttcatgcacgctcagaggaagcagccgaggttaccgagctcagccttgccacacacgctgagcactgcctcaaggaagaggacatcggcggtgacactgaagttaatcttcgcagcctcacataggcaaccagcggcaatggtgcttgagagactgttgattggtggacaacagtcttgcatagccttagtcgggttgttgagcagcgtggacaaatcaagttgtgcgcacacattaagtgcaattacattttctcttgggcattgactaccgccagatggtgttggtggctgcgtgggtgctatggttggtggttggctaggtgctacaactggtggtggagatggtgctataactggtgccggtgttggttctacagacaccgatggtggtgatgctctccttggtgatggtggtgcacgtggtggatttcttcttggaggagtttgaggttgtttggcttgggcaaatgagaagagtgggagaatgacaatggcaagaagatgacaatggaaatacttggctagctcttgttttgaaagttcttcattatctgatgctatttataggcagcatctggttactctgcaattcaatttttgtcatgtacggttccaatttgagtggaaatttctctcacgcgagttaagccaacgaataattatggtcacctttgtaccaatagtacttgccatttgctattttgatggtcaatcaagcacattttcaattgaagaacagtgaactcatggatatttttttttgagaaacacagtacaaacgcagacgctcacaacgtgcgcacgctcacccctatgaacgcacacatgcacaccctacccctatgagcacctccggaagactgggctggcatattttgagattgacgaagttaccacaggtgcctcgctgttgacgggtacgtctggatatttggggtcattctcttgaaacttgaatcgattcagtgctgatgcggctgcattggttgactagctgagatgatgcagagaatatgtgttatctgtcctatgcctccctaattaaactgaatgcacaagtgtagatcagatgctctgtttttttttttggcatagatacttgttgccaacaattaaatccttgtttctttcctttgtcttatcaatgccttcgaatggatgaattggattgaatctctgcaattactactattttactttgaagaaacagttcaaaactgatctggatttatgggtactagtagtcaatgaggcacgagtgatttaccttctacctcagtgaaatcctcttcccgttatatatgacctggcagtgttggatgttttcattagaaacatttcaatatgatcagagcatgtacatatttacggctagctaggaggacatccggtaacaaaagcttttgtgatggtaaaattgaatatatagcatctggaggtcccttttggttttttcaaatgttgtgttaaacaaggccctgtctcacccaaattcagtgaaagaaaaaattgtctagtttacatgaggcagttgattgccgtttgtatagatggctataaggcccaaggaccacgcggcccagcccgaagcacgccattttggcccggcccaagcacggcatggcccgactgggatcgtgcccatgccagcctagcctgacagctgggttgtgcctgggctgcaccctcggcacggtgggctggcccggcacggcctgatcaaataaaaaaaatattggtatgcaaaatagacttaaacaaccatataaagcaaggcccaaagagaagaggaatacataatagacttattttctagccatttgaacacagcccacacagttgagggacgaaaaatagactttttcttggagaagcacgataggccatcgtgtcttcgggctggcccggcacggcccaagttgtattgggccgtgccttggccatgtatgccacccgtaggctggcacggcacggtccggtgtgtcggtcgggccatgccggcccgactagcctcggccctggcatggccgtgccgtgccgggcggcccagttggccatctatagccatttggatgtcaaactccttttgcattgtttcacgaggatcctttccgcaagctgcagatgagcatc

SEQ ID NO: 92706 - DNA, 637 bp, Oryza sativa
gccatcggctaccgatttcatcatatttgacaaggtattagtcaacactccagattaattaatcaaagcattatacacagcatagtcaactcgatcttgaaagttattgaaaaaatcttggaatgcattgttattctgattaagatttcccccttgcggtccctgagtgccgttaccttgaaccccatggaccccttgagggttgtcgccttgatctcctggagagccatcagtagcacctttgttactcggctgggctgattcgtctagaacttgtttcttttctccctctttagaagaaccgatcccaaaatcctcaggaaccaccttcagcttgtacttctgaacaaatgtgcccttgcgagtttgcatgaatgaacttaaaaattgatctcgtgtttgctgcatcattgcattgaagtctttcttctgttcaggagtgaacttctctccaacgtggcgtagcattggacagtgattggttaatattgattaattactgcaactgttttactgctttcaactactgcttttaaatgctagctttatgcaaaagaacctttttgcctcccttggatatatcctgcatcataccttctcttccggtatgacttgctgaatacagggggtagtattc

SEQ ID NO: 92707 - DNA, 861 bp, Oryza sativa
ataattctagaatcttcctttcacaaaaacttagtaaatattgatttaagcatcaaagtgaacaacccccatagcttaacacttgtcaactttaccaaatgttttccctaagtagtattacttttccctccaacaactctcattcaaatttctccacactttaccccaacctacctcccacttttcaaatactcctcatttaattatggacataatagtcttttcctttttttttctttctctaaaacaacctaatccattatgcgatggaggtagtagccaaggactccaaaattctggttggactacctgcatatggcctgtggcccattttcaagcggcccaagtcatattagactcagttcacaatagtaaccagggataaaaacagagcagatatggacgaacaattatcataccatattcgctttcatattttttgccgggtgtaaaaacgaatacgaatggcttggatacagaaacaaatacaaattatctcaaatacgaataaggatcgaatataatcagatatgaatatggcaatatttttttatcaaaacacgaaaaccacctcaacttctaatagaaacgaatatcatcatatataattagctcgttttatataaaatatagtataatttataaacatatttaaaagtttaaataatattaatagtgttgactagtgttaagagatatgttactactaaattctaaaaatgtacattgaaagacatagagttataaagaaatgtggtatatcttatggctttagcggatatctaaatagcactgttcaccggatatccgtacccgtcggaaaccctgatatcatattcgtattcgtatttgggagaaaat

SEQ ID NO: 92708 - DNA, 747 bp, Oryza sativa
cctgcagccctgcaaagtacattatttcatatcgtaatttagttcacaatgacatgatcttgttcggtacacaatactacaatttaacaagccaagtatgtacattatttaagtagtgcaacaaatataagcagagcttgaaaaagagcaaagcacggtgatctgaccataggataggagagctgaggtgcttaagtcacaaaaggcaaaggtaagcctgaaaacataatgcatcatccagaacttcgtctgacgatctaaccatagtgccacaccatgatgagggagggaaagctcacagcgcagcaacaccatgctaccagacatcaagcatcagaatcccacaaacaatacctcttttgaggcctgcagaaagaagcaaaagctggctgcctgccttaccttccacacccacacaaagtcaatcaagtaacaatgatgataagggccttaccaaagaccatatatacacacattgatgccttcagattttatttatgtgtgagctttagtatcgccactgtaccagttgccagttctagttatccgaaacctccacgccaagtttcttcgcctccatcttgagaaacttcaggtatctaacagcttcttcaatgacagaggctgtatccaattggtctccaccagggattattccctaagaactgtgaccatatttctcatcctctcatgagtaacagtgtccatggatccatggaagactgaactctggctagaagaatgatg

SEQ ID NO: 92709 - DNA, 2230 bp, Oryza sativa
cagagctcgaggcccatcgtagggacctggcggagatcgccagggaggtggaggaggagcgggagactgccctcatcgccaccgccgtgttcaacgcggcgcgggacgacctccgcctccaatacgggagccgggcggcggagctagagaagaagctcgacgccgcccggggaatccttgatgctgccgctgcccgggaacggcgggcggcggagatcgaggcggcgtcccggcagcgtgaagaggcccttgaggctcgcgccacggtgctggaggagcgcgcccgcgcgaaggagagggacctggcggaccgcgaggccgccgtcgccgtccaggaggcaacactggcggcgcacgaggccgcctgcgctgaagaggagtccgcactccgcctccgcgaggacgcgctcaccgagcgggaacgagctctcgaggaggccgaggccgcggcgcagcggctggcggacagcctgttcctccgcgaggcagcgcgggaggagcaggcgtgccgcaatctggaaggcgcccgcgccgagagggccgcactggatcagcgggccgctgagcttgaggcgcgggtgaaggagctggacgcgagagcgcatagcggcggggcggccgcgggcaacggcgacctagccgcccgtctcgcagccgccgaacacaccatcgccgagctgcagggcgcgctggactcgtccgccggggaggtcgaggccctccgcttggcgggcgaggtagggcccggcatgcttcgggacgccgtctcccgtctagaccgcgccgggcggtaggcgggcctctggggtgggcggaccgcgaagtacgccgccaaccaggggggcctcgcccagcgcctctcagagatggccgggaccctccagcggctccccgaggagctcgaggagacgatcaagtcatcctcgagggacctcgcccggggggcggtggagctcgtactggccagctacaaggccagggaccctgacttctctccgtgggcagcgctggacgagttccctcccggaaccgaggacggcgcgcgcgcgcaggttcgggacgccgccaaccacatcgtccacaacttcgagggtacagcccctcggctcgcgttcgccctcgactccgacgaggagggcggtgacggtggtgcggacgacagcgaggacgaggccggcgacccgggcgcgtcggagtgagcccccaggcccccgccaatcttaaatagcttttccttcttcttccgaggccttcgggcccccttcttgtatagactgatttaatctgtaatcaaataaaaaggaaatttctatgttaattctatttgttgtgtgtatgagacggggatggtctgtgccgcggtccttctgtgtcttggcttgaacaagggctcgtgcccaggtcccagcctcaaacggcgcgggtcggggctagtgcctggggagatccacgtgtcgagactggccaggccgggagcgtggtgaccgagggttatggatgacccgattgtggcctttgccgattcccccccggagttcaccacgccccggggcacggctcggttctgggcccttttgtcgattttagccggcccgggccaccgagggcaggatcgagcacgagcgtgctaattcaagccaagattcttcaaaaggaaacaatggcacagacacagtccttaggaaatcgacaatgcttttattgaaatacgtaagataaagaagataagtatatgcatgtggtagcccccggccaaccctgcacgcccggggggggggtgcggggttggcccgagcccgagacctgacacccgacccccattaggggtagaagcgacgaaggtgttcgatgttccacgggttaggcagctctgtgccgtcgcccgtggccagccgaacggagcccggccgggggacaccgatcactcgatacagaccctcccacattagtgagagcttgctcagtccagcacgtgtttggacacggcgtaggacgaggtcgtcgacgcagagtgatcgggcccggacgtggcgctgatggtagcgccacaggctctgctggtagcgtgcggctcggagggccgcgcgcctccttcgctcttccaagtagtcgaggtcatctctgcgaagctgatcttgatcagcctcgcagtacatggtggcccgaggggacctcagggtgagctcagatgggaggaccgcctccgcgccgtagacgaggaagaaaggcg

SEQ ID NO: 92710 - DNA, 1228 bp, Oryza sativa
ccgccaggtagagtagcaacggctcatctggctccggggcgactaggaccgggggagaactgaggtacgccttcaactgagtgagggcccgctcagcctcctccgtccaggtaaacggcccgaagcgtttgaggagcttaaataggggtagcgccttctctcccagcctcgatatgaaccgacttagggcggccatgcagccggtgacgcattgcacatccctaagcttgctggggggcgcatccgctctatagctcgtatcttctcggggttggcctcgatgcctcgggcagagaccaagaacccgagaagcttgcccgcaggcacgccgaacacgcacttgtcggggttcagctttatgcgagcggagcggagactttcgaaagtttccgctagatccgagagtaaggtctcttggttgcgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaataaatgcagttttttcctcatcctccctagccatgcgaatctgatgataaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccagggcctgccgccgcactttctgccggactggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgacgcccagggcaacctccttgaccgggacctcgtcgcacgtgatcatccgctgcctcggggcggctgggacggaggtgctgagcctctcgtcgccacccgcgggcttggacgccgcggcgaggtggtccgcgcgctgctccatacaa

SEQ ID NO: 92711 - DNA, 642 bp, Oryza sativa
cggggaaagaggaagcaggagggtaccccttccccatctcctccccaaggggcgggggcggtgcgtgccagcagcaggcgcccggagggtgccgtgccgacatcgcagcccgagggggagcggaagaagaaacggctccgcaagatgggggggaccgagccatgtcgggggaacctcatctcgcccccgaggtggtcgtttagccgacctcctcgcaggttcgtctccgcgcccatcgcggccgtattcattcccccatctcccaaggcgagttttcactcacccgtttctttttgtcttctggtttttcttctgcctcagcgagatcccgtcgcgccccctccgccattccaagtccggccggtccgaggccgaggagacagcgaccgcgaaggcccggagacgggaagctgaccggcgagaagccgcggaccgcctccgggaagccgaggaagccgcccaggaggccgtccgggttcgccaggctgaggaagccgctcgggaggaggccagactccgccgggcggagaagtcggtccgggagcgggaggcagggcacgcacgccaggcggcctgccaagcccccgacctgactccgcccgaggcgacgacgacttccgaggccacccacgacgaggccgg

SEQ ID NO: 92712 - DNA, 5225 bp, Oryza sativa
caggaaggcacagattcctgaagggattatggcacaatagaagagagagttccgtgcgctccagcaaggaaccatgtcagttacagagtacttgcatgagttcaaccgccttgcgcgctacgctcctgaggacgtgcgcaccgatgctgagaagcaggagaagtttttgtttgggctcgacgatgaattgaccaaccagctaatctccggagtctatgaggactttgagaagcttgtggacaaggctatccgccaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgactacaacggtggcagtcacaacaacagtaagcagcacaaccacaactcgactccacccccactaatggcaccagctcagtcagatccgccagctgtgtcagctcagtcagaacaacccaagaagagggctgtaggaaagccaggaccctgcttcaactgtggcaagcacggccactttgctagcaagtgtccgaagctgaatcgcactggacccaggttcatccaggcccacgccaatcatgtgtctgcagtggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcagaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactactccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtgacttctggttatcggaggtcaaatttctgggtcacgtcatttctgctcaaggcgtggcagtggatccatcaaatgtggaatcagttacaaagtggaccccaccaaagacagtttctcagatccggagttttcttggacttgcgggctattaccgtcggttcatcgaaaatttctctaagattgccaggcccatgacacagttgctaaagaaagataaaaaattcaaatggtcagctgagtgcaaccaaagttttgaagaactcaagaagaagttagtctccgcaccagttctaattctgccagatcagacgaaagacttccaggtctactgtgatgcatctcgccaaggattgggatgtgtgttgatgcaagaaggcagagtggtcgcatatgcttcgcgacagttgcgcccacacgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcccggcctacgctcgtggatcaagtcagagcagctcaagtaaatgatcctgaaatagctgagctgaaaaagaatatgagggttggaaaagctcgagatttccatgaggatgagaatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgagaagagagatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcggggcacgattcaatctgggtggtcgtggatcgactcaccaaagttgctcattttattccagtacacactacctatactgggaaaaggttggcagagctttatctttcaagaatcatgtgtttgcatggggtacctaagaagattgtatctgatcgaggaagtcaattcacttcaaagttttggcagaaactgcaagaagaattggggactcgtttgaatttcagcacggcttatcatccacaaacagatggtcagaccgagcgagtaaatcaaatcttgtaagatatgttgagagcttgtgcacttgactttggtggagcctgggataaaagtctaccgtatgcggaattctcttacaacaacagctatcagtccagtttgcaaatggtaccgtttgaagcattgtacggacgaaagtgccgcacaccacttttctgggatcaaacaggtgagcgccaactgtttgggacagaagtgttaaccgaagcagaggagaaagtcaggaccgtcagggaaagactgcgaatcgcccagtctcggcaaaagagttatgctgataaccgccgaagagagcttactttcgaagcaggggattatgtgtacccttcgtgtcactccgcttcggggagtacaccgcttccaaaccaaaggcaagttggcaccacgctttgtgagaccatacaggatcttggaacgcagaggtgaagtcgcttaccagctagagcttccacctaatatggttggtatccacgatgtgtttcatgtgtctcaactgaagaagtgtttgagggtacctgaggaacaagctagctcagagcacattgacatccaagaagatttgacctacgtggagaagccagttcgtatccttgagaccagtgagagaaggaccagaagcaaggtgatcaggttttgcaaagttcaatggagccaccactcagaggaagaggccacctgggaaagagaagatgaattgaaggccgcccatccgcacctcttcgccagctcttccgaatctcggggccgagattccgtttaagggggtaggtttgtcacgccctgaagttcccctcccttgctctaaattcataaaataaatcgtccgaagaaattgtttaatttaacctagagatgaatccctaattaataaatgcaaataataatcggaattggcatgtggaatttttcttgagttctacatgtcaaaattcactaacaggatttttagtggaattttcagagccttggaaataattttaaccaattaaaatgagcaaagtgcaatattaaatccctggaaaatcttttcttctttttctttttcctccttttttctctcttcttgggccgtcggcccagtccgttcgcctcccgcgcgctcgccctcctctcagctgggccggcccactccctccctcctctctccgggtcaccgacaggtggggcccacctgtcggccccttcttcctcctccagccgacggcaccgccgccgccgaaaccgccaccgacgccgccggtttccccgtttcccgcgcccactccgcccgtaccccacgcccacgtcgccgcccaccttccccgcacctcccgccagctcgcgcgcccgcaaacggcgggggatttgaaatttcccccactctctctctcctcctccatttcccccacgtcgccggccaaatcggccacctttccggcctcgtccgcccctcccgagcccatataaaccatccccgcactcccctccacctttttcctctttccgccgctctctcccgtgccctccatcactcccgcaccgatacacccgccggcgccgcctttttcactactccggtcgccgctcgccgccgctggagccgccgccgagccaatttgccaccgccattagcttcgccgccgccaaagctaccccgggcgccgcatccccatccaatcccgccatcggggcccgcttctctccgcgcgccggtgagtaccaccatagccgccgccgtcggccatggctctcgctcgtcgtgggcaccctctctccctctaacccctcacacttcctctcttagggtgtcccggagctcggccgccgttcgccgtcgcccttcggtcgctgaccgtcgccgtttgccgtcgtttcctcccgcgccggccgaaccccggtgagaactccctctctcttcttcccgcgcgcgccg

SEQ ID NO: 92713 - DNA, 559 bp, Oryza sativa
gcgcaacgttgttgccattgctacacttggtttggctcatgaacgtcccatccttgagttgcttgatatgaagttcaaggaagaagctcaactttccaatcatggacatctcaaattccctagacatcatatcaccaccaaattccttacaaaatacctcattagtagaaccgaatatgatatcatcaacttttatttgacaaacaaagaagtcatcaccaatgatatttgtgaaaagtgtggtgtcaacttttccagttttgaaatcctttgacaaaagaaaatctctcaatctttcataccaagctctatgagcttgttttaaactatagagcttttgagagtttataaacatggttaggatttttaggatcttcaaaaccgggaggttgttcaacaaagacaagttcggcaatttcaccatttagaaaagcacttttcacatctatatgaaatagttctatatcaaagcatgatgcaaatgcaagaatgatgcgaatagcctcaacttgtgtgaaaccttgtgccaccaagcttatgttgtttctcaccaccaacc

SEQ ID NO: 92714 - DNA, 648 bp, Oryza sativa
attgggaatcattgtaagatctataccgatcataagagtttgaaatatacatttacccacacagatcttaatcttcagcaaagaagatggttagaattaattaaggattataatttggaaattctataccatcccagaaaagctaacgttgttgctgatgctttaagtcaaaaagcttattgcaatttacaacaagaaataatatcagaacaattacaagcggaaatgcttaaactaaatctgggtattattaagtatggagaattaaatactttggagttgaaacctacacttatggatcaaataagagagtatcaaaaagatgacccagaaatacagatttttaaggaacggaaggtgcaaggaaaggctgcagatattactgaagacctggaaggaatattatggtacggaaatataattatcgtaccacaatcaggaaacttaagggaggtaatactaaaagaagcacatgactcagcctactctttacacccaggtagtacaaaaatgtaccatgatttgaaggacttatactggtggccaaatatgaaacgatattgcaaaatatgttgcattatgtcatgtttgtcaacaagttaaagcagaacaacaaaaaagcctacaggattattacaggggctgcag

SEQ ID NO: 92715 - DNA, 606 bp, Oryza sativa
  unsure (1)..(606): unsure at all n locations
atttcgaggatcaagctcaagatctcgagcgaggcaagccacccttgaacaccttgagcctatatttgaacttaattatgttgcttgaaaagtattatgcattgataggatcgcacttaatctgcttgtcccgtctgcaaggcagattggcggacctacctaatttgttgcatttgacccttccattgtaattgttataccatgttcccttgtacccacctaattgcgcctcggtaatcgtgcactctgcatgggtatcgacggtcgccttcaaacttaaaatctgagaaacatcttgggtaaaacttgggttttacaaaagacttggaaaacccgacacctgngtcggtgcttgcaaactaaatgaatttccaaaaccgcggaccggggaacgtaccgggtgtacggtttcccgctcttgcacttaaggaccgtttccttgaaatttcatccaaacataagacaagtacgaccacatgggtggaatgggacacccctggctgagtaactagcttatcgggggagccatgatgctaagagacatgtggattcgccggggtggggcccggacgttcgaaagtgccttgaaattggcgatgaagtgct

SEQ ID NO: 92716 - DNA, 2174 bp, Oryza sativa
tgctcatgcaggacggccatgtggtagcctatgcctcacgccagctacgacctcatgaaggcaactaccctacacatgacttggagttagcagcggtggttcatgctctaaaaatctggcggcactatctcattgggaaccgctgtgaaatatatactgatcataagagtttgaaatacatcttcactcagtcagatctgaaccttcggcaaaggagatggttagaactcatcaaggattatgatgtgggaatacactatcatcctggtaaggccaacgtggttgccgacgctctaagtcggaagagccactgcaacactctcaacgtccgtagcattccgcccgagcttagtcaacagatggaagccctgaacctaaacatagttggtcgcggattcttggctgcgttagaagcaaagcccaccttgctcgatcaaatccgcgaggctcagaagaatgatccggacatgcatggactcctcaagaatatgaaacagggtaaagccgctggtttcacagaggatgaacacggaaccttatggaacggaaagcgggtatgcgttccagatagcagagaacttaaacagctgatacttcaggaagctcacgaaagtccttattccattcacccgggcagtaccaagatgtacttagacttgaaggagaaatactggtgggttagcatgaagcgggaaattgcagagtttgtggctctatgtgatgtgtgccagcgtgtcaaggcagaacaccaacgaccggccggacttctccaacctctccaagtaccggaatggaaatgggatgaaattgggatggatttcatcaccggacttccaaaaacccaaggtggatatgattctatatgggtaatagtggatcgattaaccaaggtagctcgattcattcctgtgaagaccacctatggagggaacaaactagcggagctctacttcgctaggatcgtgagtctccatggtattcccaagaaaatcgtatctgataggggaagccaattcacctctcacttttggaagaagctccaagaagagctgggtactcgattgaatttcagcaccgcatatcacccgcagacagatggacagaccgagcgtctaaatcagatcctagaagatatgcttcgcgtatgtgtcctagatttcgggaagacttgggataagagtctcccctatgccgagttttcctacaataacagctaccaagccagcatacaaatggcaccctatgaagcgttgtacgggcgcaaatgccggacaccgctattgtgggaccaagttggagaaagccaagtgttcgggactgatatcctgagagaagccgaagctaaagtcagaatcattcgggataatctaaaggtggcacagtctcggcagaaaagttatgcagataaccgtcgtcgtgatctggaattcgcagtggatgattttgtgtaccttcgggtcacgccattgcgaggtgtacacaggtttcagacaaaagggaagctcgcacctcggtatgtgggtcccttccgtatcatcgctcgacgcggagaagttgcttaccagctggagttgcccgcctccttgggcaacgtgcatgatgtgttccatgtgtcgcaactcaagaaatgtcttcgagtgccatccgagcaggccgactcagagcaaattgaagttcgcgaagacttgacctatgtggagaggccagtgaaaatcctggacaccatggagcgcaggaccaggaaccgagtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaatctatcctcgaaattgtgcaaagaataattaaaattccatgtgaaagcctccaacaattaaaatgtgcaaagataaaagtcaaatgaggcttggaggatttttgtatatttcctaaaagcctaaaatgcttaaacaaattttagtggaattttcagaggacaaataataattgaaaagaaataaacaaagttgaaaaggtttaaaaaaaaagaaaatcctaaaagaagttctttttcccccccccccctc

SEQ ID NO: 92717 - DNA, 741 bp, Oryza sativa
caaatatctcttttctcaatttttcattgtcatattattacttgataaaaccatgaggtacaaactccccctcaaaccatgccaaaaggatgaattattcccaattcatcacgaagaaaagcaaaacgatttaaatccaaaggtttagtgaaaatatcagcaagttgcaactttatgtccaaaaattgcaattcaacatctcccttctcaacatgatccctcaaaaagtgaaagcgaatatcaatgcgctatgtgcgtgagtgtcgaacaggattcttagcaatgttaatagcactagtattatcacaaaagagaggcactttctcaagagtaagaccataatctttcaaagtagataaaagccaaataatctgtgaacaacaactagcagcaacaatatattcagattcagcagttgattgagcaacactagattgtttcctagaagaccatgcaatcaatgatgtaccaagaaaatgacatgttctactagtacttttcctatcaattctacaaccaccaaaatcagcatcggaatatccacttaagcatatagaagatgaagtagaataccaaattccaaattccaaactcaagtgtatgattcaaatacctcattatacgcttgaccgcttgacgatgtgaagcacgaggagaagcttgaaagcgtgcacacaaacacacagcaaattgtatgtctggcctagaagcagatagcatacaacaaagatccaatcatac

SEQ ID NO: 92718 - DNA, 2874 bp, Oryza sativa
tatcatccacataaatctgaacgaacagttgattatcaccatgcttaagaacaaaaagcattttgtcaacctttcccattgtaaaacctttcgtaagaaaaaagttcttaagcctatcataccatgccctaggagcttctttcaaaccatacaaagctttagacaatttaaaaacatggttgggaaaatcaggattttcaaaacctggtggttgtttgacataaactttctcctgtataaaaccatttagaaaagcacttttcacatccatttgatacaatttaaaaccttttgaagcagcaaaagacaacaaaagtctaattgcctcaactctagcaacaggagcaaaagtttcatcaaaatccaaaccctccacctgggtaaaaccttgagcaacaagtctagctttatttctcacaatcaaaccatcctcattttgtttatttttgaaaacccacttggttccaataatattaagtccagaaggtggttcaactaaagtccaaactttgtttctctcaaaattttcaagttcttcatgcatggcgataatccacgattcatcagttaatgcatgtggcacatctttgggttcaaaagaagcaacaaatgcagaatttgcacaaacatcatgagtcgttaccttagaccttattgtccgctcacctatattaccaataatttgttccggcggatgtcgtcgttgaatgtgtaaaggagcaacaacttctgaagttgatccacgttctgtatcagtactagttgaagttgaattctctggaggaccatctcgatcagcatcaacagtacccgaacccgatgaccctagccggtctgaccgctcctcatgagccggtctgaccgctcctcatgagccggtctgaccggaggtgtgccggcggtctgaccggcctggcgcccggtttgaccggccgagccgacctcgtcatcgttgttgtcgtcgctcttgtcttcaaaaatacgaccatcctccctctgaacctgtgacaatgtacctgcaatatcggatttagtacctggactagcctcatcaaaagaaacttcgcaagtctcaacgattttgttagtctccaaaataagtacacggtaaccacgagtatgagcagggtaaccaagaaacaatacatcggtagaacgtgcctcaaacttatccaaatttccagatttcaagacaaagcatttgcaaccaaaaacacgcaaatgtgaaactttgggtttatgtccaaaccgaagttcataagaagtttttccaagtttagatctcaagaaaactcgatttgaaatataacaagcagtgttaatcgcctcagcccaaaattttctaggagttttatactcatctagccatctcaaccaaaacacgatttttcctttcaacaacaccgttttgttgtggaacacgaggagaagaaaattcatgttcaagacctctttcattgcaaaactgttcaaaagaagcatttttaaactcaccaccattatcacttcgaattcttttcaaagaaccaggaaattcaagatccaatcgaagaaacaaaccacgaaagtgttgaaaagcttcgtccttagttgccataaagaaaacccaagaatatcgagaaaaatcatcaacaataaccaacacataccacttacctccaacagattgcatgtcgcgaccgggaaaattgcctttttccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggcggatgcacgattaatgcaagggggtacaaggggtaatgatataggggttaagttttgcagtaaacagcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcatcccaagccaacccaggccaaccattccacattttagttgttaagcaaattttaagaattaaaacactgacttgggtacattgctcggcttgcccacaaccgagggagaagacggcgcggccggacggtgctccggcgaggagggagaggcggctggaggcggccggcgcggaggaaagagaagggcgacggcgggaacgcgcctccggcggtcaccgcgcgaaacggagggcaggccggggtggaggaggtggcggcgacgctggaggaggcgacggcgcggccggccggcgcacggtcgaggcggcacaggcggctggaggcggccggcggcgtgggagagagaggagggcggcggggagatggctagggaccacggggaggctcgggagggggctaaaacgagagaacgggggatgaggatcccattttatatgagagaagagggagccggccacgggggaggtcggaacggcggcgggaatggcggccgacggccatggaaagcggtcggacttggcgcgtccgttcccggggattgaaggcacgaatcaagggggaatttgggggcaattgaagaggattcattggggattaaaacccccaattaatttggaatggccattgaatcaagcggattggag

SEQ ID NO: 92719 - DNA, 1744 bp, Oryza sativa
cggtggcataataggccagccgtgcaggcggaaacaccagtcgtcggcggacgaggtggccggtcggtgaagacgtggatgcccatgaacggtggtgtgaccaaccaaccgtttaggcgaggacaccagtcggcggcgacggaggcaggccggtggtggagtcgtagacgcccaacaacggcagcataataggccagccgtgcaggcagaaacaccagtcggcggcggcgaaggcaagccggtcggtgaagacgtagacacccaacaacggcggcataataggccagccgtgcaggcggaaacaccagtcggcggcggcgaaggcaagccggtcggtgaagacgtaggcgcccaacaacggcggcctaataggccagccgtgcaggcggaaacaccagtcggcggcggcgaaggcaagccggtcggtgaagacgtaggcgcccaacaacggcggcataataggccagccgtgcaggcggaaacaccagtcggcggcggccgaggcgagccggtggtgatgttctgactgatccattcctggagcgtaagagataagcttaaagccatcaatcctttttatgcatatctggatctggatcctgcagaacaaacatataggatgagtagtatctgatataaatataatactcgagaaaaaatcaagtattttaaaatatttataaatatgtatttctcctcttgtcaattttgatttctccgagcagatgactctgtacgtttaaacactctgtccgactagtcataaccatcaagcatcgggagtcggcctaggcacttcccaaacatgcatatgagtgatatgagttcgtcattaatggaacaaagtttcacggattagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacttctatagcccccgactcactagtcaacggcgaaccagttgatgtagtgaggcaaaggaaaagacaaaatatcatataaagaataaaataaatgatgacttagctttgtcgtattccctcgatgacagcagaagtagccgatgtgggaataaagtcgtccatcaataacaatgaagacaccagtcggcggcgacgaaggcggtcgacggtgaaagcgaagatgcccactaatggcggcataataggccagccgtgtaagcggaaacaccagtcgacggcaacgaaggtgagccaacggtgaagatgtagacatccaacaacggcggcataataggccagccgtgcaggcggaggcaccactcggcggcgacggaggcgggccggcggtgaagtcgtagacgcccaacagcggtggcataataggccagccgtgtaggcggagacaccactcggcggcaacggaggcaagccggcggtgaagtcgtagacgcccaacagcggcggcataataggccagccgtgtaggcggaggcaccactcggcggcaacggaggcaagccggcggtgaagtcgtagacgcccaacagcggcggcata

SEQ ID NO: 92720 - DNA, 1676 bp, Oryza sativa
acgcccaacagcggcggcataaataggccagccgtgtaggcggagacaccactcggcggcaacggaggcaagccggcggtgaagtcgtagacgcccaacagcggcggcataataggccagccgtgtaggcggaggcaccactcggcggcaacggaggcaagccggcggtgaagtcgtagacgcccaacaacggcggcataataggccagccgtgcaggcggaaacaccagtcggcggcggcgaaggcaagccggtcggtcaagacgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtggtgttctgactgatccattcctggagcgtaggagataagcttaaagccatgaattccttttatgcatatctggatctggatcctgccgttgttgttatcagcaatggcggtggcgaagacaagccggcaaagtggactcgcggccgatcgaccggaaagctgagacgcctcgactccatgaccagcattaatcgcctcaatagtgccgcgtaattatatgcgaacaacaacaaaaaataacaagagattaatctgagattaaaaatcaatatgataaataatgataaaactaggcgtccggcgctggacgagtagttagcgtgagcagatataaaaaattgctcaatggaaaatattacataaaaaggaaaataaagacacttagctttgttctcagtgtcctcctccgtatatgtgttaatggatggacatgggatcatatcggcagcttgtgacagacatgcactgtatgtggaacaagctggattataccgaattgaaaaccatctgtatgtgcagtatggcttgtgcttgcatgctgcgtgctatgcgtgcgtgagtccgccagccatctgggcaagacccaacagatgccgactgcttgcatcaatataatggcaatgtgtagtggcagtcggacatgcaaatccagtcacgagtcggtgctgatggctgagttgctttaattagtcatggttgatcagatcccaagtcggagaagattttggaaataatcgtcgcgacggtcgcgtgggacttggcttgatagtgatcaggttcctccgatggcagggcatgtatttaatggatgatcttgaaccggtgatgtcgaaaactaaatcgtcgaactcccagagattgatcttagatggcagggcatgcaacgacgcaaaccttcgggcgtgttcatgcaacatctcgactgatatttcttttttaagattgatctgaccacaggatggtgtcgacgaacatggcgatgaccggatgagaacgaagccatcttgagccttcccgactgatttgaatctgagccagagagaacttgttgaagttgtcggcgacgaggaagcgaaaactcccaaagcgaaaacgaagtcggcgactcatgaagttgattccatcgcactcgttgataggaaactcgacgcaacccctacctggcgcgccaactgtcgaaacatgaattcggcaataataaaacggggtagcgcacaagacctaaagtggatggatg

SEQ ID NO: 92721 - DNA, 705 bp, Oryza sativa
taattgtttgggtaggctaccagagaggtgtaatggtgcgggtttaatatctgatttatcagttgctctatgttgggtgcacaggtatagagtacttcctccatttcatattataagactttctagcattgcctacattcatatatatgttaatgaatctagacatatatgtgtgcctagattcattaacatatatggagattgaaatactcttgtgcatatgcgtcccatgttcgtgtgccctcattccatagcctttcgaagtcatcgattatcggttcaaggaacacatcgatatcgttgccaggttgtctcggtccttgaatgagcatagcaagcataatatactttcttttaaagcacaactagggaggaatgttatagttaacaagcagaactggccatctactgtgacgactgctcaaatcaccaaatggattaatgccgtccgtacacattgcgaaacgcatgtttcttgggtcctttaagaattcctggtaaatcctattgattgtcctccactgtactgaatcagctaggtacctaagcatactatctactttccgttcttcagcatgccagcgcactagcttagcttgttccttattcgtaaacattctcttcatacgctccgcaattaggagataccacaccacctttgcggggcctcccctatttgacttacttccttcacctttcgctctt

SEQ ID NO: 92722 - DNA, 4616 bp, Oryza sativa
cttccagatctagaagaggaagctgtagggttaacgcacgcaaagcaaattcgagacgaaagcgggtgggggagagagagagaggatttggatgctcaccaggatgcaggaacccctcccctgctccggtcgcgagattgaggatcggcgccctgctctgccctcctcgcgagatggagatcagcgctggcgcatggagcggagacgagacgggagtttttcttctttttttttttcttggcacgcgacgggagtttttcttttctttccttttttttatttacgcataagggacagcgacgaaagatttcctttttatattttaaaaaaaagtctgtgtattgcaacgggtgaatgctattttaatcttattattgttgtacggtttagctaagatgaaattcactttgggaatttgcttagattttttttagaaaatcatgaacatcaattagtagtccaactttcatatcaagtaagcatgcggattttttaaagggatttcttatatgactccttttatattttcaaaagcaaacgaatttaaaatccgactcaaacacgaatgatgtaccaaaatattaacaaaaacatcttcaaattttataatagtagagatactaatgtaatactatctcatccgaattaatatctaaagtgtttgttttttggatgtaggaagtaaataaattataggtttgtctaaactattgcttattgcttatgtttggtaggcttggctacggtgcaactgtagccagccgctacagtccctgtgtgtttgttacaaacttatagtgcccgctaaaaatgttacgtacagcgtgacggtggtcaagcctactaaacagcacattattatgtactccctttatctaaaaatatagcaacctataattgattcatagtaataaaatatgtctcatcgggtactaggttactacattttataacggaggtagtaggtgttattttgaacaaccttatttcaaacttttcatttaaaaccaactgttctttataatttggactaggggcccacctttcggtggaattcggttggggatgggtgcagacaacaaactcctccgccacggatgccagcgacacccactggctaccactcttcacatccacgcaccaccaccgccgctccttctccatgagccatcgtcattcctcctctgcacccaatcgcacacattagccaccgacatgtcttctcttgcctcccatcgtaatgcacgcggctattatagtcattgttgagatcggtagcaccgggctagtgaggatttagagaggcaggaactgacctagtggagagtggggacgctgattcatgatcctctttattggattcaatggttcccccagttgctggagagaagaaagaaagatgagagatagctagtgtgtggagcgatgacagtcattggacttaggtggatggattagatgagggtggtctaagttgaaataaaatgtaaagttagctggtgttaagtaaaaagaatggttgaagaatggtctaatttgaaaacttgtaagaatacctagcccaaatagcaatttacacttttttttcagcacaactaaagggcatgttcaatttgatgcatttttaaccataccattttttagtaaagttgtcaaaaaaaatgtctacatttagtttgttgtcaaatttggttaatacataagaaatcatgtcaaaattttagcaatattggcatcttgccaaagttttggtaatattggcatcttgctaaaattttggcattgcaaaacttggtaaggtttattttggctacaatctgaacaggcccaaaattgggttgtccatgagccgacgggcccatgctttgctataccaactatagttttatcgtgtctagatggcatggttgggctagcctatttaaacagaatccaccaaatcccacctccgaaaatcaacgtcggcataccgcttcttgcatagaatgccatcatcctcaaccctaaggaacccaatcgcgcgaccacaaatccaacatccctacaacaatccaatacccaaatcgcaccacgcgctgcaagaaatcggtggaaacgaaatatggtggggagggggggagaagagaggaaatgaaggggaggataatttttacccaaggtacaactttagtgcgactccggagcatagtaaaaaaagagatcggcccgacggttgaaccgggaaaaaccagaaccagtccctagcatggttcaatttgtagaaaagatcgtctatgcatatgaaccagcgaaaaccggttagaccggatggttttatggtgaaccgtcttaaaaaccaaagcgagtcatatcgtaaactgtactagctacatagaaaaaaaattaaattcttggttgggcaattaagagtcaaccccaaaccttttgagaaaggatctgcatgcctatagagtatctccaacatgttatctaaatttgactctttacatgttcatttggccaacttgccaaaaatttggagagccaaatttatctttcaattcaacatgctctccatcatagcaatgggacccacttgtcagtgtctatctccttctcccttcttttctctgcacaatgctcccctcctcattcctcccacctaccaccgccgatagaggcggcgaacattgaaaccgctattccctcatcgattcctacgtgtcgatagcaggcgagcggatctgacggcggcagaggtgtcggtgaaaaacagtggtgacgaaaatgggcagtgacgacgaaaattggcgatggcgatggcaacattggaagggctagagatggggacgggggcacagggaggagctgcgtcaaggaggaggggcggcagaacaaccgtcgagccgccatcgttgtgccctgttcgtcgattcaaatcccatcgtgggggaaggattaggatgagaggcggcgacgcttgtcagctctgtccggtggggttgctattgaggaaaaggaggtggggtcgctgccgctaccattgcacccctctccaccgatcgacggacgcggtggacagagaggagaggcggctccgatgactgcataattgtggcggtggtggcggcggtggggggaggaggatctgaatatgtgacccacctttggcaagccaagaaggcttgctagatttagccagtcggggggttgatttggcaagcaggacgacaaaatctgttggagggtgttttttctcttcacttactaaattttagcttggagagtcaaatggccactctcttggagatgctgctcccacctaaccaactatgcaagaggatcttgtaggtgaggatagaaaaaactactttgagagtggattacaacttaaaaaataattaacaataaatcggcggttcgactggtggaccgatgaaccgacatgctcaccaggtgagtccctggtccatgtttttccaccaagttctggaggcctcatccacaatcttgctcatgggcgtcactaggcccggcgacatccggatgatagtagggtacactagccagtggaggtcacctggcggtgtacctgtctctagcagatatttaaaaattaaataaataaaacgccattttggagtgttacagttcaaacgcaatttaggcccggacagttcaatgtggcattactcctatggtagaacaacatcatggttttcactaagcaagtaaaatgcccgttctttcttttctttctaactcacaaaggaacttggcttttatttaagcctccttgaagcaaaggtcttctgaaggattttcataagaattgaactaaccccatgaaaatcctgtaaaattcatgagttccaaaggagccttctcatgacgaaatacaggatagacaaataaaaaatgaagagtgaccaataaaacatagtcatcttcattttacaagggcaatgcttggttggatagaatagagcaaaactatatgacaggctctagaccgtttcacacaaccaaacgcatcatcaaggaaaagaatgcacgaaatttgaaagctagtcagcatcatcagtaaataagattgggtcaataggttcacattttctcatgttgagattcaattcatggagaatcctacaagccccatgaaattcagggcaagaatcatccccgaagatgaaccgatgcacccgtcctcccacctcaacacaactctctcccgcaaccttcttcatccctccttccctcatcaccctccttgccttcgctgcctcgtcccatgatccaatttcgcagtagatgtttgaaaccatgacgtagttcccgcttctccggggctctagctccagcagtttgccctgcaccttgtcaatgatctcaatacagtccttggagctatgcagctggcaggctgccaataatgtcctccacacaactgggtcagcctcgactggcattcctacaacaaagtcataagcttcctggagaagaccgttgcggcctaggacatcaaccatggcgctgtagtgcgtcatcatcggcacaataccataaacatgctgcatttcgtggaagaaccggcgcccctcatcaaccaggccagcatggctacatgcacaaagcag

SEQ ID NO: 92723 - DNA, 2058 bp, Oryza sativa
cgcggaggcgaggccgtccttgacggcctccgagtgcacggatccgacaacggggagggatcccggggcgaggcgcgcgagcgccttgaggacgtgcgggagcgtgtgcgcgtcggggcggagacccccgcggcggaggcgaaggaagagggcggcggcggtggaggggtccggcgaggaggcgagcgggggaaggaggaggttgaagaggtcgagggatggggaggggagggagaggaggagacggtgggcgaggtggaggtggggattgggcagcgaaatgaggcggcggaggaggacggggccgagggaggggaagcggccggaggtgaggagatgggcgtggatctgccggagatgggggacggtggtggcgccgccgccgccggcgatgagggcgtggaggtggagagcggccattccatggaggttgcgcggcggcgcgcgacggccgacggcgatttggtcgtgggggaaagcacacgctgcggttgctgttgggcctaacgggcccggcccgctcgatacttgcatctgcatcttttggaaaaagtacagcgaaggtccctcaacttgtcatcaagttacaaaatcgtccttgaactgcaaaaccggatatgacgtatcccccaacttataaaaccagtgtaaaataggtcccttggcagtttaacttcggttttatccgatgtggtagctgaatcagcgtgggacccacgtgtcagcctcttcttcccctcccctctccacctctcttcctctctccttccctctccacgggcagcgcccggcgaagaggagctaggcgcgggcgcgcggcaggccagtgcggcgggcgcgagcaacggccgacgggagaggagttgggccacggggtagcgggtgctcatcaggcggaggacgtcgatcgatggggatggccgcgccatggcctccttggctatggcggtccccatgaggccacaaacgacgatgactagaagggtagaacctgggaggaggtcgagcgcgggtctcctcaagcgatggcggcaggggctcctctctctctctcttcctctcgttcccttcaagcccatgacttcctcggcaagctcctccagccaccagccctcgacgggcacggcagcggtctcaatgggtggactcggcggagggtgtggtgtggacactgctcactctcctccacggacggggattgtggcggcgagcggggtggaattgaaggcccttcaaagcttgtttggtaactcgagggaaggggattgagagtttacacgagagaattgataatgagattaagatgggaatttgatttttaatcccaatatcttgtttggtagaggttatggaaattgatagggagtttagttggagattagatcattaataaaaatggatgactgagatttgcttagattaagtaaaggaggaattccctcccaattacctgctcctacccacgtattgaaaaggagggagttccttcctcaattccccatccccatccccatcccaccaaaattcccatgtctcccaaccaaacaaaacacttaatagcctcatccctctaaactcccaatccctcctaaaaactccctccaaccaaactataggcgatgtgtttggtgggtcaactaggcggaggagacgatggggaagagaggaagggatggccaccaccttcccgcgcgctgatccgccgcccgccggtcgcgcccagctgctccccccgccgcctgcgcctgcccacgcgctgctctgccgcgcccagctgctcccccaccggccaccacccatgcagctgctcacccgccgccgctcgtggagaagagaggtgagaggaagagaggtagagatgggaggggaagaacaggctgacgtgtggggcccacgtgggttccacgctgagtcagctaccacatctgacaaaaccggggtcaaaaccaccgagggatataatttgcactggttttgtaaattgggggatacgtcatatccgattttaccactggtagagaaaccatctttggtcggtcgacccatatccataatagt

SEQ ID NO: 92724 - DNA, 685 bp, Oryza sativa
caatttgctgtgtgtttgtgtgcacgctttcaagcttctcctcgtgcttcacatcgtcaagcggtcaagcgaataatgaggtatttgaatcatacacttgagtttgaaatttggtattctacttcatcttatatatgcttaagtggatattcagatgctgattttggtggttgtagaattgataggaaaagtactagtggaacatgtcattttcttggtacatcattgattgcatggtcttctaggaaacaatctagtgttgctcaatcaagtgctgaatctgaatatgttgctgctgctagttgttgttcacagattctttgacttttatctactttgaaagattatggtcttacttttgagaaagtacctctcttttttgataatactagtgctatcaatattgctaagaatcctgttcaatactcacgcacaaagcatattgatattcgttttcactttttgagggatcatgttgagaagggagatgttgaattgcagtttttggacacaaagttacaacttgctgatatttttactaaacctttggattctaatcgctttgcttttcttcgtggtgaattgggcataattcatccttttggcatggtttgagggggagtttgtacctcgtggttttatcaagcaataatatgacaatgagaaaaattgataaaagagagct

SEQ ID NO: 92725 - DNA, 724 bp, Oryza sativa
ccctccccctgcccaatctctccatctctcttcccagttaagcagggagagtggtcatgatgcagaacgagggcgagagggtcgatctgctggccctgccactcgatccggtgggtagacgccggcctccccctcctgcgcttctcctcgccgccgacgccctcccttcccccaacacacacacacaccataataatactactcctctctcttcccagttcaagtaggggtggtggtgatggagatcaaccagggctgctggtgatggagaacgacaacgaggtgatcgatctgctggcctatcgctagatccggtgggtacatgcactcaagctcgccatgaaggtctggatcagtgatgttgcattgccatgggctattgttgtgttgaattctccgttggttagtagttctttgtctctgtaattcatatttgattccttttgctttgtgctctcttcagccgatgcaatccttctccatctccacagtgggttggcgcccttctgctcaagtttgaagctccgctgccgtgcggcgccgacactgtttcgcaattgcagatctggccagcaacaggtaatctgggaaccatctgtcgtcgcctagccaagggccatttgcaattgccttgccattgttatttatggtgtaattacttaggggcaatggatgtatgcaacttcatcattaattgagaatccatatgtataggtattttggg

SEQ ID NO: 92726 - DNA, 1470 bp, Oryza sativa
aagtttttgtcccaagctccaccaaaatcaaagagcgcaagctctcaacatatcttacaggatttgattgactcgctcggtctgaccatcagtttgcgggtgataggccgggctaaaatttaaacgggtccccaattctttctgcagcttctgccagaattttgaggtgaaatgactccctcgatcagatacaatctttgtgggtactccatgtagacatatgattctcgagaggtaaagctccgccaaccttttgcccgtatacgtggtatgtactggtatgaagtgagcaaccttagtgagtcgatccacgactacccagatggaatcatgacccgatgatgtccggggcagtcctgttataaagtccattccaatctcctcccatttccattccgggatttgaagaggttggagtagacctgctggtctttggtgctctgccttcactcgttggcaaacatcgcagagtgcgacgaattcagctatttctctcctcatgctgacccaccaaaacttttctttgaggtcttgatacattttggtgctgcctggatgaatggagtactgggtctgatgagcctcggtgagtatcagatccttcagttccttgtcgtcaggtacacacaatctttctcccaaccagattgtgccgtgttcatcttcatggaaatcccgggcttttccgactctcatgttctttttcagctctgctatttcagaatcatttacttgagctgctctgacttgatccacgagcgtaggccgtgcctccagagcagctacgaacctgtgttcaacaattcccacgttgagatgctcaaactcctaccgcaattcctcacacatgccctcgatgcatagggcagtgcagtaacttttcctgcttaatgcgtctgccaccacattggctttacccgggtggtagtgaatgctcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaggtcatgagtcggataattcccttcgtgtggacgcaactgccgcgaggcatacgcaaccactctgccctcttgcattaggacacacccaagtccgtggcgggatgcatcgcaatagacttggaagtctttcatctggtcgggcagaatcaaaactggtgcggatactaacttctttttgagctcctcaaaactcttatcgcactcagctgtccatttaaacttctcatctttcttaagcaaccgagtcatgggtcgggcgatcctggagaagttttcgatgaatcggcggtaatatcccgcaagtccaagaaaacttcgaatctgtgacacggtcttcggtggggtccatttggtaactgactctac

SEQ ID NO: 92727 - DNA, 1152 bp, Oryza sativa
attaacccatgcatcccgacaaacttctttgaaatgaacgaatgcgttgcaccagaatcaaaaagtactgttgcagggattgagttaacaggaaacgtacccagtacaacctctggtgctgtttgtgcctcctccgcagatacgtggttgacacgagcttggataaaccttggcccggcacgcctaggcttcgggcatttgtcagcgaaatggccaagctcgccacagttgaagcaggaccctggttttgctccagtctccttggcttgcgcggacgggcctgactgtgccggtgtcattggtgggcgtggagatacaccgcggttgggctgacctccatggtggttctgactgccactggcgccctgggaaaattgctagggttgaacgggcggtactggcggacgatcatggtggtaggtccaccctgctgtccaggagtgaagtgcggcctctggtgacttccctgatgtgccctgaactgagcggccttcctcttcctgtccatcttgttgcgttgatcctcctgacggattgccttgtcaaccagcctctcaaagtcgacgtagtccccagatattagttggttggtcagctcgtcatccagacctgccatgaacttttcctgcttctcggcgtcggtgcggacatcctctggtgcatatcgcgtgaggcgattgaactcatggagatactccgtcacagtcctgttgccctgatggagtgcccgaaattccctcttcttttgtgccacgaccccgtctggcacctgcgccttcctgaagctacggcagaactctgcccaagtgacttcagtacctggtgggcgggtggccatgtgattgtcccaccaagctgacgcaggaccttgaagctggtgtgtggcgaaagcaaccttctcctgatcattgcactgcaggagattcagctttttctctatggcatggagccagtcattcgcctccatagggttggtggtgttggagaaggtgggtggcctgacacgtagaaactctggcaacttggactgagggggagggggaccaaactgctgatgctgctgttcggcgtgctgcagcatccgctggtgcatctgctggtgctgctgctgcatctgctgcatcatggatgccatcatctgagtctgatgtg

SEQ ID NO: 92728 - DNA, 2244 bp, Oryza sativa
  unsure (1)..(2244): unsure at all n locations
cctgcagcccntataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtctatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcaattgatgcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaatacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaacccttcgttggacagaagagggcacgcgggcaacgaggtgcagcgaagaagcttgagggtcggcacatcataacggaa

SEQ ID NO: 92729 - DNA, 587 bp, Oryza sativa
ccgtcataagttcctttgttaattaagaaaatcttgttatgttaattgctactacgaatcatagctttaaactccatgtagagcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccgtccttagcttctgagctagcagcg

SEQ ID NO: 92730 - DNA, 1473 bp, Oryza sativa
tggtgttcgagagatgattctactcgctcgctggttctcgaaccagtgcgtagcaatctcccccaccgcaagcttccattgatgttcgagagatgattctactcactcgctggtcctcgaaccagtacgcagcaatctctcgcaccgcaacctcaaatggaggaggtacgactacagcaataacacagcggtcctcgcaccacgacttcaaatgatcgagataaacttactcactggttctcaaccagtcaatcgtagcaatctctcgtacatttacttctagtggttgagttacgactactacctggctcttgaccagaggtgtagcgattctcccattacctctacttcaacaaagttgatatcaggtacacgatatcgccaagtgttttacccagagatcccttaccacaaaagacacctagcgttgaaacctatcctaatgttcctttacgccgtcttgacaaagcctttgaggaacctaagggaacttcggctgggaacgcccagagcggataaggctttgtcggatccttcagagacgaaagaccatgtaagatctggtcgtgtaagagttctcgccgtgcgtattaaccaagccgtgtaatcggaaatcgggtttttcaacttcaaggctaggggctaggatcagtgcttgttcaactaaggcaggtcaaaggtccaagagccttatcctccaagaacaattctccgacaaaaaggctaggggctagggagagtatataactcaacaaaccgactgatcgtagtcggtaaaagagtagacgctcatatacaaaacattggcctgtaagtttaattcattttctgttttccatacatattataacatgtcacccttagagcgttcgctcgggggctatttctatctaatattcttttctgagtattgatttcaggaaaattctattcgacattgtcaaagacttcatgtctctatggttctacaccaagatcgactaaggcaagtacgacaaatgttgacaaggctccgtcgcagactctacgcctactcgattactcgagaacggttgatggatctcgacaaggaatacggaatgaagagatggtgtacccgccgagataaaatttcttgacttcaatccaaattcccgattacagcaagacgggagacttagtcgtatgctctgtactttcttggttgacatcgaagattgactcagagaaaccctttaggtgcccgcacgaggctgataaaggaagtctaacgttatctccgaactcatcaagaacagtcacgagagctcgacaacagttcctacaagatctgcggttgagaatatgaacttgctcatttgcattgaagtcgggggctactgtcagggttatggataccatatacctaatagtagttgactaaatatgggcaggacccaccacataccatgtcctatatggaaacaacctgcggatataggaggagttccggat

SEQ ID NO: 92731 - DNA, 2261 bp, Oryza sativa
cagcaagaaatcgacgatgacccatgtagacaaccttcctacagtgcttaagatacgtactttctgtttcatccatacagtgagtgcaagccttgtaccccttgttagactgcccggataggttgctaagtgcaagtcaatcgttgatggttacgaacagcaacgatcgtaggttaaactcctcctgtttgtcctcgttccacacggggacaccttccttcttccacaacagtttaagatcttcgaccagtggtcttaggtacacatcgatgtcgttaccaggttgcttggggccttgaataataatcggcatcattatgtacttcctcttcatgcatagccaaggggggaggttgtagatacacatcgtaacgggccaagtgctttggccgctgcttatctctccaaaaggattcatgccatccgtacttaaaccaaaccgtatgtttcgtgtgtcctatcaaaagtctttaaattttctgtcgatgtttcgccactgcgaaccatcggcagggtgtctcagcatcccgtcctgttgacgttcttcagcgtgccaacgcgtcattctagcattccccttattcctgaacaaacgacttagccgtggttttatagggaaataccatatcaccttagcaggaattctcttctttgttggctgcccgtcaacttcacctagatcatctcgtctaatcttgtatcgtagtgctttacaaacagggcatgcttctaggttctcgcactcctcaccgcgatataggatacaatcattcggacatgtgtgaatcttctgaacttccagtcctagagggcaaactatcttcttagcctcgtacgttgtcttaggcaatttgtttctctccagaagaatgttcttgacgagttacaataaatcgccaaatgccttgtcactaacaccattttttgccttctattgcaagaactccagagtggtatccaactttttgtgcccctgctcgcaacctgggtacaacgacattctgtggtcatctaacatatgctccaatttatgggcctccttttcactttcacactcctccttggcgtcctacaacatctgaccaagatcatccgcagcgtcattatcgtcagcatccctgtccacctcgcccatttgatttccttcaaatgcagcgtactgagcccagtcgggaatgttcccgtcctccgcttcatcttcttccatttcaaccccttgcttaccgtgggatgtccaacaattatagcttggcatgaacctcgactcaaacaagtggaaatgaatagttctggatgtagaatactccatcttgttcttacacttgttgcatggacaacaaataaaaccgctacgcttgttagcttcggccactctaaaaaaataatgcacaccgttgataaactctttggactgccggtcagcgtacatccattgctgatccatctacatgaaatgaaaaaaaatcgtacataaataaattttcgtacaattttgacagtggaacaataatgataaaatatttaaaaactctttcgacaagcatacaataatgacatatcattactcatacaattaataattataaaataatccaacaaacaattcttattaactatttttgaagttctaaactaatattaatgttgtacttctcttaattttcaatttagtttgttttctattttttaagattaattttcattatattttaaactatgagaataaaacttttttaagtaaaaaaacaaaatttctatatattcttcttccccatataaattttctctctcatcaacttacaacaaagttttggagaaacaaaaatgtgtgaaacatagctccaaaagtaatataacaacaaaaaacattggaggatgaagttactaaccttttagacacctccgacttgtatataatcactaaaaaaatttcacaagaaattttggcatgacctcccctctttttttgagaaattttaaagcttgctcgggctggaggaggaagaatacatatataaagggggggatttttagtcccggttggtgttaccaaccggaactaaagatcacatatgcccgttgtagccaccagccgggactaaagatcacctttagacccggtttttagtggaaccgggactattgtggatttcggccgaccgaccaaagatggtttctccaccagtagttcatgaattcacccaccactattcaaattatggtgccaataaatattactcactccgtccctaaatataagg

SEQ ID NO: 92732 - DNA, 8270 bp, Oryza sativa
tcgtgcacgcgattggattttccacagaagagaatactaactcttctgtttttggcatggttgttttttccgttggatttggcccagtaacagtctcgcaaacacaaacgcatgacgtcatcgccctttttcccctttttttaatccttcgtcggttccttttttttttcttcttgtgcacgcatgatgtaaagccaaatgcagattctctgtgcaaacgccaaagtcaatagtctcacagcccaaatcaccgttttctctttccctctttatttttttattatttgtatatggatatacatgaatttgtttctaaaataatgaagtttaaaatctattttcacataaatgttctctaagattagatttaaaattacacccacgagcaagtctaattccaaattggactttgtatcctttttaaaaaaagaaaataccgaaaagtctctttttttatatattttgtgcatagaaagtttatagatattttgtgcacagaaaatttagagacaaaaaatttatatgtataaagtttacagataaattttactcgcataaactttatatgcatagatttatgtagaaagttaggtttaaattataaatatatatatatactgggctacatatatacatgtgaactttttttctcaaatttgtacgtcaaaaagaaaaaaaaatgcctaaggatttttttttgtttgaaagctcgtgtgcttggtactgccatcgcgggcttgcgtgggctctaattcaaatagccaatggaaactactaaaaagttacgtggaattggaatggctcgatgggctttgccgagatgcatgcattcacgcagatgtgtaggtgtgtttttattgtcaacaccaatcgcgctccttttcggaagcgatcgctcacccattagagatacccaaaatatgccaaccttacttgaggtggggtgcttacaatcattgccataaataggtaagacttgtcccccttctttagtaggtttggttacttttgttcgatcctactatatctccgccgtctcgatcccttccctccgcacttctttctccgtaactctccacatgtcttgtggcgcagcagcggtggatgtggctacctagcacagcggtggcgcggtggcagccacgtctccgtggtgctgcaacggccaccaacacaacggcgcactggggggccacgttgattattaatagtttatttcgtgatgattccaactggattgggtctcttctgtatttgtgattattttgtgatgatttcgatttgattgggatttagttttttttgttagatttgtgatgctattttggtgcgtctgattggattgggattcagatcttaactgtccactgcagccacattccacatccatccccacattccgctctgctctacactgcattttacatcgacaaaactacatgcgttccggtagcacaccacgttcatcaaagattcatttcgatttcgacatgtttcgcagacaggaatgcaaatacacgcaaaacatgccgaaacctgttcgtcggcatggctgcaggcagtcacgatgccaggcagcagcaccctacgtgccaaccgtcccatggcgtccctgatcgacggctccgacaccacgttgcggatgcactggcctccgcaagccatgacgccacctctcgacccaagctggacaagattccaatcctcctcactcatatccaggctggacggagtgacgacgccacgctgattccgccttcgtgctgctacaaagctgcgtccgcgcccgaagacagcgccacgaagccaccctgggccatgccgcaccgggtccccatcaacgactccacatcgcatgcttcttcacacaacgagtaaccggggcatcgttatcattggcatccaagctgcgcgcggctcgtccatgtcacactctagtagatgtcacgtccactccattctaggctccccataaatgcgtgaggaagaaccttcgggtacgactatagtgggtggatagatattggaagcaagatgaaggtggcatgtgttattccttctccattggatggttaaatgttttaccgtcaacaattataccctcggtggaatgttgcaggatgttggggttttagcatacaataagagcataaatgagaagttcattagcttgtgatagatttagagacacatgtttaccttgggtgcaagccaaaatacacgaagttgtcttggagcttacgaagcttatggtaagtaatggatgatcggataagtctatcacataacaagacgttctggccattggggttggaagtcagaagaattcattttcatgtccgaacgactatggccccgtttggcacaactccaacttacctgcagcgggagttgtgccaaacggtccagattcacctttttttggagtggaattggcagagctactcctagaaaataaactagggggtggagctgggtttttgctgctccacagctccactccaccccaaaagacccactaccctctaatattttagtgtatttacacgaaaatgccactcaactaccccttcacccctcctttcctcacgttctctctcctccccccaatcttcctcccaatctcgagctagtgcggcggcgtcggcgggctgcggcggcagcggtagcgtcgacggcgacaggcagcggcagcggcggctgcgggacgacgaaggacgacaacgggcagcgcgcgtggcgcgcacgcgcgaccggaggctggcggcggcgggctgcggtagcggcggagagcggctgttgcgggacgaggacgggcggcacggcggcagggccagcaggtggcggcggcccatcttcttccccatcctccgacgacggccacaaccggttgtggtagtgtctgcatcggcagcatacgggggcagcgagcgcgggctatggcgcgttggcggcggcaggcggtggcggcggctgcaggcggtgttgcagtggccacgacgggcggcacgtggtggcgtcggcattggctcacgggcggcgacgtcggcaggcgactcacgtgcgggggcgtcggcaggaggcagcctgggcggcggcttgtgcggcggtgcttgtgcggcggcttgggaggcggcggagatgcgtgggcctcccggcggcggtggctcgcgggctgactggctgtggcggcaacgtcaaggcgacgcctacaaggtgttcgatgaaatggcaacaaaggatgtagaaatgtggagctgagtaatcttgccaaacactttttgacctacctcagctcctagaggagccagctctcattagagttggagtttggagttgggagttggagttaggagctctaccaaacagggcctatatattgtaaaaaaagaaaatatcgatttgtatgcgtcccttgtatgtggtggtgcttcttggttcaagagagagaacgattgggtagaaggtaagaagcccatgaagggtgccactgtaaagtttgtgcggtatcttctgattgcacattatctcatatgaaagtttatcaaagataaggagattgagttagtctattgccatgccataggtcaaaaattgcacagtatgcttaggcaccatgcgaatttgatatgatggaggaatatcaacgcattatacctagaatccttttggtgatatgaataggcacctttggtatgcatgaaatagggcctaacttacctgtgatgggttatttgtaaaaaaacttatcacatgtgagttacctgtgactattccacgcccatcataggtattttcactgtaacaggccatatctcaacagctgtcacaagaaacttacctatgatgggttgtgagatacgtcctgtcagggatgaggttaaccagccatatgacctagtaagagccatatggccagtttaccctagatcttaccaaacgtgccggacaacaacctcaatcctaacctaacgcagcgttcttatcacacccagctgccacctcctccttaagcctggtggtgctgcatcctctccaagccgagatgctttcacctgcgcactgttacaattgcacctcttccccgagcatggtagcctcgtcctcccgtatgtggttgtaattgtcaaatttagtgattttagtgacttctcagtgatttattagatattgcaataatgctttgaaataaaatattagtgacctattagtgactttagctttatatttgtgagtttggtggccagacatatgaaggtccaaattgatataacgatgaacaattgacatactatctcctagatatcccaccaaacaatgacattataacatggggagcgggggcacatgtatccaatggtccaagataaatctagtcacgaagataaaagcgcggtcactttacccaccttggcaagctcgactgcctcttccgaaacctccggctcttccaacacttccttaacatgcgtttatggaactacaatttggtgccggtcctatggacttctaggacgatgatatacctgaagatttcactggtggagaaaccatctttggtcagtcgaccaaatttcacaatagtcccggttccattaaaaaccgggactaaaaacgatttttagtcccggttaaaaaaattttgatctttagtcccggttggtaacaccaaccgggactaaagatgatttttagtcccggttcatcccctgtcagatgtatgtcagggggtcgaggatctttaatcccggttgatactaccaaccgggactaaaaattaccactttagtcccagttggtgataccaaccgggactaaagatcgatctttagtcccggttggagttatcaaccgggagtaaatatttctctcccacatccgatcggttaagtcccagacagatatttagataagattggaacatcccctctcttcctcttctcagatccaatcctcttcctcctcccctcccctcacttcctccccttcctcttctcctcccctctccttcctctttctcccctctactccgtcttccatcagccagccggcggcgggcggtggcggcgcggccacgaagggggaggcggcggcggcacggccgcacgcggggaggcgggcggcgggcggcgcggccgcgtgcgtggaggcgggcaagcggcggccgggcgccggctcgtttgtttttgttttttttataatttgtctttcactggatgtataattgtttagattttgtgattcattgcatcgcatggatctaagatgtataatttgtataatctatgatgtatttaatttgtgtgtagttttttaggatttgtgatgtatttgatctgtgtataggatttgtgatgtatttgatttgtgtgtataagtaacttaatatttgggatgttgatttggggatgtgcatcccattcgattcggaagaaaatacatagattaacactagccattagcaaatcaacaacaaaagaaaaaaaaaaggatctcgaggaactgtcgcgaactgtcggttcctctctttagtcccggttggtaacaccaaccgggactaaagatagcgatctttagttccggattcgtagtcccggttggaaaaccgggactacaaagggttctaaaccgggagtaaagagcatttctccaccagtgcaaatttgccacccatgaaggtctccatcaggtccaaatcttctccattgataacccacaatataggttatggaaggagaaagtgattgttgacgacgatgaacaagtacatatgggtacgttgcctgcgaataactacacccttggtacattggggatgatgaatgccaataggtctcaaaaggaaccatccttccttggtcaattaacatgataaaaagacattccttttgtcaggatctctctactcgttgtgggtatcaatgatctccataacatatataggctctgagcgatgaacacacgattgctaaaattctactatttgtaagtgctctttgcaatacaatatgttaaaatttgaactgaagatgttctacagtagtttgtaatcattttagggcttgttgcctacaaaaccgtaggatgggtaaccaggatggtttgctatatgcaagtatgatccacaatctcagagtaaataccaaactagataaagtaataagatatgtgagggtagaactattatcagtagcctagggcgctagatctggccactccatctcccggtccagtacatatggcagccatgatctaggggtccgacagattaggcccacccaaacctcaatgggagaggaactcctgcttggtaaaaccagaactacgctaaggactgtgccactgtggcaggactgttcgaatagtttgttaacctccacagtggagtacactttacccacatgatgctactaacaagtgtcaaccaccctatgtagaaagccgacacatggttacttcctacactgaacattaccaggtgactttggggctttcgtgacatgtcatttcgtaacctgatacaggttttcacgacaagtcctgttgtgccatgaatcctcagtattttccctaactcccctgggatcgacatccataggcattcaaggattccctgttttagcttgttacttagccaagggtgttccacttcacccatgtggtcgcactttttatatgctcgatatgttctaaggtatcttacgttgctcagggcttcacggattttcctgaaatccaatcccggacagaattctggcaatgcaagctatacacaaacaaacaaaatccaacacagggaacaagaaaaggatgctacttaactactaatagagccacttgatagagctcaaataaaaaaaaaggtggaacgaggtcaatcggagctacgaattaatttcaaagattaattgattctctagacaaaggacaaatgatatatgcaatttcaggaggggaatattccatgtagatgttgacacgtggggtcaaatgtcagagagacacaacccattgggcacaccatggaccaagttcacgggcgactggctcgataggaaatagatggccatcattccataggcctctaggaacgatggctcggccaattcggctggggcaaaaacgcaatctaacagggcaacgctcttgaaattttttatttaagtattttaataatattttttgtttaaaagttacagatctggatgcctctcgttgtctgggatggttttttcttaaaaaacaccctcccagaggaagttttttgtgatgtgctagacgaccattagccacttgcaaatgactgctttccgggggatgtagttttttgtaggcggctatgttgcgaccctccccgaggctttttttccctcaagagtgggctgtctgcaaaatagcggtgagggcaggctggtgtttttttaggggtgcctttgccggccttacgaagagcatttattttttccatagggggccgcttgcaaacctagttgaggtggcctgccattttgcaagcatccccttgccgcccttctgtagaggtcttttttggcccagggtataaaacccccatctctctcctgaaattttttttactattccatattataatatttcaacctattttacatattttacaaatacaactcttatacccacacatcaaaataaacaattggcagggaaaataattatgcaagaaaataaacaactcaacaaaatttccttatctcacaagaaaaaaacacactccccgagggcaaaaggggccctcctgcaaaatgccagccccctcgactggggtttgcaggtggccacctctggagcaaaaagtgccctctaggagggtagcaagggtgccggatgagagaagagccttgccacctttgcttccctttgcaggcagcgctttgcggggaaaaaaacaccctccttgaggtttgcaaggaggctacctgcatattctacctctctgggacgccctctgggagggcattttctagagggcgttaggcatctagtttgtaaatttatcaattgaaaaaatatctttgaaaatatttttaaaaaatatcatctctgtggtctgcacaggttagtgactagtgagcaatccagtgagataacacgccttttccgtgttcagttgcttcgtttagggcaagagatggaagtccatctcgtaggtcttatatgaaaatggtggcggctagtattcgccactcacaccgccaccattggaattttctatggaccactgttggtgtcgt

SEQ ID NO: 92733 - DNA, 4572 bp, Oryza sativa
gagaagaaagtttggacaaagcgtaaaagaggaaccaagatagggagattaaagcacatccatccaagtactgggaagccgttctaccttagaatgttgctcatgatagttcgaggatgtatgagttttgaagatattaggacatatgaaggtgtgttgtatggtacctatcgtgaagcctgtcaggcacgtggtctcattggtgatgacgctgaatgggatcacctctttgaggaggcagttatctgggctacttcataccagctcaggaaccttttcatgactgtactagcacactgtgatgtaggtgatgttagggttttgtttgataagtactggagatacatggtagatgattttgcttacaagttaaccaaagctcttggagtacaacgcacagctattccagaagttatgttgcaggataccttgctcaaagagttggatgccatgttctcaaataatggcttatcaatctcatcatacaatttgccaacaccagttgattgttcaggatccagtgcagcaaacaggcttatcttagaagagctttagctttaaccaacatagcctccatcaagaatctttgtccatgtatgccagcttgaacaatgaccagaagatgatatatgacaagatttttgacaggatagaccatcacgaaaagtgtattttttttatatctggacatggtggaacggggaagacattcttgtggaatgctattatggcaaacatgagatcaagaggtgaaattgttcttgcagttgcctcttctggggttgcagctctgctcatgcctggtggaaggactgctcattcacggtttcggatacctatagatatacatgaccggtcgatgtgtgctattcgtagagggacaatcctaggagatcttattaggaaagcatcactgattatatgggatgaggcgcctatgacacacaagctgtgctttgaggcattggatagaactctacgagatattcaatccgctgatgaaccagctaatgaatataagccttttggaggtaaacccattttacttggtggtgattttaggcaagtcttaccggtgattgagaaaggtacaagagctgatgtggtagatgcttcgctggttaggtctgcactatggaagcatgttgaagtcttacaccttaccactaacatgaggctacataatccatccctgtcgcagcaagccaagggtgaattggcagagtttgctaaataggttcttgacattggtgagggtcgtgctcccatgaacaaaagacaaggtgaggttgagaggacatggatagagatacctaaggagttgctgcttactccctgcggtgacaagattacagctataattgatgccgtgtacccggattttgaattgaactatgactacattccttacctttctcagcatgcaattgtctgtcctgtcaatacagttgttgatgagattaatgataagatgcttgctaaagtgcttggggatgcaaaggactatcttagcagcgacactatttcaaatacacttgaaaagcctgcagattttgatctattgtaccccatagaatttctaaactcaatatccataaacaatttcccgaaacatcgcatatccctcaaaattggttcagctgtagtcctgcttcgcaacattaaccaatcactcggcctttgcaatgggataagattgatggtcacccgactcggtgattatgttttcgagtccaaaatcatgactggcacaaatattggccagctggtctgtattccacggattgtcctaagtgggaacagtccaaagtggcctttcacgctccagcgaaggcagttcccaattaggttatgttatgcaatgacaataaacaaatgccaagggcaaactttggggaatgttggtgtatacctcagaaaccctgtcttcacacatggtcagctatatgtcactgttttgcgcgctacatcgaagcaaggcctcaagttgttgatagaggatgatgatggcaagccttgttccactacaggaacatcgtctacactgaaatattatcgttgctgtagattaatcttattgtcagtttgtcactgtgactgcagctaggatactttgctccttttgttcacctgtttcttctatgatcccatttctccgtgttactgtttgcttgtgtaacttaagcaagaactcatggtcatacagtgttctgtccacaatgactatccgtatttttggttttcgctatttgttactgctttctttttacccttcaatgagttgttgttcatacttgttttcttcctatttgaccagttgattgttgcagtgtcttccatatctgcttattaattgttctttcttatttttgcatattcttctcttggatgcaatcagttgcttttaaacatgcctgcttgaaacactgtcagttgggaaacagttcccacctcgaaaaaaaaaagatatatcctgcaccacagttccttcagcaattaggactttatatcttcatatcatgcaaggtattattattattattattatagtttccctctaacctatgtaatgccttctttatgtgttgtagatggattacactatgctaagggatgtgacacaggaatcacaccgttggcaggtccgagtgcgggtcactcgcttctcgcagttcactacagcaaatgaacctgacaagattctgcgacttgatttagtcctgcttgatgagcaggtatagcaataagcacatggtcatgccttattttacctccatgctatttgtctcttacacatccaaacatcaacagggggacatgatggatgcgcagatcccaggacgtcatgtttctcaattcaagcctttgctgaaggaggatgctgtgtattacatcaagtacttcgaagttgctgaggcgcgcccctagtacaggcctgttgatcggatggtcatggcaaaattcactgcccacacaaccgttaaagaagacactgaggcaccatccacagtcccatctcatgcttacaaggttctttcttttgatgatattctttcaggtgactctgtttggtccagatcaatctatctcattccttattagctttgtctattccctgcttactgccctcacttactcatgtgcaaattttatcccttatactactcctgtagatgctataggtataatgacacccattggaccagtgcaaactgtttcttgtggaggtgttatgaaagctgtgcttaatgtccacataaccaatggaaggtatgtatgcgttaatccactaattgttccagctgcttttgtattagatacaaaatgacttaattgtccgcacatgcattgtcagtttctttttacacatgtacaatccttcttttttgtttataatatcaacattgtttcacaactctcttatttgcaaatgtgaatactagcttaattcatgcacattattttccacctcttcattcttctatgtgcctacagcgaaactgctgtcattgcattgtggggtgcccatgatacacagttccacgctgaaaacttacagcagcaagcaaaccatggacctgaggtagtattgtttgttggattaactgttaaattccaaaaccgtaaaaaataaattcttaccctattatcacctctcctatttacatatttgcctgttcttgcttaaataatgtactctttcatgcttgccagaccagctagccctacaaggtagcactgtttgtaggtggtatcccaatgcaccaatccagaaaacaatttctctcataagcaggtatctctttcctgcactctttccattcacataaacatgctcttctttgttcaacttatatcttccttagtttatctgttatatggatcaaccatatttccctagcctacaaaccaaaacactaatctgtttcatatttgaagcctccatggtaacccacgggtggtaagggcaatagagccgaacttcggtcagaaagaagctgtgcatgtaaaagtttctgatatctgtgaccttaatccccacgaagccttggtaatatagtgtacctccccacacctaatgattacattgcataatttccatccatgtgttatcagtgccatcctttacttcctctgtttctcgcatgtgaaccagggcaacagctatattgtcaagatagccatcaaggatttagtccctgctgaagcctggtggtaaatagcatgcaacacctgtaagagaggagcaggtagagatgggaacacatataaatgctcgaggtgcatcactaatgcaattgaaacaaggtactcttaccacctacacacgttcagctcttctcaattgttttacataataaaccattcagtatgctacaatttgagctatagaacataagacctacttctgctaccttatataataggtacagagtggctatcataggtgtcgacccatcagatttagcgaaccatgacgccaaaacagctgagtttactttctttggagaaattggctaccagttgattggcatccctgttcttaacctggttgcatctgtccaaggagca

SEQ ID NO: 92734 - DNA, 540 bp, Oryza sativa
cgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttaccgccggcctgcctccgtcaccgccgattggtgcctccgcctacacggctggcctattatgccgccgctgttgggcgtctacgacttcaccgccggcgtgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgacgttgttggacgtctac

SEQ ID NO: 92735 - DNA, 895 bp, Oryza sativa
aggacaacccttcttcgctctgctgaagaagcaagacaaatttgtatggacacaagaagccgaagaggcattcgttgcactcaagcgctacctatcaaaccccctgtacttgttgctccccaacctaatgaagaattattcctctatattgccaccacgccatattccgttagcaccgtcattgttgtcgagagagagaaagtacaacgaccagtctactacgttagtaaagctctccatgacgtaaagacaagatatccacatatccaaaagctgctttacgcggtaatcatgacatcaagaaagctacgccactactttcaagcccacagagtcacagttgtctcctccttccatctcggtgaagttgtgagaaacaaagacgttgtcggccgcattgcgaaatgggtagtcgagctaagccagtttgatgtccactttgtgccacgaacagccatcaagtcccaggtactcgccgacttcgcagctgattggactatgcctgataacaaatcagacaaccaaatcgacaacgaaacgtggacaatggcgttcgatggtgcactcaacagccaaggagcaggggcaggattcatcttgacatctccttccggagaccaattcaagcacgcaatccacctcaacttcagagcgaccaataacacagccgaatatgaaggactactcgccgggataagagctgcagccgcacttggggtcaagcgactgatcgtgaaaggggactccgagctagtcgcgaaccaggtgcacaaagattataaatgctctaaccccgagttatccaagtatctcgcagaagtcaggaagctggagaaaaggttcgatgggatcgaggtccgacacgtatactgcaaggacaacatcgagccagatg

SEQ ID NO: 92736 - DNA, 605 bp, Oryza sativa
aatgccggaagagacgcgacgggttttcgctgaaacaaaagaaaacccagaagccaacaaggatgggtgagtgaaaattcgcgttgagagaatgaatacagccccgatggtgagagacgaacttgcaagggggtgggttaaacgaccattttggaggggaaatgagggtttcccgaaaatggttttgtttccccattctaaggggcccgttttttttggggttccccttggggttgggaggtggggcgggccccttcggggggctggttattggaagggccggcccggccccttggggaagaaaatggggaagtggttcttcctggtttctttttccccgggggttggcaaggcgggtgcttcccggggccctgttggggggccaaaaaggacgacccccttttggggtaaaatggttcccccttggggttccgcctgggccgttgggggcctttggaggttggttcttttagggcccggccgccattaataatgttaagaaggaagggcggtttggatggtgcaaaaggggaagatccctctgggaaataaggccggcttttacgaagttaagattcagcacccattggaccaatatcttgaag

SEQ ID NO: 92737 - DNA, 553 bp, Oryza sativa
ttctggtcctcaaaaggcgcggttcgggggtagtgcctggggagatccacatgtcgagactggccaggccgggaacgtggtgaccgagggttatgggtgacccgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagaaataagaatatgcatatgtggtagcccccggccaaccctgcacgctcgaggggggtgcggggttggcccgagcccgaaacctgacacccgatcccccctttaggggtagaagcgacgaaggtgttcgatgttccacgggttaggcaactctgtgccgtcacctgtggccagccgaacggagcccggccgggggacgccgatcactcgatacggaccctcccacattggtg

SEQ ID NO: 92738 - DNA, 575 bp, Oryza sativa
cgggagtaaatatcttttcccgctatttcgaaattctttttaaacccggttagggttaagaaccgggattaaagattaaagcactgcatatgattttcgcttacatatgtgtttataaaatagaagttaatgcattaacattatttaaagtacaaagattaatgacaattacttcgaaaaattatttttgtcggtaataaattaagtggataaatcgtaataagcaaatatatgacttataattaataaaaattccaatatatatatatacttagcatatatatgaatgatattattatattggtaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaa

SEQ ID NO: 92739 - DNA, 2464 bp, Oryza sativa
agcaagtgtgagttctggatgtccgaagtcaaattcttggggcacgtgatatctgccaaaggagtcgctgtggatcccgaaacagtgaccgccgtcaccgattggaagcaacccaagacagtcactcaaattcgcagtttcttaggtttggcaggatactaccggaggttcatcgagaacttctccaaaatcgctcaacccatgacacagttgttgaagaaagaagagaaatttttgtggagcccgcaatgcgagaaggcgtttcaaactctcaaggaaaagctggtttcctcgccagtgttaatcttgccagatactcgcaaggatttcatggtgtactgtgatgcttcgcgccaaggattggggtgcgtgctcatgcaggatggtcatgtggtagcctatgcctcacgtcagctacgacctcatgaaggcaactaccctacccatgatttggagttagcagcggtggttcatgctctaaaaatctggcggcactatctcattggtaatcgctgtgaaatatatactgatcataagagtttgaaatacatcttcacccagtcagatctgaaccttcggcaaaggagatggttagaactcatcaaggattatgatgtgggaattcactatcatcctggtaaggccaacgtggttgccgacgctctaagtcgaaaaagccattgcaacactctcaacgtccgtggcattccacccgaacttaatcaacagatggaagccctgaacctaagcatagttggtcgtggattcttagctgcgttggaagccaagcccaccttgcttgatcaaatccgcgaggctcagaagaatgatccggacatgcatggactcctcaagaatatgaaacagggtaaagccgctggtttcacagaggatgaacacggaaccctatggaacggaaagcgggtatgcgttcccgataacagagaacttaaacagctgatacttcaggaagctcacgaaagtccttattcaatccaccctggcagtacgaagatgtacttagacttgaaggagaaatactggtgggttagcatgaagcgggaaattgcagagttcgtggctctttgtgatgtgtgccagcgtgtcaaggcagaacaccaacgaccggctggacttctccaacctctccaagtaccagaatggaaatgggatgaaattgggatggatttcatcaccggccttccaaaaacccaaggtggatatgattctatatgggtagtcgtggatcgattaaccaaggtggcccgatttattcctgtgaagaccacctatggagggaacaaactagcggagctctacttcgccaggatcgtgagtctccatggcattcccaagaaaatcgtatctgataggggaagccaattcacctctcacttttggaagaagctccaagaagagctgggtacccgattgaacttcagcaccgcataccacccgcagacagatggacagaccgagcgtctaaatcagatcctagaagatatgcttcgcgcatgtgtcctagatttcgggaagacctgggataagagtctcccctatgccgagttctcatacaacaacagctaccaagccagcatacaaatggcaccgtatgaagcattgtatgggcgcaagtgccggacaccactattgtgggaccaagttggagaaagccaagtgttcgggactgatatcctgagagaagctgaagctaaagtcagaaccattcgggataatctaaaggtggcccagtcccggcagaaaagttatgcagataaccgacgccgtgatctggaattcgcagtggatgactttgtgtaccttcgggtcacaccattgcaaggtgtacacaggtttcagacaaaagggaagctcgcacctcggtatgtgggtcctttccgtatcattgctcggcgtggagaagtcgcttaccagctggagctgcccgcctccttgggcaacgtgcatgatgtgttccatgtgttgcaactcaagaaatgtcttcgagtgccatccgagcaggccgactcagagcaaattgaagttcgcgaagacttgacttatgtggagaggccagtgaaaatcctgcacaccatggagcgcaggaccaggaaccgagtaatccgtttttgcaaggtccagtggagcaaccacgccgaagaagaagcaacatgggagcgtgaagacgagctgaaggcagcccatcccgatctcttcgccagttcctccgaatctcggggtcgagattccgtttaaggggggtaggtttgtcgcgtcccaaatcgactctaaaattcatcctcgaaattgtgaaaagaataattaaaattcatgtgaaagcctccaacaattaaaatgtgcaaagataaaagtcaaatgaggcttggaggatttttgtatatttcctaaaagcctaaaatgtgtaaatcaattttggtggaattttcagagcacaaacaataat

SEQ ID NO: 92740 - DNA, 2526 bp, Oryza sativa
gatgctaggagaggcaccaccggcgggggaaggggaagaggcagaggaagcgattgtttcttggtcgccggccgcctccccctccctcccaaactcgctggccgccgcgctcgctcgcctccgctccgccgccgcgctcgcactccgctactctgtccgcggcctgctcgcgctccactgctcggcccgccgccgcgctcgcgccttccgctgctccgttgccgcgctcgccctccgctacgctgcccgcatccgtgctcgccgctccgctccgccgccggacggccgcgccgcgtagcctcgcccacggcgacgacgacggcggccacggcgcgcggctgctccacccgcagcctgaaggagaagagaagagagagaaaagaaaagagaagaggagagaaggagaagaaaagaggagaaaaaagatgtgaagctgacatgtgggctccatgtgtttttttaattttttttgctgactaggatgccacgtcagcaaaaccgggcaaaaatactgccgagggacctccggtgaatggtttgagtgagtttaggggtacacatttatggttttgtggttaagggagctcaagaaatctcgctgttaaattgagggacctccagtgaacttattcctcagctctacggatgcttggtttacttgcctacttgggtggcttcaacttctgggctagtccgttctacttctgggcttatttcattggacccaacagtttgtgggttgtgatacaagggaaaagttcattttacaccctcgaactcttatgattgtcgaaaatacacccccgaactacaaaaccggatataatacaccctcgaactgtcaacaccggacacttaaccccccccccccgggctgttttcaccgtggtttttgccacatcggctgccacgtcggatgccacgtcagccctcgccacgtcagcgcacaacataacatgggccaagcccatattctctcccccctctctctccctctctctctccttgccgtgtttgttctcctctctcccacgaccggtggcggcagctgcgtcggcggtgtcgccgcggagctgcgagggcaacgactacggtggctgcgtcgagctgcgagggccgcggctgttgcgtcgagctgctagggccgcggcggctgcgacgtcggcatcggcggtggcggggagaagtccttatcactctcctcttaccgatgtcaagcaaaaagagaagagcaaaatgttagtatgcacaaattcaggtctcagattcagatgatgtaattaacctacattgactgtatcttgtgaagacttcccagattgtacaccaagaccaatgcacgtcgttgcttccaccacgcgtcgagctgcttcttccctgctaagccaaatccaagggcgcgtgcggcgatgacgcccggaccttctgttgatgactacgcgcagaggcttccaccggcgaccgtccgcgcaatcggggcagcgccaccgccctcacagtagctccctcccgccgccgcctcgcagctccacaccaacgcggcagccgcagccctcgcagctccacgccgacgtcgatgccgcagccgccgcggccctcgcagtttgacgccgccgccgtagccgtcgccctcgcagctccgtgccaccgccgctgccaacggtcgtgagagactggagaacaaacagggcagggagagaaagagaaagagggagagagagggggagagaatatgggcttggcccatgttatgttgtgcgctgacgtggcgagggctgacgtggcagccgacgtgtaaaaaaccacggtaaaaacagcccggggtgttaagtgtccggtattgacagttcgagggtgtattatatccggttttgtagttcgggggtgtattttagacaagcataagagttcgagggtgtaaaatggacttttcccttataccaactcggaaaaagtatacatttagtccctcaactatcgccgaagtatgattcatgtcctccaaccacaaaaccaggtatatcgacttctccaactatcaaaaccggtgcaaacaatacccctgggtggttttggatgacgtgccacctacgtggcagtcttgaccgagtctttgtcctacgtggcattagaataaaaacaaaaaataaaaaggaatatgttggacccacatgtcattcaaacaaataaagcattgtgggacccactgacatgtgggacccacatgtcatcctccctcgccatcccttcttcctgctccctccctctctcccccccgcctttctcctcaccttggccggagcagcagttgggagcagcagcagcagcgggcaggagtggcggcggtggcggtggggacggcggtagggagcggcggcagcggtagggagagggaggtcctagccgagggcgcggaggtcggcgagggtgtaaacgctgaggggcatgtaggaggtaaggtcaccggcggcggcagcgggtcgtaggtggccttgtcgagtacccatgacgcggtgaggtggcagc

SEQ ID NO: 92741 - DNA, 5667 bp, Oryza sativa
  unsure (1)..(5667): unsure at all n locations
gatacatcacagatatattccagtcacccccaatataacatcacagatccatctcaaaaatcacagatccccaacaacacagagatgcagttcaaatgccacaattttgcacagcaaattcacaccccttgaaagccacaatttcggtcgttgctcatagaaccgcatatatacttaccaaatggattaaagccataatgtcctcgacctccacaacctgtcaataaggaaaaaaaaaggagaaaacagatgaatagtacaacgtaaaatcgtagttgatcaaatttgatgacaatttagtaaactaccataaatattgcatatatgaaagtaaattatattgcactccataaaaacatatttttttacatcacaagaaattataaaaacatcttttttacatcacaataaattatctagccaagttcatgagtctatttgacatgaaaacatccttttttgttcattatttctgcaagaatgaaggcgcacacttcgcctctgatagcggggggttgatgggtgagatcttgaagccagctctgcctttctgtttaataaataagtggttaattagcacgttttgaatagcaatgttggtattgaaatgagcttattcgctattagcaacaacctcagggtcgaaatctttcacctctcttagaagtgttgacatgttgtggtacacgtggaaaaccacattggtctccgatctgttgtgcacatgcaaacttggtgtcatgataaagttcgtccttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcattattactaagaaccttaacttcaaaaacagtatacacgaagagtattgtcctcttactcttggttgtgtgcgcacatgatgtactccttgtcttgatgggcccataaacaccggttgacatagtgaatcacctcagtgaagctctgtcgtaaattaacctcgttcaccatggatggatcaaggaacccaacctgattaccaaggtgacgactctcgatccaacacaaccttaaaacatttatgtattagaactaatttaattaggagatatagtccaatcatatcacaagtatagaaggtatgcacatacaaggagtagcattttagaagaccagtgtccaacttccggatcctgaaaaggtcgaagaggtcatcaaagcctatagttatataggcaagcgacgataggaatggctggtggtcgtgatgtccaactatggatgactccctcattttccgcttggcattgcttagctccatgtattgcttatgtagctctcggcaagcaatacccatcacggctaacacattgtcctccaccaatggcatgcctagctcaaattgggctggcgccctcacgaccttccccgctttgctcactggcatcgacgtcgcagccttgcccctttttggctccggtgccaactccccgaccttccccttgccacgttcacgcttctggcccttgacaagtggtggggagctatcggcctttcttgtggtctttattggagccaagctttgagctatatctgcaaagtccatatcagctccaccaggagattgaggtactgacaatgccagtctatggggagcctcaattgatagcttagacttgggaggtgtaagctctgtcggtcgacttggacgaggagtcatcttcacaactatgtcttctttgggccattgtatgaacgtcttgcacgcatcgcccaaagtcatgatttcatcattggggggcacgggcagcggatagcctgaccaggtgtcctttactgtatcgatggacaccttggtatacccagctagcaggtctgcgccgtggaccttgtctgtaaccgagggcttgaaatccatgccctcagcgacttcaggagcgaaagttgggtggactctcgctagtaggacacactatgctgcgccttgcatatgtgaaagtttgaatttaatattggaacgtgtaaaggttttttattagatatggatcggataacatcaattacctcgatgtggtccactgcagctagtggtgcgaccgggagaccaggggccggcacctctgtggatgaacaactactcctatgctgtgacggactcgcgtcgtgttgtgcacgaggagttggatgcacagcaggtgttgttcctcggggtatattcatgtcggcgaggaccttgttaaccctttcttccacccttgcattcatgctagcttctagttcttgaatgacctcaaccttaagttcggccttcaaacgagcgtccctctcttcctcggagactttccgtttcctgtattgggagctgtactgcgggagtccatgcttccagggcacatcgctaccaattccccgagtccggccaggatgttctttggttccgagcgcctttgtgaggatgtcatcttcgcgcctcttcggcgcggactcaacctcgctttgtgaagcttgttcagcaaccaagcccaactagaaaaaaaagagtcgtttatacgaacttatactttatacgaacggaaattagataggttaagtagtgcactcaccagttcctgatagacgacggcatcacttttgttctcaaatgtgacagagccgtccgggttgaccttaccccttgcccgcgcgcagttgcgagctctttgttcagggatgtctgaaaacggggcagggacattcgctactgcagcggctgcatcttcttgggcccatattgcctccttgccgatgtaccctgcggtgcccagccgatgcgggtgctcattccgctattgcagtaggcgatgtgcctcgcttgattccctaaagtcttgggtgttcttgagagagcagaattcctcccacaccgctttggttatttgagggtactcatcgaacgacgtatgattgccggacgggttgacaaactcggtgaagagcttcgacttccaattcttccaagctttgcccatcttatggaatgccttccgcttgagcctatcttttgcttcagccggaaatgtgaaccatttctccattgttgtccaagcttgctctttctcggcttctgtgaccttcccggtatctttatggaggatcccgaagttctcacgtgccgctagcccgtagcagttagaccatcttccaatgacagtcctgggcgccatgggcctaccactagcgtcaacctgtcttataacttgcactgtggtcggccatatattttgtgaccggggatttctactagacctacttgcacttgtcccacccgacatcgacgtatgttgttcctgcggcaattctgcagcacaaacagaaggcaacatatgctaaggggtgctagccaaaatttatgtggtcatgtggtgaaaatttatcctataaattaccatgaatttcgggttgttcgaccgctgttgtcgagggatgaccttcggcaactgtctccgtggctgggtttgcttcttcctggatcctcgcaggtgttggggagggcgggtttgcgccgggcgttgtcatggtctaatttttgcgaaaaagcttatgaatttcctaccattatactaaatagcattagatcgaatgtaatacggggtatactataaaacatatggcctcagttttgctcagaaattatgcatcaattaccatcatttgcatgaagggaaaaaaagaggaaatcagctactaggagggaaaggcaaccataggcagcagcatgggaaaacatagacatcaaggcatcaaaaaatgaataaggggcataggggcagcgggggtagcagcagcaacaacaattcatcaaaaaagaacatgtgtacataaaaaaaagaacaagtgtagataatctgttcttatgcattaaaaaaagatcaagtttagataatctatgcacaaaaaaatgaataaggggcacaggggcagcaggggtagcagcagcaacaacaattcatcaaaaaagaacaagtgtacataaaaaaaagaacaagtgtagataatctgttcttatgcattaaaaaaagatcaagtttagaggtatttctgttcttgagcattcatcactggctatttaacataaggcaaccataggcagcagcatgggcaaacatagtcaacaaggcatcaaaaaaaattatcatacacatggcaattcattttataaaaatcatcaaaattcatcaaaatcaggcaatcaggggcaattcttatgcataaaaaaagaacaagtgtagataatctgttcttatgcattaaaaaaagatcaagtttagaggtatttctgttcttgagcattcatcactggccatttaacatagggcaaccataggcagcagcatgggcaaacatagatagcaaggggcaagtgtagataataaaacagcccacaataatttatgtggcagcagcagcaggggtatataaatcatgtatgtaaacaacaattcatgcaattcaactattcatagacaacaagggtatataaattaacaagtgtagataatctgttcttatccataaagaaaagaacatccactgcagcaaaattcatgctaagatcctctattgatgctaagattcactgcaccaaaatcatgtatataaaatctagcccctacattcatccaaaacatccgcagacaactaatcacatttaattcatctatacagcagcaccaacaatcgaaacaacaaatcacatttcattcatctaaacaatgccattcatccatcgaaaaaaggaggaatgggggagggtggcggcgtacttggagaagcggcgtacttggagacggcggcgcaggccgtagtcgtcctgaatcccagtggcggcggcggagaggcancancgaagaggtcgaggcggtcggcggtgctggccggtttcgtcaattcaggcgtcggggaggtcggggaagtagatggcggcggagagggcggcggtgcaaaggtcgaggcggcagtggtggtggagatggtgatggagagggcggcggtggtcagggatcccagcgtcgtggatcccggtgtcggggaggtcagggtcggggaggtcggggaagtcgatggacggacggcgagagtacgagcggcggtgagggtggcggtggagaggttgaggcggcggtggagagggcggcggagagggcggagatggcggtagaaaggtcggcggagatggcggcggagagggcggcggagaggtcgaggcggcgacggtggagatggcggtggagaggacggcggcggtcgagagagtgagtgaggaggcggcagtggagagggaggcggcgagggcggcggagtggacggagatggcgacagagagggcggccgagatggcggaggagagggtggcggcgatggtggatatggcggcggagaggacagcggcggtcgagagagtgagtgaggcggcggcggtcgagagagtgattgagtgagagtgagagcggtgccggatctggatctctctagaagatgtccaaccctaggtcacccctagtcagactcacctgtgacgggcgccaactatgg

SEQ ID NO: 92742 - DNA, 1218 bp, Oryza sativa
cactagcagcctcgatgcgtaacccactgttctgcactgtgcatttgctgtcttgctttaccgtgtgaaaggtatatccatttatgtcatatccttgccaggtggtggcactccatttaggaccctgtgacaacgactgaagtgtttcactagacatgttctgcaacctggcaattcggttcttcagccactcgttgaaagaagacatgtgcttatttctgacccaactctctgatcggcctaggttctcttgtcggataactgcaaggtgttcgtcaacgtacggcaccacctcagtcatctgctgtagtaccttgaaatgagctttatcgtacaccttccgatccaacctaatagtctttcttccaacagtaccaacaccaccaagcctcccttcgtgatgagatcgtggtaatccaattgaagatgtttctgacatgtagtccacacaaaaattgatgacctctttggtggtgtaactctcgatgatactcccctcggggtttgaacggttccgtacataacccttaaggatccccaggtacctttcgcaaggatacatctgcgtcatgaatgctggaccacagcactttgtttgcctcacaagatgcaccggaagatgttccattatgtcaaagaaagttggaggaaagtacatctcaagatgacatagggttctcacaagttctgcctgtagttcatctagtccctcgggatcaatgatcttctggccgattgcatggaagaaggaacacaaccgctggattgtgtgtcgcaccttaggaggcaaaatattccttattgcaacgggcaacagctgtgtgataagaacgtgacaatcatgcgacttcattcctaccaacttaagatcttgcagtgaaacgagcctactgattcttgatgagtaaccagatggaacatttataccactcaaacatgttagcaaatcaatcttctcttctttcgagagagtgtagcaggctggaggaaggtaaaccctgccggatttcgtggttatgggatgtagctccgagcgaacacccatttcttccagatctcgtcgggcgttgagaccatcctttgtagtacctgggttaagcagtaatcccattaaactctcgcatacattcttctcaacatgtatcaaatctatgcagtggcgaacttcaagatccttccagtatggtagtctccaaaatattgacttctttttccaca

SEQ ID NO: 92743 - DNA, 1225 bp, Oryza sativa
tcaacacgaccgaaagcatctttcaatttcaacttattcaaattacatgttgagcaatccaaaacatcaagaggttgttttaactttttagcagaattcatgttaaacatcaaactagcatgaaaagcaatttgatatttttgcaacaactttttagttaaaaaaaactcatccaaagtgcgtgtgtgcaaagcaaaactaaaagcaagagaagatctatttttcaaatcatgtgtagcattaacatctctaatttttgaaatctcattcattaaaacctcacaatttgagcaatcatcatcattaggaataagagattttaatctagcaatttcagatttaagagattcaatgataaattcctgttttctatacatcttctcacacttcttatttttttcactcaaaatattaatggcttcctcaaaagcacttacctcattatcttcatactctgtgtcagattcaccacgcgccatgaagcaaacatcggagatgttctttcccttatcatcatctccactttcaccatctacatcacttagtggctcgaaggcggcgcaaacttgttgaaaaggcttcctgagattgtccagcttcctcccttgggatgaacccttcagcttgttgttgttgttggtcttctcaccatctttgtcttctcttttgcctctcccaagcttaggacaatgcgaacgaagacgatcaattgaaccacattcaaagcaacgatttggaccacctcttttcctgttcctggcattattcatagctcgagcaattctgttagcaaccaaagccaaatcctcctcctcgatttgttcgagttgatcatcggatgtggcattaaaaacagcaagaaaagaagacttagatgaagaagcatcaacatccaaagaagaagaggaagaaaccaaagcactcgacttaaaatcaacttttcgagaaagaacattcatctcatgtgttttcaatttagtgtaaagcgaatccaaactcaaagtagacatgttaacagactcctgaatagatgtagctttcatctcccaaatagacatgtcaagaccattcaaaaagtgatgagaaatctcagattgtggataattagcattataagaagaatcaacagatctaagatcactcaaaattttattaaacctagaaagatagtcatccaaagcttctccaggtttcatctcaaatttaatgtactcctttttgaaaa

SEQ ID NO: 92744 - DNA, 1785 bp, Oryza sativa
tggagcaggggtctacgtaatacgacatcaaaacaaacaaaagacaaggattatactagttcaggccccttatcaggtaatagccctagtccagtttatatgggattgatgatgatgagaacaggttacaaagagagtaactgaaacaggcgataccggcaagatcatagttgagggatttgacgagatctcccggcgagttggctccgtggactccggcttcgtaaactttggtgggtgtgttggcgatgagatgcgatgccttttgcccctccctaggggtcccttttataccgtggaataccttcacccccaagcaagacttggagatatgtaaaccgacacgatatactaaagactttaccatttccgagtaggactttagcaattccttaactcgtagggatattttccataatttgaggcgaattcctaacagcatatcgagaaccaaccgtatacgcgaaggtataccttatcggtatattccataagtcgcaggatagagggtatgccttatccgtaaccctgacaggggcagcggcggcggcgccagctctcagcgtcaacgacgcagggaaaggggcggcggggagtggatccggcacctcctcctgcttccctctggcgacgacggcatagaggagggatggcggcttgcgcatgcggcagcggtgctcgagagaggcaaatccagcatcgacggaccttgggaggtggatccgccgccgccaggcctcgggagcggcgcggggatgcgggcggcgggggcggtggctctcagcgtcaactctcggctcagcggcacgggggagagggcgggagcggatccggcacctcctcccccctccccaccggcagcggcagcaaagaggagggatggcggcattaaggtggctagcgcaggcggcggtgtatatttgtgatgatgatgtattgttaatctgttctgctgatgatgccaatgttgatatttgtgatgctttgtatttggattgatgcttgaatgatgttcatatccattttcaattttttttggtaacttcctggatgagatggtagaaagggattttggggatttattttttttcctggaaaatcatttttagtggcggtaggcataatcttgccgcctgcagaagtctattttcgctggcggtccacttaattttgccaccaatagcggacgtcttagcgtggccaccagcgaaaatcgatttttactagcggtcggctacccatcagcacaaatgatgcattattttcattggcctttgatagctggcggtacagttggccgccagcgaaaacctattttggctgctagcaaaaattgtttttttaagtaatgggtggccctgacgatgaaaatggtggccccatggttagcaagctggttttggctggccaaagccaagatggcctggcatctggtttgtaagtctgttggagcctccccccggattgtcaaattttgacttgaagattgagatagtaattccattgcagatgctctaaataaatgttttgttgtctaagaccaaactcagtccagccactgagccagtgtaccaattgcaagagctcgtgaaagtttggaagaagtcaaaccttttttaactacggttttaggaggaacacagatcaacttttagaggctaggcatgttgacttgtttttagaagatgaacttgttgatttttggaaagcgcaatatttattctgttcctgttgatcacacgatgcaaagtttgttaacattgttttgtaaatcggtgcgatttg

SEQ ID NO: 92745 - DNA, 995 bp, Oryza sativa
tgaatagaattataagtctgcaaattagcctaatcccatcaggacggaatcaaaaaaatatatatttcctttaattttcacactttctcttaaatggttgtacctgtgcagttgcttttagcccaaatgctttgacaacaacagtgatattcggatttccagcccacttgatggaaggttccattataagttcttgctcatctgtggtgtaaaccttcatccctatatggaaagttacggaaatgcgatatcatctcatcatatacaaaaacacatcagtcagacacaataacatcatctaggtgcttaagagaaatatttagaattaggtagaattaggtaatgcagagcagagttatgtactctgaaattattgtgtatttcaggtaatgcggaactatcatagtggaaacatgctggtacagatagtaaaccttgaattcatatgtagcaccatatgttcatgcgcttgacttagcgagtagtaatgagataagttcatatagatactacaacacaatggcatatattcatacagagcttagtacttatcgtaaattttgtttcacaatggtaaatgaactgtcagatggcttgttggtttgcatctgatccgagggaggagagcaggaggtcatgattacccggctagcaccgtttgtttagattgctcacatgggaagcgttgggacatttcgcgttggggtctggcacatgagttcatggtcgacaactctgggataaattgggcctggtcatttggggctagcagaattccagatgaatacagtacactgaagcaacggttggtagaacagtgaaaccatttcaggcttcgtatatggctggttatactatttaccatttccaggtgattaggtcggtataaatcaaaacaagcgtcaattggtcaggaatctctgtgtcatttgcactcctatcatcacacgaccaatgtacaacttaagagtctacctggcagatttacaaaatca

SEQ ID NO: 92746 - DNA, 1113 bp, Oryza sativa
taataaatttatgcattctaccagatagtatgtacaagctgtccacttttattccatatgttctaacagaagttcaatttcaacggtgcaaattagtaaattccaaaaatacaatatggccgtcatttggccgtgcaagcataaaacagatattcaggttgtcctggaaccactccaagaataggttgtcctggaaccactggaggaaggaattactgtgatttttgtacttaggtgttttctgttggtcaagtcaattcctctgacccattgcaaaggacgaacaatattcaatctgaaacaggaagaaaagtagagcaccctgaccagctctttttttagaccaaaagcggaacccctgcttccatacaaagcaaataaaaaacaagagtactagagagaccttttgaggtcgctacaaaagggaaacaaagccgccacctccatttacagagaccttgaaattcaaaataaagtccttgaaattcaggagtactagcaacgaacatctgatttgctttggtacaaaataaagcccttgaaattcacctcatgcataacgaaaattcgtagattgcaaattcgtcttctcataaatcacatccaatcagatgattattcttcacatccacagtagagatgcagggctaattcgaaggatcccattagaacacaatcctactgttatacgatgaaagcaagctaactccagctaccctatacagcaagcccaaaccaaaggaaagaactaaacgatgagttttcaggaatgcatatcactgtatcatctcgtacagagaagcctcgaaaaccatcccgtttctcgcttccagctccactaattcaccccgatgccaaaccacaacgaggcatccaacgaaaagaagggtggcgaatcgtaccttgacgtcggtgggctggaagtagatgaagaggtagtacccaatcacaagccccatggtaactcccaccccaaacccgaagaaacccagcacagtgcggaaaaaccccatctcctccccaccaccgctcccccaacgcgagccgccgagaagagcaagaatccgaaagcgagcgcctcagatcacatgaagaggagacgtgaagcaagca

SEQ ID NO: 92747 - DNA, 1994 bp, Oryza sativa
ttattctagagatatttttagtatattttgttaaattttctcttgtagaggtattctttcaccactttaaaatatgcctgatatgtaaagacattttcttgagatattttaaactctgcagagacacttctaaaaaagaataatactgtatactaagagaataaatataagtaacacacgccataaccttacaagtattgacatgaggttaagttggtcaacgcattgaagataataatgagttgcctaaaagatcttgagttcaaggattgacagtagcaagaattaatagtttatgctcttttttcaacattggtttgatatgattatggtgaaatttaatatctttagaaaatgcatctaccctcttatagacataaaaaatgtctctattaaaataccacgagacatagagggatttatcttatagacatgaaaaaatcgcctctattgaaatgccacaagacggatatttttcgtttgtagatattaattcacaataaggcacgcattacatattttttaaatgatatagtgttgtaaatgtattttaaaattgttttctatggcattagaaaatgcctctacgaagcatttttcttggaggcgacgtgtccgtcgagagcaagacacccataaacacttcatcaatctcaatatataccagtctagtctctcggagatgttcataggggtagagtgtttgtgtgtgtgagttcagaaggatgagtgtgcgcctgtactgtgttaaaaaaaaagtgttccactcataaattgcatgcaagatcgatgcgcatgcatgttccctacaaatgaaatacgagtactatctgttatccaaaacaagtccatggtgcacacttcaattaaaatctaggatacaaggagtagatcaacctttatggccttgtcctttacctagaaagaataagccgttgttaaaactttgatcagaactcctatgggcttttgttatctaactaaaaaagctcgtgcgttgcaacggataaaaacgttttgtcagtgatacaatagctattagaaactgagcaataaattaaaacattaggatggctatacattataattgaaaaagctaataaaaattctttcttggttttgggatgaaagtccattctttccttcctagccccagcctattccgttacttccctccgcatgacctacctctcttcggtccagcccacaagtggagccataggcccaactcacacagccgactgccatctccgacctttagatagtctcttgcatatatgccggagccgttcatccccatcaaatccagccaatttcttcttaatctatcaaaattggttgagggctttttatccattcgatcttctctttccgtttttctcaaaattggaacaaatccacaaaattcaatagggggataaaacacacggggagatgatgtggcgacaatgctaggttttggtccggcggcggcgtgcaatagatcagatgagatcgaagaataccaaaccgaagcgtgatggaaaaaaacagttggaaaaaaagacggacacggacaaaaaatatttcagaagctttacctattttttaataaggtatagatatagatataaagttgcataattagctaggtgaccatccattattaaatcatacctcatgaaatttcacttggcgcagggatattattggctctaaattagtggcatggaatcatctattcccacgcatcgctaatatagttttgtcacatgagcaagatgagtttaaatggaatctaacaccagctggaagattcttggttaaatctcattatcttgctttggctcatacgggagctcccaatattaacaaaactatttggaagttaaaaatgcctcttaaagtaaagatctttttgtggtatctacgtcgaggagtggtgttaacaaaagttaacctggctaagcggaaatggaaagagagtaagatctgttgttttgccacaaagaaga

SEQ ID NO: 92748 - DNA, 940 bp, Oryza sativa
agccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccggggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaacggtcccaggatatcgagtccccagacagcaaatggccacgaaagtggtatggtctgcagggcctgggccggctaatggatttgcttggcgtggaattgacacgctctacatcgccggaccaggttgaccgcatcattaagagctgtcggctaatagaaaccctggcgaaaagctttaccaaccaagg

SEQ ID NO: 92749 - DNA, 1523 bp, Oryza sativa
gacagaaatatgaacattagatccaccagttatctgtcaaaaaaaagtatgatttgatacttacagtcccagtcaacatattgacaactatgttgggcagcagttttatcaggtaggtacaggtaaaaaataaaaaatggaggcctgatgtccctattttacatcttcctaaaaaaatcaggtaagctcaaattgcagcacaactgcatgactgcctaaaaatatgtttttttttaaaaaaaaagaaagtttaaaggatgccaccatgtgcaactgcacttcatgttcttttccagaactggtattctggaacaactttctctcaagtttcaactggctttaaggttggaacaatccctgttttcctccatattagagcaatcatcatccagaaaagagttatcaacagataatttcgtcatatgcatagactttgtaaaagctccccctccagtttttcatcatcaagttatgtcatgtttgagcattgtgtaaggcgccaattttcggaaaggttcttagcatgtatgttgaaagaattatctttatcaggcaatattcaagtctttatatctactggaaagtcttccattaggtagcgattatcagctttgggaagtgacaatggcaaggtctcttcgtccacagaatctcggtatttcaatggaacgacttcaatcgaaaacctattttggctggccgactttgaacgacttgtgggtaaagatggtccagtacctatttggaaaaatctcattagacatgatgacatagtagtatctatgaaaatgtgtaaaatgacagattgtggcatactgtcagtcatgtcctttgtcttgtggaggagaaatgtcccagaaaggatggtcacaaaaccacacagctccgtgacaatttgtgttggattttgtcgatcccaatcctgcacgtaataaactatgctatcacaaattgaggaaataaactttccataaggcatcaattgtttcttgaagacagcaacattgtgaaagaaaattaaggtgcgtagtgcacggtaacaacattgtgcaaaattataatcacagcagcatagttagcggagcaggacacatgtagaactacacattaagccaaaaaaaaaaattgttcatagctttctgcaacaagaaagttgagtgtataagggctgaatgcctaatggaagtgatagaaaaagcttaccttaaacattatcacactggctaaaattgttagtgaagtaaacatcacgtaatatattggtgagacaactgctgtattaaaggtgtccaatgcctgcaagtcacagagataaaagaattactattgcgttaatgtaataagcccttatgtgatatgttacaataatggtagctcaataagctacatgttctgtactattgcccagagtgacatttcaatgccccagtgacgagccaggaaagttttacagcctgaagccctggaaaaatctaactacgctgagtatatgctgcaattctattttcaatccctacaatgat

SEQ ID NO: 92750 - DNA, 2021 bp, Oryza sativa
acttacagtaaggctgctgagggctatgttatgaacatattttaatacagtaaatacctggttcagttgcaagatcccaaacttcccttacagaatcgatgttgcgctcctgtggagcatggagtacaattgtgatagatccaactacacaaagaacacaaccaagtatgccaaaggtgtgtagtttctcctgcagaatggcgtgtgcaagtgcagcactgcacaaattgacaaaagattatggttttgatttagcaactagatagcaaaaacaaattttagcaagtttcttatttgattcatctgaaattacctgatgattatactgagtgccccaagaggagtaacaagaatagcaggagcaaatgcataagcagcaaaatttgcaatttctcccacaatcactgttcacaaaggtcatgtaagatgccattagtcaagtttctttccttagtgacattttttgtctaaaaacaaatgaaacagtaacttcagtatattagaaaatacacatttctgttcacttccaaccaataaattccaccaaatatcttactgaaagaataacaaggaaaaacaacagccctaggagcagacagtagtaagagatattcatgctaaggagccatattcaggtgacaggaaacactttgctccgtacaatcacttttcatgccccagttaagctcaaaggttctactaatatctagtcacatacttgtatcaatgtaattatctagaatatcgttttggcttcattgaattcagccccaattaaaaatgtttagtttctcctaatacaaagtaactgtatttatcctgattctcaagacacagaaacatcttattacaggtcttagggagttgacaacttgacatcaacacgagtttacatgaccaactaaccaggtaacagacaataaagatctcatcataatcaaagtgacatcaataaggaaaaaataattgcaggataatgtttgagcagagcaagctatatgttaagatcaaaggggaaaaaactgataaatccaatgatagaaaaaaaatattgtgcacataatgtgacagaaaagaaaggaacattttcaagaagtacaaaatattgtataatttaaaaaggaatcaaatgtggcttactagaaatcatgcctatccaccatagaggctccattaagtaagaaaatcctccatatcctgtttaatgcaaataaagaaaacatgtgacctcctgcattgaaacttgtagagcttgcaacacaatagcttatgaaatatcacacgaataatgaaagtgcattgatctgacatcaatcatttcaggtaagtgcataaggacatagatcaggttgagatgtaagtgcatgttttgttcatacgttaccactaggctgtcctaaagtaagctattatagagtaaagtatcatagtagttggttggtttgataaaatattgcacatgtgacatcgctatcatggaagtgaaccactagccagccaaaaagatgtaatttcgtcctggcatactgaagaaccatatcggttagccactaatcgcagaagcaccacaaccacctagcaatagaaacaacaacccgaaatttgacttgactttactctttccgcaaaccgaatcaaacaaaatccacagtaatcatccatgactcgatcagatacagcttacgatccagaaattcaaaataagcaaagcattggtaccacaagcattgaacatcatcttgtataaatatttaataatggaggacaattgcaaaaggccaaggataccaccacaaaagacaacttttttccggactcactcatcttagttccaataaaaaaaaatctcacaagtaacaaatgccgtatcaaatgaagcaagaaaaaaaaattcttcagagagtcaactgatcctccttgcaagtaaagtaaagatccttagactcgattagaactacttttgcaggtagaactttccagcttccacgcccaaatcattgcaatccttttcacccgcgaga

SEQ ID NO: 92751 - DNA, 1632 bp, Oryza sativa
gggggactaagaggagggcgaatgcatcaccctcgggcccgacgtccctcgggggtaccaggccacgtatgcgattgtgtctgcctcaaacctctagtcatgatactcctgatcccatgtcaccgacaacatgcatatagaagttaatatgaatgtggatgcatattaatatgttaagtcattcataacgtgtgtttcatatgaatgtagccaatactagaatgatttacattatgaaatagagggagctaataattaattaataatgtactaaaggattgctctattttccgtgtgtaccgttccggtttcaataccagcgcctcgccgcctacagagcgtctgggggaagccccccgtttcacccctttctcctcctcctcccccaaccccaaatcatatcatatatcccagccggagttgtattgacaatcgacactttttttttccaattttccttaaaaacacacacatgcatgcactgtaacaattattaaaattcttaataaaagtgcactggcatatgtgtttttttaggaaaacattggcatatatgttgactacggaagaagttcagatttgaaccctaacgcttgaagtcatgcaccatctaatatgatatcacatcagagatgttcaccgcatcatattaactttctgtggacgtatctcataatcactggtgctagcctccaaacaaagaacagaacgcacagcggagtgcaaaggggcccaccgaagatgaccaagtagacaagattggacttcaccaggtcgacggtgatggggaccccaatcttcgcgagcaccgtgatccccatcctcctctgcagcacgtacgcgcagatcagcatccgcaccacctccctgttcctgaacagcagcgtgccggtggtgaagacgcagacgcccaccgccgtggcgcgggacaccggggccagcaccaggtacaccccgagcgcgaaggccaccagcaagctcctcgtcgactgccgcatccacgccagcgaccgctcgaagtacgcgcggcggagcttccagtccaccgccgccgtgctggagtacatcaggctaaacgtggcgagcatggagtaggcgaaggctatcgccaccgcgtacatgaacgcgtcgaaggggtactgccccgccagcgccggcgcgccgccgccgtcgccgccgtagccgcccggaggggagaaggccaccgcgaacgtgacggcggcgacgaggacggcgccgacgcccagcatctgcgtcgactccgtcatcttctttgactcggcgctctcgtctttcttggggacgtactcctcctcgaagtgatcgttgcgccggaagttgctgccgagtgcgttgctttctaccagagaccagaggatccaagttcgtgcgctctgcatgaacaaaattactacaatcagtacagatattgtatatatgttggagaaaaaataatctcaacatgaattaattgaaccacatcacctagaaaacattagcagctggatctttcttgagttaaatctgaatcgtcattcatgtctttagttacgttactttcatgcgacggcggcccgcggcgcacgggaggcgcgcgggcagcagcggcagtggccgggcgtgcgacagtgg

SEQ ID NO: 92752 - DNA, 2397 bp, Oryza sativa
  unsure (1)..(2397): unsure at all n locations
gcatgcgtgacgacgatgagatgcctaaggcctggtggtgctcgccggcgatgccagctgctcgacggcgacaccgccgccttttgcgcctcgctggtggacggcctcgcgcagctggagagcacgctgcttcgtgaggaggacgacggcgatggcggcggcggcggcggtggggcggtgtcgatgaggtggtgcgccgacgccatgaggctggtgaagcggatgcagcgggagcttctggtcatgttcaagaaggccgacgtgccggtgggcagcgccgtctcctacggcggcggcggcggaggcggcgacggcggcgggtgctggttcgagcactacatgcaggagacggcggcgctgctcgacttctgcaacgcgttcaagtccgccgtgtcgcggctgcaccgctactgcatggtcgtcgacttcgccgcgcaggtcggctgcgccggcgccggcgccgccgcggagaacggcggcggcgccggcggctggtggctggaggaggagccgggcggcgacgacgcgggcgccatccgccacaggctgtccgacgtgagggcggcggtgagcgaggcggagcggctagggaggaagatcatgtctagctccagcggcggcggcggcgccggggacgacgacgccggcggcatggtggtcgtcatgctcgtcgccaagatcaccatggccgtcgtgtcgatgttcgtgctccaggccctcacctcacccatcgtccccctcgccgccgacgtcgacgacggccactgcacccttggccgcgccgccgccgtcccggtccccgagctccagccatggcgagaatccctctccgtgatcaccgaccggttcccgaggcggccgggcgtcgccgagcacgagagggtggccatggtggtgaagtccatgatgatcaacaccaagatggaaggagaagaagagaccaaaaatggcaaacaagaacaagaagatgaccatgttgagcttctaagaacaagatcaggtgagctcagggaaggtgtggagatgtttgattgtgttttggatgaagtgtttgatgaggtgatcaagggcaggaatgagatgcttggcatcttcagagataaggccctcacactgggctgaatttttagatgttagctaatctctgaaaagttaattgaccttgagcaatctggaaaccagcagggtatgtatgtaacctggggtggatgctaatttgactgatcaatttgagttgttttgttgagggtttagagcttcttgcaatgtgtgagtatgtgtttatgaaggtgtttaattatatttggtttccttttatactttaatttctcctttggtttgtaacttgtttcagtgtgacatactgatcaataaagcatctgaagtttagatttgttttatatctgctaaaagagatgaaacaccagatgcaatttcacatctacattgcagttgatgcaggagtaaactatgttcagttaagaggtgaattgaagttcagagcacaaaacacaatcagatggtcacttcttcattgttgaaggaatgctcaattgcagcaagctgtantacatggaacaaaaaacaaacagatgatcacttattcattctcagttctgatctaaccaaagccccagggaaaccctgaaaattccacaaattcaaacaaaaaaaaattgcttagtttgctatcacagagaaattacagaaggttttgtttcctgttgtagtattacatttcaacaagaccattgaggattacatcggaatcatgtcttcacttggtagttcttttaacaaccatatgataatacacagtgctaaactagttctgggagttcatgccccacttgtcccagatcaccccaaaagaatgaacaaaactttaccgagagcagaagaatttacgaaaatcaaacggccatagttccctaatccgcctttgtcaagtgcaaaatagaaaggcggcaggaactggtctgcaggatcatagagtaaaggagtagaatcgcttgcgacctttaggcttaaattcctcagcaggggcataaatcttgacactgaatagtcctgtgccatcctgtgctatatcaaaggtaaaatcctaaaatatccttgcaccacccattccgaaagaatctctgtcatcttgttagttgtggactgctgcgtctctcttctgatcgatgatggaataactttgctattgaccgcctctcacaatcctgaacgagaatagcatgtaaattagatttagtatggttgcggtcaaactagctagctagatggtcaactgtacccaccttaaacatattaaggcgaaatggcttctccgggttcattcttctaagcttcaaatatgtatatgcaaagctgagctggtcacgaggtgtgaat

SEQ ID NO: 92753 - DNA, 2493 bp, Oryza sativa
gttggaaagaacgaatcagaaaaaaacataaacagtactactgaatcatatgcctccacgtgagctcaacctatctgagaccagcaaagcatcaacacagatacagctgaattgaaggaatcaggattgattgctactagtagcgaggcagtcaggaatgtgcatactgatagggacagggcagaatgtgaaaacagatttccacctggtggcaccggtttatgactggaaactactggtattttctggcagttagtgttggccaatatttttgataaaaaaaatagtaaccagctggtaaactgcttggatttcccaaggtgatttatcttgggggaggggagttactagctcagttcagctgaggattaagaatgatattggcccataaacatgacagtgtggattcaatgtggaaaaaaaaaagtacaaccaccatatataagaacattcatttttaccttgatgatgggaaaagacgatgtgccagaaatttcggtattttgccgactctccgcatgtcattataaggcatattcttaatcaatatgatcttccatataccgatgaaacctgaactatccattttttggccttcagattccaaagttcgtaatgtgatttcatccaaaaacatagcaaagcatactgtcttctttgatagacttgtaatctgcgtagacagatatcatatgaagttatttcttaaatattaccagatttccatcaacttctgaagcatttaaaaagattcagggagcattggaacaacagaatggaaaggtcagcaattgtttaacctaagtatggagattgaggttatatattcatgtatatccaaactaacattgcagaaggttcagttgcatttcacaggcctattatataaggtttatgtttcattgcctactaacagagccaataagtacctatggtaaaaatgaagctactgagattataaggttctaagacaaatcatgcaaagaacgctaattttgcgattgccaaaatatacaagagaaccaaaataaatacattgacaagagttacattggttgtaactcatgcaggattaggggtatcataattttttcaggagtttgttggtacagaaaaagaacatactgttttcccaaaaggagtcttcagacgatcagaatttccaaagatgcaggaagatactgcaatgtggcatttgctcatgtactttctgttttcctctgagatatcaaaaccagtgcttgtaccattgggacccttaacaaaagcacaatttaattgttggtcatgagctaagtatgattcctctctttcttgtaaactctggtggccagcaaatcttggctcccaatactctgatccaagaggtttgtcttcaacttccacatattccaaattaaaactagcaaatttctcatttttagcaggctctacgagttgagcagtggagttcagaaacctcatttcacaagttgaacctgatttatgtttatccaacagattagaaaaccatccataataacaaaggctagataccaagagtattttatgtgataccaaattatcaaacgtagaaatcaatagatcatattgataaacattgtaaatcaagcactacataaatacacatgatgctgctgtgctactaacatctcaatcttcattttaaaggatactaatgtgtggaactaacagattagttggcactctaaaatgtccaagactaactgatttatgtctatcgaacatgaatagcacatagttagtaccttcttacaaccagattccataattggtgtttctgatatcatagaagcaagctagaattacctctaaacactacagaaggctattgaaacagaaataaaatgcagaaagcttagttattctcagtagggatcaatatgtccactaagctaaacaagaaatcaggtttctgaattcaaatcgcctgactctagcacttaaatttggggaagaacaaactcaccagtcttcttgcgctttgatttcttttttgacgcgtgtttcttatcaccagtcgccgaaaccttcttttggttcacattagcagcatcaataacatcgacaccatcactaatacccgcacctgtttccgtgcgtctctctaaggcgatgctttccttattgccggtgctatcatgagctatattttccttactctcggtgctctcatgactactgtcgcaagcttcctcccgccatcagatgaatgcgactgagcatcatcaagatcgtcctgtgcatcaatgccatcgtcatactcatcatccggatcaacctccctgatcccagtacccgcagctcccatcgcagccgcctcatactgctcgagctctttcctgcccccttcattgtacaaggtccctcctttcccaccttcagctacctcagcagcctccttatcggcggcaccgccggtatccatggtcaaccctttctcctcaacagcaggatcagaggtcacaacct

SEQ ID NO: 92754 - DNA, 988 bp, Oryza sativa
ttaacttttactcctacataagaaaaaatgtatatgttagcaatgacatatatataagaaccaatttactatgcttgaaattacaatggtgttgtttcacttttcctggctgcagcagcagtgactgtcggctgtaaccattgaaaatggctgctaacggcaacaactctaagctactaaaacaaccatcactattgatcactaccaatatccatacctctcgccataacataatccgacttcattaaatttttcttatttcacctatataagataaacacaaatatatatatattcctacaccccatgtctaaagtctgatcttagatcattgcatcaatcttgatctcaccaacctccatgagagagaagagatcaaagccctcaatagtctttggtatcctaaccccattcatcatcacgtgcaattaaccaacccatccgcgccaaattacagaaaagcccctccatttctcaccttctcgcccaccctcccgtccatgtccatggtggtcgagcaccaccggcgcggccaccgcgagctcctcctccccctctaatggcgcagtacaggcagtcgggcggcttcttcgactaccgcggcggccaccaccacgcgctcccggacttagggcggccatgcaaccggtgacgcattgcacatccctaagtttgctggggggcgcatccgctctatagcccgtatcttctcagggttggcctcaatgcctcgggcagagaccaagaaccctagaagcttgcccgcaggtacaccgaacacacacttatcggggttagttttatgcgggcggagcggagactctcaaaagtttccgctagatctgagagtacatttcctggttgcgcgtctttacaaccaagtcatcgacataagcctcaacattacgtcctaattggttacccaaagaaattcgagtagtacgttaaaagtaggacctgcattctttaacccgaagggggctgcagg

SEQ ID NO: 92755 - DNA, 1689 bp, Oryza sativa
tgaatcaaaatttaaccaatgcttgttctaaatgtgtctaattggataaaccctattcgcaggtgtggacactgcaagaagctcgctccagaggtatgcttctgtacagttggatcacttccttaacagcacattttcacattttggattaaatggtttgatcccatgtattaattttctttgcttgatctgtttcagtatgagaaagctgcacaagagctaagcaagcacgatccaccgattgttcttgccaaggttgatgccaacgacgagaagaacaagcctcttgctaccaagtatgagatccagggtttcccgacactcaagatattcaggaaccagggcaagaacattcaggaatacaagggcccgagggaggctgagggcattgttgaatacttgaagaagcaggttggtcctgcttccaaggagatcaagtcaccagaagacgcaaccaaccttattgatgacaagaaaatctacattgtaagacctcgattcaatatgacacattctccaacttatattttctgttccgactgttcatgctttaaaattgactgctgacttgaatgagcaattgaaataggttggaatcttctcagaattaagtggcactgagtatacaaacttcatagaggttgctgagaagctgagatctgattatgactttggccacaccttgcatgccaaccaccttccacgcggtgatgctgcagttgagagaccattggttaggctattcaagccctttgatgagcttgttgttgacagcaaggtatataactcctcaaatatcaaacttcattgttttaactattcatttggccactatgtttcctacaacttgtcacagcctttattggctggcattattttggttaattgtcaataatgtgttgtttgcatatctcttcaggattttgatgttactgctttggagaagttcattgatgctagcagcacccctaaagttgttacttttgacaagaaccctgacaaccatccttaccttctgaaatttttccaaagctcagctgccaaggtaagcgcttggcattccttgctctctgaaaagctccattcttttaataacagctggcagtagttgattgatactgtatattaatagtcaatttaaatgtttatttctcgtgtttcaaatagactttgcttagactgtaatatctgatacccttctccattcatatatttgcaagttctcactattaaacgcagtgattcaaatattgttctttaatactccgtatatcattatgccagtaatttgcagttgttgatgactgacactaaacgttaccaaattatatgcaggctatgctatttttgaacttctccactggaccgtttgagtctttcaagtcagtttattatggtgctgctgaggagttcaaggacaaggaaattaagttcctcattggtgacattgaggccagtcaaggtgccttccaggtttgttacctcactttcttataatttttttcaaacaattattaatgtacttgatgctaactttaaatctgtcactgtacagtactttgggctgagggaggatcaggtaccactcatcatcatccaggatggtgagtccaagaaatttttgaaggcacacgttgagcctgaccaaattgtttcttggttgaaggaatactttgtaagtagtctttt

SEQ ID NO: 92756 - DNA, 4249 bp, Oryza sativa
cctgataacaaatcagacaaccaaatcgacaacgaaacgtggacaatggcgttcgatggtgcactcaacagccaaggagcaggggcaggattcatcttgacatctccttccggagaccaattcaagcacgcaatccacctcaacttcagagcgaccaataacacagccgaatatgaaggactactcgccgggataagagctgcagccgcacttggggtcaagcgactgatcgtgaaaggggactccgagctagtcgcgaaccaggtgcacaaagattataaatgctctaaccccgagttatccaagtatctcgcagaagtcaggaagctggagaaaaggttcgatgggatcgaggtccgacacgtatactgcaaggacaacatcgagccagatgacctagcatgatgtgcgtccagacgagaaccactcgagcctggcacttttctggacatcctgacaaagccatcagtgaaagaggttagcggcgaagtcagcccagccgcccccaacattagctcggaggccacagaggcagaacacgccgtcgccgatatcgagaccacagacgactggcgcaccccactgatcaaattcatcaacagcgaagagttgcccgaggacgacgcagaggccgagaaaataacccgtaaagcaaaaatctgctgcatgattggcaacgatctatacaagaaagcgccaaacggggtacttctcaaatgcgtctcgtccgacgacggcagacacctcctccttgatatacatgaaggcatctgtgggtcacacgccgctggtcggacattggtcgggaaagcatttcggcaagggtttttctggccaaccgccatcaaagatgcatgcgacatggtccagcggtgtgaagcctgtcaattccacagtaaacacacaaagctacccgcgcaagcgctctagactatccctcttacttggccgttctcgtgctgggggctagatatactcgggccattcccacgaggacagggcggctacaggttcctattcgtggcgatcgacaaattcactaaatggatcgaagcagtacccacgggggaaatcaaggccgacaacgccatcaaattcatcaaggggatattttgcagatacggactaccgcaccgcatcataactgacaacggctcccagttcatcagcgccgatttccatgattactgcatcggactgggagtctagatatgcttcgcctcggtctctcaccctcaaagcaacggacaagtcgagagggcaaacgacatagtactacaagggatcaagacccgcgtctacgacagattcatgtcacatgacaaaaaatgggtcgaagaactcccatcagtactatgggccgtacgcaccacaccgacaacgtctaacaaggaacacccttcttcctcatgtacggctccgaggccatgctccccagcgagctacgacatcagagtacacgagtacagaagtattccgacgaggatcaggaggaatagcgaaacgtcgatgtgaatctactcgaggaacatcgcgaacgagttgccgtccgagtagccagttaccaacaggctctccgccgctaccacgaggagcgcatccgagcacgcatactttcaatcggcgactatgtcctccgacgggttcaatgccaagtagggcgaaacaagctctcacccaaatgggaaggaccttacacgatcacacaagttttgcggccaggcgcattaaaaattgcagacggtgatggtcgcgagttggcaaactcttggaatattgaccaactacgtaaattctatgtatgagtcaatgtcatccacacctgtaagacaccttacagtatcaatggagcctatttttaggcgcatattacaatcaaagtgttcctacccgatgatcccttacccagatgtgttgacagaaaacacgaggcctgggagatctgcttaactccagtgtaggtccaaagctcgccttctggtgtactagcgtgccagttgatttgatcccgtaatcaacaagaaataaaggcaaagaaaccgtggttaaatctataaatgatagccgatcggctaggtgccgatgacataacatttatctttgagccgatgtcatatgtgaatcgatcggcagttgtaaatagacaataaagaactaaatctattcgatcggctgtagatatttccaatatatagttcttatatcgatatatacttaaatcgagtgattgggatagatcggtcgccatgccgagacagtataaatcacttagatcgaaatatatattaataacagggctatatatgtttatagcatagccgatcagatagatctagcatgtatcggctaatactccaatactactctatatcaggatattaaaacagacataatatattaaacaaaggactaatatacttagatacagcaatatcttgacataaaggacagatttaatatgtcaatgaagcatatagagcaaatatagttagatcagataagatcggctgaaactccgatgctaccctaattggcaaccagaaggcatgttagagattgatattctaagcacgacttaatagatcaaactcgactgatgcaacattaagtatgaaaagaagaacaatatctagacaatcaagtcgctggaagtttcatagagtggtggataccttatataatctaagtcaacatcgatatctaacctaatcggctaccctctacagacagatgttagccgattgtagattagatagcggtattgccggagattatgtaagatatatgataactcgatgaattacataaacgagatcagagtgtcataaagatggaagcactaatcccgagaatacaagccgtcataacaagttttacctctcgttgaagatcgaaaccgatgcagctcaacctgaaagcaagaactcatcgaaacaaaactaaagcaaaagggtggcgatgcgccgaaattgtattgaacgtgtgtgtgtgttaaaagttacatagggctcgggtctatttatacccgagaatcacaagatatgtccataacagacacgactactatcttatcaaactctaggataccacaagtctttgcggcagacttttgcccaatcgtatctctaaggagattacataaaacaccctaattaatagatacaattgacttctcaggactctatccatgtgcggcaatcaccttgaagcacctcaatccaacccgatatcatacatcaagctgcattgtcggaatcggctgtatcggcttacctagtccgactcagacctagccgatgccaatcgcatccgatttggactccagccgattcctgctttgtttccgaactcaatctctgcctccgactttgcttcgatctaatcttctttcctgatgccgatgttaccaaatttggttgttaacaagatgacacctagcgttgaaacctatccccatgtccctttacgtcatcttgagaaggcctccgatgaacctaagggatcttctactggggacgcccagagccgataaggccttgtcagatcctgtagagacgaaagaccatgtaagacctggtcgtgtaagagttctcgccgtgcgtattaaccaagccgcgtaatcggaaattcactttccaacttcacggctgggggctaggatcagtgcttattcaaccaaggcaggtcaaaggtccaagaggcttatcctccgagaaaaatcctccgatgacaaggctgggggctagagagagtgtacgactcaaacgactaactaaagtcgtgaactgagaacacacccttacacacgatatccagagtaagaaggatttgttaagatagatttcttttctatttcacaaaataccccttacaattttacacaagttcaaagctatattacacttttccctaagatatccatcacagggtacaaagactaccaagaaggccaactccagtccatagactagaagaccttctccgccaacggcgccatcgactttgccaggtggtctatctccgccgtagttctccgagaacgagcaaaaccttcatggagaaactcgaggtcctgtcgcggacgatgatctcgtaggcaagccaacacgtgccctccggcatatcggctcgatcgacgacattcctgcttcaaggcttcgtcaatgcgtttgccgacgccttcgagctgagtacaggccccattcagccacgagatgtatccggccgccgactcctcaggatctccacg

SEQ ID NO: 92757 - DNA, 1859 bp, Oryza sativa
tttggctatgcatacggagctagacgtggtgttggcgatatcctgcagatctggtgaaggtacaaagactaccaagaagcccaactccagtccatagactagaagaccttctccgccaacggcgccatcgactttgccaggtggtctatctccgccgtagttctccgagaacgagcaaaaccttcatggagaaactcgaggtcctgtcgcggacgatgatctcgtaggcaagccaacacgtgccctccggcatatcggctcgatcgacgacattcctgcttcaaggcttcgtcaatgcgtttgccgacgccttcgagctgagtacaggccccattcagccacgagatgtatccggccgccgactcctcaggatctccacggggtactcggagctctctacaaaccttggccatggacgtgcagcaactcttcaagtacaagttgaaccatacctcacaacctcagagcgtttccacagcttgctctttctttacttccagcatagttctctcgagctccgctacttcaaatttcatcttccaatattggatacgacgatcttggccagcaagcgcactctcgagatctgttcaatatggaaacgactaagtcaagctgcactcctctttcgagaacacggttgatcaagtcggaggagcaaaaagggatgaagagaccactaacctaaggaagtcatcgccatccccattctcgcgggtaaaatctgatctacatcgtccggcgacgcgtgtggctcaaacgcaagagccggaatgatcgctggcgactcaggctgcccaccctgctggacatcctcgacttcaacatctctacagggaacaaaaaagtactcaagatcaaaatgctaaagcaactaaggtgatgactgcacgcacaaaggcggttggagccaattggagttttatacagcatgtcgaaggagtacaagagagtcaaaatcctactcttcaaaaagggggagaacagactcccccagatcaccgacttcttccatcacatccttatgcgcgtcgctagccgccccctattccaagatctcccgcagatcgagttcagggtgcgccagcctcacacacgcaaggacgtggcatgccccggtgtagttcccgttggacgtctcctctccgatcctggccgcatgcttggagggaatctcctccatcgccgccgccagctccgcaagagaagacgtcagcgagaactcattgggattcgcggggatggtagacttgataccgcattccccggcgagctggtgcagaccagtataggtgacccgcaacgagccacggatttccgataagttgttctcgagctccgacatacggtgctcgagcccctgccgttgtcgctcattcccggccaccagtttcctcatcttcttgaggtcctcacgagcctccgccaagtcgtgtgccagccggtcggcgcgctcgttcgccgacgacgacgccgccgccgctctcacctccatgatctcgcggccaatgccgcgagcaccagcctcgaggaggcgccacatctcaacctggagctcctcccaggtgaggacggcagccggcgaaccatgaccagccacgagatcgctggctgggccgcttggtgtcgcctcgtggctcccgggcacgaccacgacatccgtcgaggctacagcaggagacgcgctggaagtccctccagacccgtcctgcgccgccttcgcccgcgccgccctacaagaaggctgtggttcagacaaagttcgacgaaatcacgaaacctcaaattcattcactcacttctcgccgagtgtcacaagccgctgccgtcgtggaggcaggggagacgcgtccaaggct

SEQ ID NO: 92758 - DNA, 1394 bp, Oryza sativa
ccgcaacgcggcaaagccacggtctccacaacgcggccacggcgttctcccgcatgccgcacgccctcaagttgtcagagagctattaggccatttacaatgcaaagacgtggagttcagcttccacatgctagctcggagattcctctccacctaggcacttttcactccctcactaggaacggggagccaaagtaagcattagaataactaacagccacgattcatcaccgttattagatcagcataaaccaaacaaaacaagcagatgtgatgcgaccgaggcagctttattcaacttgtccagaaccacttctctaccgactatcacttttgcatgggtaaaattaactaggtaccacgggttgattgtacagtatttctcaatgggacagacatgccgaaacatcaactatttcccccactctcactactctccatctcaccgtctttcagaaccttggcaaaatctggcgttggagctgtcaaacatgttagccgtcaggtcccgtctcctccatgtctacagccacaagcatccatgccctctcctactcactgcacatcaataacagtttaagaatagtaatattgtggtgaaaaggatgctcactgctcaggcgatcagtgtacaaaccttgtttagagctcatccttgagaggctcggctggggccgactctgccttctccttcgcctgaccagcggtttccttgttcttcttaatgaagtcgacgatctcgtcggctgtcctgccgctttcatagggaaccatctttccactgggggtgacgaagtacagggtggggtaaccttgcacatcgaactcgcttggcacatcgttcgcagttgcatcctgcatacaaggtagcaaaatagtagttagatgaactgtacttgtgataggaaagaatggatgaataatgcactcaaaactaatggcaccacccagatagaaaggaaattaccatcttagcgatgacaacatccttgtcgcttttaagcgtcgtagctgcctcatccaagattggagccagcttcttgcagtgtccgcaccatggtgcatagaattcaacaaggactgaaacagaaaacagcaaataaatgagagctgcaaatcaaatagaggctttgccagcactgataattgaagaagctacaaaaaaatagcaaacttgcttttgaccagggaggaatcagtcgctcacaatactaatataagaactaaaaatcatctcactgaaaagattacgggggacaacagtatgtaccgtttttgccagacttgaagacaaaatcatggacgttatcagcgaccacaaccttaacaggctcgtcgttgacctcaggaataggttcagacttcctgaatggagacaatttaccatcctaaaa

SEQ ID NO: 92759 - DNA, 558 bp, Oryza sativa
ctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtgcgccgccagcgttgcttcccggatggtgacggcgccctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgccggcggtgagccttacggcccacctccaccatggcctccaccgagcg

SEQ ID NO: 92760 - DNA, 1504 bp, Oryza sativa
tgctcggaggagtggctgttggtgctggggcgcgtggggttgcggctgtggtggtgtcgcaagctcgtccaactcgaaccgcggcccgagggtgtgttggtgtcggagtcgatggaggctcggggactggggtagacacgcttggtgaagaagagctgcctactcccccagctctctcgaagtggacatactcgacggtgaagtcgtcgtacgtcagagtcgaaccatcgtccaccgtcttgtcccatacccaccctcgcccttagtcgaacactacgtcgtgcgctgtgcgcacacgctgtgtctccgggtcgaggatgcgataggccttcgagccctccgcgtagccgatgacacccctggggtgctcctgtcatcgagcttgctgatggggccaagctccttgacgaacgcgaggcagccgaagacccgcaggtgggagacccctggcttgcgcccatgccaagcctcgtacggtgtcctgccatcgagggccttggtaggcgagcggttgaggatgtagacggccgtcaccaccgcctctccccagaagatggccggcatccccctctgcttgaggagagcccgagccatccccacaaccgtttggttgcgccgctcgacgacgccgatctgctgcgggctgtacggcacggtgtactggcgctgaatgccttcatcagcgcagtacgacgcgaattcagccgccgtgaattcgccgccgttgtcggtgcgcagtacgcgtagcttgcggccgcactccgcctctgcagcagcctgcgcgcgccggatggtgtccgcagcctctcccttgctgccgaggaccatcacccacatgtagcgggagaggtcgtcgacgagcagcaggaagtaacgtcgtcctcctggtgtggccggtgtcactgggccacacaagtccccgtgcatgagctcgagccgctccttggctcggaaactcgtctgctggggaaaggggagccgcctctgcttcgttaggacgcagacgtcgcagagctgctccacgtggtcaaggcacggcaggcctcgcaccatctccttggcgctgagccgcttcagggcctcaaagtgaaggtgcccgaaacgctcgtgccactgccacgcctcgccgtctcgacgagcggcgaggcaaactggttgtgcgacctgcgcgctgaggatgtagagtcgattagtgcctctggttaccttggcaagaaggcgacggcggcgatcccaaatcctcatgactccgtgctcgaccaacacgcttgagccgttctcatccagctgtcccacgctgatgatagagtttctcaacgcggggatgtagtagactccggtgagcagcctgtgctcaccggacttggtggtgaggtgacggagccgacgcccttgatctccacgccggaggcatccccaaacttgacggagcctcggacgctggagtcaagctcggtgaagaactcccgccggccagtcatatgatgggtggcgccggtgtcga

SEQ ID NO: 92761 - DNA, 719 bp, Oryza sativa
caatctgatctatgtgaggcagggggtaggaatccttaggacatgccttgttaaggtcggtgtagtcgatgcacatccgaagcttgccgtcgccttgggaacgaccaccgggttcgccagccactccggatggatgacctcacggatgaatccggcttccagaagtcgcgccacctcctcgcggatgaaggcttgacgttccagggcctgccgccgcactttctgccggaccggccttgcgcccggccgcacggtgagacggtgctcaatcacctccctggggaccccgggcatatccgccggtctccatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcgcctgtgatcatccgttgcctcggggtggcgggggcggaagcgccaagcctctcgtcgccaccctcgggcttggatgcagcggcgaggtggtccgcgcgctgctccagacaagcgagcgcgactttgaggtcgccatggacagagatggggccaccggggcccggcatcttcatctgtaggtaggcgtagtgaccgccgccatgaacttcaccaacgcgggcctccccaggaccgcgttgtagggcagactgaggtccgccacatcgaagttcacccg

SEQ ID NO: 92762 - DNA, 607 bp, Oryza sativa
tcaagagccaggccctcgccgattttgtggcagagtggaccgcggctcccgagcccgtctcgatccccgaggccagcgcggacccctcgcagctgcctcacaccgaccactgggtgatgcagttcgacggctccctgtctcttcagggcgccggtgcgggtcacgttgacctctccgagcggagacgtcctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaaggagtaccagtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccatgcgcctttgaagaaaggcttgcccagccgtcggcgcgacccgaccccttagggagacggatgcgcctgaccggcccctgaggcctgtcggagtccaggcctc

SEQ ID NO: 92763 - DNA, 949 bp, Oryza sativa
gctggtgggtgtctacgtcgacgactggtgatcaccggcaccaaggatgcggaggtcgcggcgttcaaggaggagatgaaggccaccttccagatgagtgatctgggcctctctccttctacctggggatccaggtgtaccaggacgactccggaatcacgcttcggcagaccgcctacgccaagcgcgtcgttgagctggctgggctcaccgattgcaacccagctctcactccgatggaggagagactgaagctgagccgcgacagcacggcggaggaagtggatgctacacagtaccggcgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacattgacaccagcaagagcacgagcgggattctcttcttcctcggcgagtgcctcgttagctggcagtcaatcaagcagcaggtggtggccctgtccagctgcgaggccgagtacatggtggcatccgccgcttcgacccaggcgctctggcttgctcgactgcttagtgatctcctcggcagagatactggagcggtggagctcagggtggatagccagtccgctctggccctggcaaagaaccccgtttttcacgaacggagcaagcacatccgggtgaggtaccatttcatccgaagctacttggaggaagggagcatcaaggcgagctacatcaacaccaaggaccagcttgcggatttgctcaccaaaccccttgggaggatcaagttccttgagctttgctcccggatcgggatggc

SEQ ID NO: 92764 - DNA, 660 bp, Oryza sativa
aatttcgtttgggatttttgattctcgcagttcttgagctcgccgggaacgcggcgcgggacaacaagaagacgcggatcgtgccgaggcacatccagctcgccgtgcgcaacgacgaggagctgtcgcgcctgctcggcgccgtcaccatcgccaacggcggcgtcatgcccaacatccacaacctgctcctccccaagaaggccggctccagcgccaaggccgccgccgccgacgacgagtagagacgaacacagattcctcactatgacgaacactacatgcttccttccgccgatggattagacaataggcatcctgcttaatttagtttttaattgtgcttgtttcgtagacaagggattagttgctctgtaattggtgttaatttatatgaaatagtgtcatctttctcgatgacttttgtcaaaagaaattctctccgggtgttcagattttccaggttgatttgaatgcgttgtctataaatcgtggtaaatgtttcttgatttttttaactcttgggactttttttttttgaaacaacaactcttgggaaattgggttgttgtcaaacgtcgcgtctggtttttctagagttcgtgcgttctcagcgtggtattcaaattgagacttgatttggttctcaaaattgttgga

SEQ ID NO: 92765 - DNA, 790 bp, Oryza sativa
ccacatcgacctaccggtcacctttggtggatcagcaaactttcgcacggagcgggtgaacttcgatgtggcggacctcagtctgccctacaacgcggtcctggggaggcccgcgttggtgaagtttatggcggcggtccactacgcctacctccagatgaagatgccgggcccttgtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggagttgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatcccgagtggctggcgaacccggtggtcgttcccaaggcgaacggcaagcttcggatgtgcatcgactacaccgaccttaacaaggcatgtcctaaggatccttacccctgccctcgcatagatcagatcgtcgattccactgcgggg

SEQ ID NO: 92766 - DNA, 7259 bp, Oryza sativa
cctgattctttttcatctatttccatacaactcttgctatgtttctccttttgtatgacacctgcatagaaagaataatctaagattgcaaaagaacttttgtatttctaaaccagcaagttctaaaacatagagtgtatttcccattctttttcataagtccatttacagtaaacatatatttgtattacagtgaaattatactgtaattccagtaaacaaaaactgtaactacttaaaaatccaactacaatcaatttgataattgattatagacactgaagtgaacaaatgaatcagtttgtataattctttcaaaataattttaatattacactaagtatgtatttcaattacagggtaatgctactataattcaagttaaaatttactgtaacttttttacctgtattttttccttctatttccttagaacttttgcattctttgtccttttgtatgacacttgtaaagaaataatcaagcaagtctttaaatgtttttcaaacctgtatgagtctgttccataagtagtattacagtaaataagtatttcaattacagtgtaatgctactgtaattccagttaaaatttactgtaactcttgttacctgtgttttttctttctttttccttagaacttttacattctttttccttttctatgacacctgcaaagaaataatgaagcaagtctttaaatgttctatatacctgtatgaaatgtgatttctaattgttctgtgtacattgccctggatgcttttctaaatggcaaagtcagcgaaatataaaattacttgttaatatgacagttattaactgaatcactgtcttttattaaaaaatcacacatcaagaaacactaaactactgtcctttatgttttcttaatcatatttcagttgtgccaaatatgaaattattcataaatcaggctatgatttatgatctttttaaaattcatatagtttacatcatctgttttcctgattgtgactatgcttaactatgatgacttgttctaattctagttttacttttcacatttaaaagtacattgtatattgtagttttttggccagatgatgatcaataaaatttgaattgaaaaacaaatcaaaattttgcacgtcatcaggcaagaaaatcaatcatcctaagtgaaaagaatgatttaatttcttgtttgatgatgtgcagaattttgaggtgtttcttataatatctgatggcactttttcttttctatttctttgtactgttgatttgatttgagcagtttgcaaaatattttgtatttttgatatatatttgtgttaaaaggatgttaaatcaaagtttagatttgaacctgattccactttttgcatgtccatagaattgttcttttccttttccttgtttcctttgaatcctgtaaataatgaaatgagtttgtactgaataatgtattagaactgaaagtaaaatataatgaagtcaaaagaatgcataccttttgaagttttcatagatatgaattcatttggcttctgcacatgaccaactttgaagtagtgatatcctgttctttgcttgatgaatctaaaatcattttttaaattggaaatgaagatgcattagttcatgaaatcagcaataaaactcatatacaattgtgttaagagacatatatattgtgctgattgtgatatctcctgtacaattgtgataatactaatgtacaattgtgttagactgtcctgtaattagaatgaaaaacaaattgattttaaatcttcaaaattgattttgaaagtagaattttcagatatgatttgttttggcttttacatatgtactacttttgaagtattgataccttgttttttgctcaaaaatctgaaatcatcttgaaattgagattgaaactgcattagatcttgatttcgtatgaattttacattgtttctttgtagttacatgtatgttcaattgaaattgtagtgttcactctatatatttgtaatagaagttcactgtaactagtttcattatattctattttgagacattgaacaaatcaacaatgatctattatctgaaatcttcatttgttgtctgatgatgggagaaacattaaactgagatagtcttgagtgtaaaacatatcttgaatgtgttcctgaatttgtgcatgattgtgtgagctaaacttttctgaactaatcttttactacagtgagttaatactagaattacagtgattcttgtatgtaattttattacttttttactgtaacatgtaagaaatttgtgagttcctataaattggcttttttgtttgtgctgtatgagatcttgagctttatgaaatattgagttgtatgagacaactggttgacattgagaattgaatttgtcattagtttaatatggtgattatgctgataaaattgaatatatcacaattcaggatatgctatatggcctagttgttatatttctgtataactgtataactgtgatatcttcagagtaaaattcagtaaggttggaagtctaatcaatctgtcatgtttttttataaagttagtttggtattcatcaatagtacacaataatacaatcatccagaatgcagggttgtagtactgaatgcaatttaggcttacttttaacaatacatagttcatatttacagagcaaacatataaattgacagtgctgagttgaatttatccagcaaagtggaatgttaagtactgattcatttaccttgtttcatttgacatattcagcaatttcttgtattcttttgaattgtatatttgacctaaactctctctttattcttgttcaggatttagaatttctaatagaggttaagaactggagccttgaactaacctttgaactggagccttcttgtttctcttaatcttgccttcctcttgtttttcctctgcgttctccagatgttgtgtttcctttgtatggatctcaactttctgttcagaagttgtctttgatttcttctttcctctagaactactctttgattctgacattatactctccccttcttccatctgcgatttggatcctctttttctctcttttttctcttctcctagctccatgtttgattcgtgctagatctgtttgtgaactagtagcgctgttgaaaagtaggggattgaaaagtgtggtcccatacatggttgattcacgtgacatatttttcatctacttggcttccaagtttggtccctactacttttttgcttctaattttgtatcttgggcctgctttttactaacgggctattatggatctggatatggacttgggccttcaaataattggcatgggcgaaaaaatcatgggctttggttatttgtgtgtgattcaaattttgtatcttgggccttctttttactaatgggcttttatggatctggatatggatttgggcttttatagatctggatctgaatttgggctttcaaaaaaatggcgttcaaataatcaaataatatatctgtttttaagtgtaatatttatttgtatcactttttctgagttgttggatgtgcatcctatggtagataaaatctacatgattggaccttcagaaatcattcgattcctatatagacagccccaattaaaaaacggttcggtttctgatacaaatgaaaatttattcgcaggccactttgcatgcttatcttctgaaatctttcttctcttactattggatggtaatttctttcgcactctttcgatgtcattacaaagtaataattacttcaaatctaattgcgtgccactaacatcactagataattcgttacaaagtattagtaatgaaatctgatcttgcctttaccttttctacagagaaagagagtctctgtattcttgaatgctactctactactgtctttcttgctgcatacatgcatgcatttgacaaaaaaaggattttttttaaaaaaaaagaaacatcagtagtacgtacaaagaatcaagcaaaagaactttagtactggtattaactgtataaacggatcaaaatctaagattctagatagctgcctagtaattaactagcagcagctgatgctaacaccagatatactagaaaaatctctctgataacagaagaagcgccgagttaatcggttaataagcaacagctactccaatacagttgatgcatcgcactggaagaagaagaagcagcaggtactcatgtaaatgtaataacgtttgcattcagtacgcaccgagggaagacaagatgaagcttcccaggtacatgctctgcccttctgcagtgagttaagaagcaggggtaggataagaagaagcgaccaccccaacagacagagttactctacacaggtaagaacagatctattccgatgacgacgggcggggacacggcggccggcaaatgactggcagacagaacctgtcgaaggcatcaaaacagatccacctccgaggtccgtctgggctgtggctgtccataatcttcagctgaagctcttctccaatcaaactcttcacgaacctatactcaaaacagacaactgcgtgccaggccgccttacgggcaattattgcagactcgggacagcctctgtacactcttttggctcgctgttttgcatccgcccgataagagaagtagtggggtgggttaaccgccagtgcaccaatgatcggccctctctgacgaataagcctggctgtctctatggcggtcaggggtttgacatactccgtcagtctgagcatctgggtcttgtaaggtccaggatacttattcaaccctaccacggggaggaagtaatcatcatccatagtcggcagacctcccatgccaacaacaacctccaatacatgctcaaccttaccaccttcttcggggttccatgcttctttctttatgcattccatcctcagagtagttggaggtacctcaactctccatcggaatgagcctgagccatggagcctatcgtaaatcatccgatgctgagcttcagtgcatacagtgcaagcagacaatgaacacccacctgcaaccacacatcaatatcattcatctctgtatctgctgtcatgcaagttaatttaagcatccatatatactatcagtatgattgattgggagcttctcacctctgccttgaacagcaggtgatccgacaattttctccagctccatgtatctggtaacacgagcccagcaagtgtggtaccagtcttccatgccagccatcttacagcttggttgcaccagcgccatggtgttaagtatgagatgcaagcaaactcggtgtcaaccttcctaatgcctcctccaccaaaagcatagtctgcggcccttcagccctctcattatctgcgcccatcataccattgtctccgccgattgggaaactggttccacttatctgagaaaagaacacaatgttaattaaattctccataagattagcacaatccatttcaaaaaatattaccacgatgttgcaattatgcccatgttagaaccgaaattaaaaatgttttgtttactgccagaacattttctggagaaacacaaacgtgcccctggtgcatgaaaactgttaccagagctactctatgtcagatttgcaaatattgaaactattggtttatcaattatggctaagaaacaggattatgtaaaattacatcagacatggtttcatttaagctaagtaaaagaagaaagttccacacattcaagaacatgagtggcaaatgtcatgagatcagtgcatctgtgaacatatataagaaagaaaaaactttgaaatttgatctgtataaataaccacaggctaaaatgatgaatcaaatagaaggcatcttcataattacatggagaagcctaaaccatgtaaacatgtcattttcttgtgtgccaaataatctgaataaacgtgttggttccagcactcatagactagcattattgataaaatgtcaatgggatttgcagcactaaaaacttgaacctacaggctagagactccttatggtttttttttttttgaagggaacctatggaaataaatgatactaagaatttcttcccgcataatgaaagaattgcaacggagagcagaacaaatacaatttgctcaatctgcatcctctgtttcaagaaaacatcaacagttgatccccaaacaacggagatgctcgcacgaaccatatatacaatgcatcatgtcctatgggctgcagcaaagaggatggcatatagcaattcaatacaatttgcaaagaacgcaaacaatcttgaacatcatctagcacggtgctatctaggacatagtaagagaatgacaatggcgatcagatgatgttaccattttcaagaaccacaccgaaataaatttggagaggaaaattcatagcgtgtacagaaaatttaagtaaacagagagagagaacgatattttaagcaggtgcgatgatgactttttgatcagctattgttgcaccttgttacaatgaaataaaactgaaatctcagctttcctctagcagaacaaaaaactattaagggaacataaaatccctaccgctaacaggaaatgaaaatttctaaatatattattctatgcacttgttcttttggtaatgtataagctagaagttcatggtgaataatggtaaaaaagggaattacttcacactaggtcttttttgggggaataacaaaacaagaagtacacttgatagcgtggtcatggtggagttcttcaagggtacagttgttaccctgatcaccctggaagaaccaagtaaacggagctgctgcactgtgaaggaagcaaatggggaggagcgagaattggatagcaacctaagaactgcccccctacgaatgtaacatacagaattaaaatgcaactaagaattcgagacattggtaacatcagaagcgaagaattttttgcaatctgcgttcaagaggacatcaagaattgcctcaaagaacctaagtcatgcaaatcaattaagaattagctagggaagggagtgctcaccagaagatttggttctgaaactggaacggaacgcagggagtcttcggggggatgacttgcaccacgcaggacgtactcgtgggagcggccaaggcatccagcagactcgtcccccgatcccaagacgacggtgaacaagccgaaggcggtgtaggtcgcgcagggtgac

SEQ ID NO: 92767 - DNA, 687 bp, Oryza sativa
caaagcacactgcggatttcagatcagatggtgtacgtatgtgttcttttaagggaattcaaaagggttgaattcgaaaagtttggaattggttttgtggttttggtttggctccatctattattatttctcaggctgcctttcctctccaaactgctttcagaagctctgcatgagtgctgtaccgtggaaaagaaagatggaaatttgacataaaaaaatgatagacaagattagattagtgcaagtaattacatagaggaatttttttatactagctcctatatgtatatgtaatgtaccatgagcagattcacaataagaatcttgcacatgtcggtatttctagtctgttgggggtggggatatccctgtctgactagtactaccttaataaattgcttttttttttttgctgttggaatggattacttggaagctgtttaaagttttgagactgttttgggatggcaatacaaactccgggctgcgcaccaattttgccaaatgctcgattactccgatccgctgttcggatgaggacctggagctggtccactcttgcttcccctgctcgatttctgattttccttgcacctacctcggcattccgctgtccgtttgcaagttgccgaaggcggctcttcagccactggtgaacagggtcgtgcatcgtctactaccttg

SEQ ID NO: 92768 - DNA, 3544 bp, Oryza sativa
agcgtaccaggccttcttttttggccagcactcctttgcctgtgctgatcttctctggcacgcgaagggccctgctaaatgaaagttcttcctctggtttgcatttcagcggcgctgctggacggccgacctcctcctaaagcgcggcttggatagtcattcggcctgccctttctgcggtcaagagcttgagactgcgaaccacatcctcctcgattgcgtgttcgctcggcaagtttggctccgtgtgctgtcgcctcttggttggactgccctctctcctccccggggtagctgtctccaagattggtggccttcttctagggtttgcttgccggggcatctccgggccagtttcgattctatggtcctcctagtctcttggcaactgtggaaagagcggaactccagagttttcgactctgcattgtcatcggtctcggaggtccttgagtccatcctctctgagggccacctttggtctttagctggtatcgctaattttggggttctcctgggaaggtagtggctctgccccctcccagctatttggagttgtgtgtggccgtgacagtagtatttcgtctcttctttattttatctttttttctcccctttcttggcataagtcggtctgactgattgcgtcgtgtaacaaacattctattcttctaatatattgacgtgcaatccttttgcgcgttcgagaaaaatgaggtgtttataggttgtaattcttgtgcatatacaaatagcagtatttctgaagatttactgtatgcatatacaacaggtagctattgaatatgtacaccacagatagaggaattatagagtcgttcgcagatcagaattcagatattggagaaaggaactactactactaggtagcactgatgatgggcaggctgaattgatgttgtcagggataaatgggcccaagttgatgtagaagagaaaggcaaggcccacttggttacgagggcctttgggctgaggcagagggatgtatggactagtcgttcgtcgtcttctccgttgaattattaattaaggggagtatataattcacgtttataaaaagcggaagaagaaggaaagaaaaagagaaaaaccagccaagatgacaatcctatcatacgatgacgatgtatccagctttgtggtacgcgcagcacgtagccctcacctcgccctgcagtctagtagtatattcccattcccattcccattgagttagataggtagagtataggataatgcgagagagctagcatatgcctaccatccatgatatatccatccaaaaacacaaatttggattggattgccccctcttaattaatctacatgtggcatgcagcaagcggttttaacccagatttaattactagtagcatgctgtttgtcaacaatataatcatttcttaatttacattacctttggtttcgcatcaaacactacatggcaatccaaatgaacgatcaacatagctgcttcgtctttgtagccctgtgataattaaggaggccagcgatcgatcgatcgagccaaattcctagctagcttggttttaattcattctaccctatcctatcgataattaatactcctattcgtctgtctatatatggcagctgctgcgacgaggtgctcgccggcggcggcgccaccgcgccccgtccgaattccaagagtgcgcgtccgctgctgcgaggacacgctcggcgtcccgcgcagccgccggcccaccagacccgagctcgcgcagtcgcagcgcttcccggagctcgtcacgccctacggcgccgccagctaccttccccaccagcagcgctaccctcctcccccacgcccgcgccgcatcgtcctcgtccgccacggcgagagcgagggcaacgtcgacgaggccgcctacacgcgcgtcccggacccgcgcatcggcctcacgccgcagggctggcgcgacgccgaggactgcggccgccgcctccgccacctcctcagcaccggcggcggcgacgactggaaggtctacttctacgtgtccccctaccggcgaacgctggagacgctgcgcggactggggcgcgcgttcgaggcccggcgcatcgccggcgtccgggaggagccgcggctgcgggagcaggacttcggcaacttccaggacagggacaagatgcgggtggagaaggagatccggcggcggtacgccgcttcttctaccgcttccccaacggcgagtcggcggcggacgtgtacgaccgcatcaccggcttccgcgagacgctgcgcgccgacatcgacatcgggaggttccagccgcccggggagcgcaacccggacatgaacgtcgtgctcgtctcccatggcctcaccctccgcgtcttcctcatgcgctggtacaagtggacggtgtcgcagttcgagggcctcgccaacctctccaatggcggcgcgctcgtcatgcagaccggcgccggcgggaggtacagcctgctggtgcaccactccgtggacgagctccgggagttcggcctcaccgacgacatgatcgaggaccagaagtggcagatgacggcgaggcccggcgagctcaactacaacttcatcaccaacggcccttccttcttcacccacttcacccatcatcaccacgacaaacacaaagccgccattgacgacggcactggaggatcacaaccgcaccttcttgatcaccctacctttaattgtttggttaattaattactactccttccgtttcacaatgtaagtcattatagcattttccacatttatattgattcattaacatcaatatgaatgtgggaaatgctagaatgacttacattgtaaaacgaagtaagtactcctgtacataccactgctacttaattagagtgattttatggttctcaagaacgtaacaggagatgccatatttttcggtgtaaactttgatacctctcactatgctttgattgactatacacatatttctgtactctgcttagcttctctgtgtctgaatgcaagcttcatctaatcatccatgcactgaaatgatgagctactcagctcagttaagttagatgaaagaaaacaattaatttagctgttccatatatacgatgtgaatgccatgcaggttttgtgtgtagttggtagcaccaatatcagcttaattagcaattcagaacaattgcagtgacaatgcaaggaacaggggcactctgctttttcctgatggagaaaaataaaactgggcttttcaggccagcctatgaatcacactgttgggcttggatagatgaagccgtgaaggcctaagggcaaccgcaatagttatctataggctctctactagagatccatgtcagcatattttcctacctgaaagagaataaatgaagagagagagagcaaaactatctactaaccgggagatagtgtataaagaaaaacgaggcaatggattagagagctatagatacccatgtagacataccattgaagtggtttactattaatctagtctat

SEQ ID NO: 92769 - DNA, 1739 bp, Oryza sativa
aaagtcaacggtgtcaaacattttaaaacggatggagtattatactaccatggatcctctaattaacttgctaccctctgattttgagtggctgaccatatgtcagcgacccatgtcagaggagtttattttcaatgttatatatatgtcactctacaaacatataaaattaaatttaatcttcacattccacacaaaaaaatatgcttatgattagtgttagatatattcatgaacaaatttgtttattttgtttctagctcatttgtgtggattgaatttgtgagtttcttttttttttttgcacgacgatggatacttactttatcaatgttacaatttttaggtctttttacaactgtttgattgatatttaagaagttgtaaaatccatttatgcacatatatatttacaagttcatgcattctatcttatgttaattattaataatttgagtaatttgtgtgttgttttctttttttttttaacttacaaaatgtttgcgaaagcctgtgtagcgcccgttccgccgtggcgcctagcgggaaaactatctcttaaaaaccctttttgcgaaatctgtttctttgcttgttgtctagtgtccgtgccttctcatatctcaaatccccgatctatcgtcgagttcaatcccgaatccaaatccttcccaaatcaatcccttcgcaaaagtctattttgcctccctcgggttcgatgggccgaatccctcttggcccatcttccccctccctccccggctctctctctctctccctctctctctctctccgctctgcccgcgcaccgcgcgcgcgtgcgaggcgccgagccgagccctccgactcggcccccgcgtgccgtgcgcgtgcacgcgcccgcgcgctcgttccccgtgccgcgcctggcccgtccgcgccgcctggccccactgccctcgctcgttgccgccgctcgccatgtgctcgccgccgtcgccgcccgagctcggaagcgcctctcgtcgccggcctccctcgatgcgtttcctcctaatccgacgctagggacagattcccgtagccgcgtagatgctctcgccgccgggaatcggcccctcgtgaccttgtcgccgtttcccccttcttccgccgccggttgccgccgccgcaatccgccgccgtcgagcatcccccggcaaatccgagccgttggctcgactcccctcgtcccgcgcaacttcccggtgtgctcgctttcgcctagatcgccgtgtttcgctccgccgctcgccaccgccgtccgccgtccgttccggccggcgtcttcttcaacctcccgtcggcccgcgtggctgccacgtaggcgccacgtcggcgccagctcggccaagactgggtcgagccgaccccggtcagccgctccctccggccccgctcgcgggcgcagtccaccgcaagccgtgaggctgcgcgtgggcccgccgcatccgcgtccaccatgaaccgcgcgcatgcgccgcgccccgctccacaccctagcgccgcgccgcgtgcttcctccgcacggtgagccgagctgctgacaagcgggtcccacccaggaccacgcgaggtgagcccggtccaccggctccctctctcctcccctcccgcgcgcgctctgggccgccttttgggccggccggcccatttagctcggccgagccgcccctttctctcgggccgcgccctagccgcccgagggaagtttaattccc

SEQ ID NO: 92770 - DNA, 580 bp, Oryza sativa
  unsure (1)..(580): unsure at all n locations
ctgactatacttatagttagctctctctcctgatctctctcttcacaattaagcagctacaaagaatataatggggttcccggtgggtggctactccggcgtgccacggctgctgctccacctcctcttcctcctcacccacctccgccgctctcctcctgcctgctccgcctcgccggcgccgacatcgacgactccccaaccgccgtcgacgccgaatatgacggcagctacagctacagctcccagtcgtcccagctgctggagctggacgaccactccccggcgctgcgcttagacnnncttcatcatccctgcagccgccgctccacgtcgccacctgcgccgtctgctccgcgacttcacaagtccgcccaggtgcgccgcgcccatccgtgccgccacgtcttccaccgcgcctgcctcgacgcctgggcccaccacggccaccgcacatgccctctctgccgctcgccgctgctgccctagtcgaaaccgcccgttctcatgccctttccactccctgcctcctagccccagggtcctttctgcataattatactcgcatagcaaaccgtct

SEQ ID NO: 92771 - DNA, 525 bp, Oryza sativa
caatcaaataaattagctgcatgctaagctggagcctgccttactagctcctgcaaaatcatgcagcaactgagactccatgaggttcctgtaagggagcacgtcatcttcttcttcctccgccgcctccaccatgaatgactgctgctgctggtgctggtgctggtgctgctgatgctgatgcatcatcgacgccgcaaatggctgctgctgctgctggagccctagagtaagcgacacggcgccgccatgaccatgatgcaatcctgctgctgaagaatagctatggccgcccaacagctggtggctgctgtcatggtgatgatcgatggatgttgatgctgctgcagggatcatcaacgaggaggagttactgtttccgctgctgcgaacgtggagatggtagctgctttgttgtactaagctggcttctgctgtcgttgccgtgtaattcttcttgggatcatctcgatgctgctgtttgttgcccgctgcgctaaggtttaatttgttgttgccatcaga

SEQ ID NO: 92772 - DNA, 2027 bp, Oryza sativa
tcctgtagggtccaacaaatctacggtatctctctatctgtagtagagccataccgtcagtcgttggtagccctccgatgtcaatgattacatccagcaccctgtcagatttcccaccactttcctgtgaccaggcattcctcttaaggcattcttttctgagttttgcagggggtgattctaccctccatgcaaaggatcctctcccatggattctctcaaacgcaagccggtcgatacatacactgcacgccgagagcgagcagcctcctgcaccatgcatacaatacatacacagagagatcagtcagtgagagggtggagaaattagtcaatcaatgagagagcaggtattactattccagttaggagcttcacctgcgtattgaataattggtgagcccattacttcttcccaactgtattcattcggtactaatgcttggtgaatccctgccactactttccacttaaaatttcttaagctgcaaacccagtcagatagaaactttgtgcagtacacaggttttgcatcagccttctgcactgaggcctcctccaagagtgatatgttcattccctcatattcctcttcattcctatccttgtaatctgcaagcattgtgcaatttgttcgtcatgtgactagaagcagaagcatgaacaaacataacaatgtactactactactacaaattaacctggtagatctgcaagacccatgcagctaacagcctcaattactacttctagttttggacttgagcttgttggagctagcgaggacaaaaactacctgaacgaattgctacactactagcttcatgctaaactcaatctctcaggcagacatggagcaatgagcgaatacattttttaaggtactagctgctattccctccattctaaaatataaacacatgtagcatttgagatctgtaccaaattacaagtacttctaaagcactcaatttagaagtgctcttcagtgaaatgtttgtttactgaaatataaacacatgcaacaaccttatttcagtgaacatacaagaaaaacaaaacgctggacaatggggaaggacccaatgtggaatttatcaagaaagagggtgagcgtgtccggccagagtcgaacgcgggtcgcggggagcacaacggctgcaccatgccatctgcgctacacgcagtctccagtgaacatataagcattcactcagtttcagttaacatatggagctaatttcagaaatatgaggagcaggctatgggctgttttcaatgatgataccagttaataagagagagccagtgtttagactgaaaacatctatcagaacaatcatgataataaatattggttatatcgttacctgatacaatgtgatgtatatggagcccactgcttctgagaagcagacgaagggagatgaacgtctgcaacggaaaacacacaagggaagcacatgatcaacaattgaatcaggaatttcacatcaagatgtagctacccccaggcatgatgaaagaatttgttttttaggcggaaaaggggaataaccagaagaaacacggcgcaagagagggggtgcaagaaaccccatgagaatgacatggcggtggcaatgttgagcgaatcaagaacaagaaacagacttaattacccgaggacgccgcttgcacacggatgtcctgttcttgacgccgggttcgcggccaggcgacactgacacctgctcgcggatggccagcgtcttcttgttgttgtgcacatgtagaaggccggcgtcaccgccgtagatggggttcggaatcacaaccctgcaccggcggaagtcgcggcacaaggagaagaggctggtgacgtcgtggcccagtgagaggggttcttaatcgccgatgggcgaatccgatagcgtcgtcgtgtgccagcgcagtacgccggtgacgccctcgccgccgtggaagggggtcggcatcgcgcccccgcgctggctgacgtcgtggcccaggggcgcctgctcgagctc

SEQ ID NO: 92773 - DNA, 4562 bp, Oryza sativa
aaaataaataaatcatgtttattgcttctgcaaatttcctttttctagccaaatacacaactactgcagcagatatctcagaatacagcatcagggctggttcaatatcccaatttgcagcaactgggtaaaagggcttttgtcaccagtctcaagtcagtgcacctccagagtccagagtgacaaagaggtgtttgatctgagcaggttcttcatggagaactttgctccgcatatactgcttcacttggtcttcctgctacctcaaagattcattttgttagccacacaaagaatgtgccaaacaagtatattggggacatcgatgtgaaaacaagttccaaacctcaagctatagaaattaatccacaggtcaacagtaacttaattgtggatgatggagatggaaatatcctttattccaaggagtcttgggtgatggtcttgatgatgtcctttatcctcagggagtcaactgcagacacaaatattgaaccagagaaagtcacacagtacatcccgggaattacttccaccttccaactttcagcccaccattctttttgtagatattgctttgtgctgttctattctaaacctattgtcattgtcagattgagaaataagcccataaaaatcactttcagcttgaatggtaaagatgttgattaacaaaaacaagtctcacattcaagtgattctcaagagtaccaggtatctgtggtgatactaaaaaatgacttaatgagtcgtttaaggacaatggatgataactcatggcatcgtccacatgacaagacttctgcaacaactcaagaaaacaccactcgagttcatgcgagtgtactccctggtaatccggttgcactctgaaagttgtactgtcaccatggtcactgcataatgaggttttgtaatggctgcaagaactcagttgacaattgcagctcacaaagcagatgtacatcaatgcttcttcgctcatttgaagtttaaaaagtgaactatggtgtatgttatgatgagaaaaatgtcgatgattgactgggctttcaatgtcatacctgctgtgggagtcctgctgatgttgtgtctgctcctgctgctgctcatgattgccattatcacatattcaaagtagttttgcgtgctaggatgctgtgcatttggtgcaccatagtatgcatcacagcccgtatccttagtagttgccattccactggctgggatcctgctggggaggcctgaaattcagtcagctggcattacaggttttggggttaacctatgcacatgcatgctgcagctcgcataaacaaccaaggattaaactctgtacagaaacctgtttgttctgatgaggagagcagccccatgaaagccgaacttggtacccacctatcggagatacactccaaacacggatggatggtttctttagcggatgacctgaaagtagaataatataaccaaagcaacaaagaatcatatgtactgatagtattaggtgaagatgattacaaagaaagcttgaagaattcattaatctgctgctagtaaattgggcaaatccacggagctttgcctagagaaatcttcacatgaccaatttcagcacatgattgagatggttctcatttacattggaatctatgggggcagcacaatacgaaaaatcagttgcgtcaaaaaaaaaaaggaaaaaaaatcaggaaacagcaagtcgtagaattaaataatgagaaagttaatgattctcgaaattgtttccttgggagctccagctctggtaagctgcaattagaaaacatatataataagcaccataagttgagaaagatcaccataggatgctgatgctatatagtaaaaaagtatggaaaacccgaaatcaaagttagcaaccatgtttgctagccagacgcccagacccaaaacaaacaggccactgaagacaacagattcagtgttaccatgttgataagtaaactaaatttcttccttaataatctatgggatgatgaaaggaatacaagcaatccttacttgatgaaggtgatttgacaaactagtgaatgtattgtatcagcttggctgaaaaaacaagaaaagactgaatgcatttagtaattagccaatattgtgaccgaatctgaattgtcgtgcctggttgcgggcttgtgatgtgctttgaagaggtggcgggggccgggaggaggaggacgcggccagcgcgccccgtcctccgccgccgagcgccgactcctccccacttccacaaccacatggcgccgccggagttggaggcgccgaggcagccggagcaggagtggtcgcggtcggagccgacggcaagaggggcgcacgaagtacgcccgcggcggaacaaccaggactgagaaggcgatgcaggcggcggcggcggcggcggcggcgaggaataggaagctaggagcataattttcaacttctgagccgttggatctgacaagtgacgaggcctccctcaccctaccactcttctgcgcaagtctttttctttttcttttaacagaaaaaaaaaaccctactggaagggaccgatcgcacaaacagaagggtgtatgtccgcgtgtaaaaaaaaaaaagtatactccctccgtcaaaaaaaaaaaaactcaccctaggactaatatgtgacataatctaatacaacgaatctagacagaagcatgtccagatacgacagaagcatatccagatacgttgtactagattatgttacatctcattcctaggttgatttttttttggacggagagagtaggcggggatgattcacacatgttgggggagtggctccggttgacggagctggcctccgtcagtggggaaactctactcggagccatccaccaagggagaatgaccgaaggtttcggaaccaaccgagagctccggagcacatcaccagctccggagcagactagccgccctgaagcctgtcataggctccggagcatatcaacgacgctggagctaaccaatagctccgaagcagatcaagggctccggaatatccggggacccaaagtatccaagcatgaaggaatggcgcacgagcgtagtggggcgccataaatacgcattacgcgtccgccaaccacctctgacattctgacaggggcagggcggcatccactatcatccgggggcatgcctttacccggataatagccatcaccctcggaaagcgtcaccgcatccttaatgggcgcagcctttcctgtcacttgggattttaacgattgcccaagggctagcccatcggccggccacactacatctgttttagttagagcaaagatgtaactttctcttgtatccctagtatatgtaagcattgcccacagttaagggcaaattgaatacagaatacacattgaatacattgtttggactttgtcccaacaacacgtctaatatcattagtggaactagttgcctctattggaattaatctcacatataatatgatcatggcatataacttatacatgtgagaaacatcaagatgtcttccgggtaattccacaaggcggtgggctagccagccttttatttgatattagattcttccctaatatttatttttttttactcgtacatgtgtgttagagaccattatatcatggactcatgtaagtgattaactgaaccatgtaatcgtggttgatgacatggttcaaatgttgtaaaccgttagatcacagccaatcaacgaatattaggcattccaagcattctagaaaatctcttgatatacgagaatgcatgtgtcagggactcggtttgtgccatccaatgggccagttctcaccgagcagtgtcccaaaccagcccaaaagagagaactataagagcaacagcagctggtcctctaaggacgaacagaccagaagctctcggggaattttaactatttgctacttttaggtttgtcaattatctaaatatccctcttaggttcgtatttaataatttgccattggagagaggtgatttcttaactatttgccacttttgcctacgtggcgagccatcgtggcatgtccgcgtggaaaacgacgtggaccccacccgtcagcccctcccatctccttcttctccacctccggccatcatttctccacccatcagtcgaaatccgcaccatggggaggttgggtgggcattggtgccagcgcacgagcttgacgcggtagagggaggcctgccagtgcggcgtgagattggcgagtgtggtggggtcgcagcagtagacggcgagcgaggtcaccgccggcaagcaacccacgagacgggcggcgatggaggcgttctgctcggagatcgcctcggggtggtacaggttcatcctcgacgacgtcgatgtcaacgacggcgcgccgccgccgccaggccggacgaaggagaggagcgggtgcccccacagcgagacaagtgagaggtcgaggcggtccagcatcgggaagcagaacgtcggcgagaggaacaggaaccccggcgagccgaggtggagg

SEQ ID NO: 92774 - DNA, 853 bp, Oryza sativa
tattcatgttgaaacctaacatatattttccctatttagcaaagctggggcagcatttcctttcattaattgcaaagttgcttctcagataattatgagattcaaccaaaattttgaattctgaccatcaattatttctgatatgcttagtttaaaaataaaagaattaacatatgtagatttgcctcgaaagttactacaatatcagaaacttattataatataaaattgattgttggaatttgataagtttgaccgaatcttgtcctaaacgtcaaatattttttgaacaaagggagtaatttggtagagaatcgacccaaacttgttatacatggagtaaaccaaccatttttttggcaaaagtaggaagaatccttcagccactaaacctgtttaacttcattaaaaacttcaagggagcttataaacacttcttttaaacaactggctgaatgacatcaatgtttatactgccacagggaattatggggtctggagtgggctacgtactgatgacatggtgtgtcgaaaagagaggtccagtgttcacttcagcctttattcccatcatccagatcatggttgccataattgatttcttctatcacatgagaacctctaccttggaaggtaatcttgtcttcagttcttaaatcaaggcatggagtctcatgtttctttcttaatttattcctcttcctgatgaagaactgcagaatctttagtaacagacattggatatatagcacaattttattctagctagtcttattattttctaaactaaattctagtcttattaaaagagtgaaatggtacatagatacatcacattcaagctatgagtttt

SEQ ID NO: 92775 - DNA, 1084 bp, Oryza sativa
agatacttcaccgaggtcaccatcatcctctcccagaccggcggctccgtcgcctacctcgtcttcatcggccagaacatctgctccgtcttccccaccaccgccgccggcggcgaggagccgccgcgtcgcgtgtcgccggcagccgtcgtcctcgccgtgctcctgccggccgaggcggcgctctccttcatccgctcgctgtcgtcgctggcgccgttcagcatcctcgccgacgcgtgcaccgtcctcgccgtggccaccgtcgtcagggaggacgtccagctcctcgccggccgcggcgggagcccattccaggggcggagcgccctcgcggggctctggggcgtcccgttcgcctgcggcgtcgccgtgttctgcttcgaggggttctgcctgacgctggcgctggaggcgtccatgtccgaccggaggaggttccgccccgtgctcctccacgccatcgccggcgtcaccgccgtctacgtctgcttcggcgtctgcggctacctcgcctacggcgacgtcaccagagacatcgtcactctcaatctccccaacaactggtccaccgccgccgtcaaggtcaccaccaaatcaaacataaattcttttagagttctttgatcaagttggccatcaagcacgatttgattatccgattcgcagatcgtgctgtgcgtcgcgctggcgctcacgttcccggtgatgatgcacccgatccacgagatcgtggaggcgcggctgttcccgtcggcgggcgggtgggcgcggaagcgcgcggcggtgcaagcgagccgcgtggcggtggtgggcgcggtgaccgcggtggcgtgcttcgtgccggcgttcggggagttcgcggcgttcgtggggagcaccgtgtgtgcgctgctctccttcctgctcccggcgctgttccacctccgcctcgtcagagcggcggccagcgcgtggcggcgctcggtggacggcagcttcttgctccttgggctgggcttcgcggtccatgggctttacaccgttgtctcggggcctttgaacatgggcggtaatgggctttcctcgccgtccaatcccaatc

SEQ ID NO: 92776 - DNA, 634 bp, Oryza sativa
ggaatcaactggaatactcccaaatcattggctcgttgatgtacctggctagtgcaactaggcttgatatctcctttgctgtgagcaagtggagccgatttacttctaatccgggagatgatcactggcgtgcgcttgagcgagtaatgcgctatctgaaaggtactgtggaattggggcttcactatactgggtatcctgcggtactggagggttatagtgattctaactggatctctgatgtggataagatcaaagccactagtggatatgttttcacactaggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaatggtaattgtcaaagtgaatagttctaaggataatatgaaatcgtctagacatgtgaaaagacgattgaagtctgtcaggaaattaagaaactccggagttccaacgttggattacatccaaacagcgagaaacctggcagatcccttcacgaagggactatcacc

SEQ ID NO: 92777 - DNA, 1564 bp, Oryza sativa
tcttgtagtattgtgctaacgctgatgaaatttatcatcaggtggtttcgacacggcgcacgcggcagcaaggtgatgtattaattaagctcgatcgcgtgaatagaattaattaaccttgttggattaactggtaatcatattgattcatcgaggttgatgtacttgttgctaaatttgcatcgatcgatcatgtttacgcagggcttacgatcgcgctgcgatcaagttccggggactggaggctgacatcaacttcaacctgagcgactacgaggacgatctgaagcaggtgatctagatatatgattacatactaatcgtagtatgatactccatgctagctagctagctcgtctcgacctttcgatctcatgtgagtgaactgagctgggttgctgcagatgaggaactggaccaaggagaagttcgtgcacatactccggcgacagagcacgggattcgcgagggggagctccaagttccgcggcgtcacgctgcacaagtgcggccgctgggaggcacgcatgggccaacttcttggcaagaagtaagcttaattagctagctagctagtgatcccccttcatcaatacttcaatttcacaaccgtataattaggagtgacaaacgaaagtacagatgtgagatgttcaggttaggaatgataatgagtttaagctaattaattgagtccagggccatgctagtgtgacacaagttgtttccggttggggcgtcttaatatgattcgggtgagaggtccacatctccaattctcagtgcatcaattcgcagccaatattggggaaaacacatgtactttctcagctggagagacagtattgtcatcaaagagtctagctagcagttaggcatgtactacgcttttctgatctgaagtggtctcagaattcagaaatatcttcttgcaggtacatataccttgggctctttgacaccgaagttgaagctgcaaggtactattcctttgatgaagtgacatgcatgacgagtcatgaacttcctggtttctcgctcactttcgattcatgtctggttgaatttggtagagcatatgacagggcagctattcgcttcaatgggagggaagctgttaccaacttcgagcctgcatcctacaatgtggatgctttaccagacgccggaaatgagggtactacaatcagtctcaccatcgaattttccgtttcagccgaagcacaccaaacaccatttctcatagccatcactgtttttttctttagcaattgttgatggcgatcttgatttggatttgcggatttcgcaacctaatgcgcgtgactccaaaagcgatgtcgccacaactggcctccagttaacttgtgattcccctgaatcttcaaatattacagtccaccaggtaatgccgtaatgcttatagaaagtaataaattctcaattctgtttttagtttcaattttttttcctgtttttatgattttctctgcaagtatatatctgtcgaaaaaaagtgcatgcaaaaaaaaaaaaatggtagtagaatggaaacaactgtagc

SEQ ID NO: 92778 - DNA, 2150 bp, Oryza sativa
gccaatcttctgaactctactcctcgctcattattgtctaatataggatctagatgcctctctttgatctcttgagaggaaaccggctctattgattcagtcattccacttaggcaacctggcatattatccatccctgcatctgaagtatgcaaaacaggacctttccctctttcaggctcaagcatatggccttttgtacttgcaattcctaagcgaggctttccaagcctccatagaagaggagggagaggtggtggtttttgaggatcttcataggaaacatttgaaaacggttcgttgggtggtggaacaggagacgacaaccgatatgtttcctcagtacttggcatggcattagcagaagacattgtcgatgcctcagatagtaccactgattctgaataacatggttcgatttggcaatcaacttgaggcaagcaataagatccgttctctgattccaattgcttgcatggaggttcatctagctcacaaaccttatcatcattcaaggaacatggagcaactagagaatccaattctgggaatgaacacacttcttgctctaactccaccggaagaacatgagttgatgtagcaccatctggttcattagtcttatcattaggtgaagagcacggaatgatttgggaatcaagatcaccagagacactgtcttctgactcgagttctattaaaccagaactgctcaacggaggggcatttagttcatctattttctcattacttggtgttggagaacatgaagcgatttgagaagcagattttcctgggacacaaacttctctctccatttccgctaggagagtattgctcaatggagaggcatcatccagttcacctatcttctcatcaaccaaagaagatttggtgacttgagaattatgctctcctgatatacaatcttctggttcctgttctgcttcaagaacagtactcaaaggaggggcatctacatgatctgccatctcattaacagagcaagatggaacagctcgagaatcaagttcgcctaaaacaagagcttctgatccctgggtttgaattcgtttgctcaacggatgggcatccacttcatctctcccctcatcagttgaagaccatggaacatcttggtaattatattcatccgagtcatgaacttcttctgatggttccaacaatacggagttactcacaggaacttctagttcatctgtcctttcattaataaaagcacgtgaaacaagattggcacaggtttcctgtttatctttcactgcaatactgttgcctgaaggagagctacatgtttcatcgatcatgtcattatcccacaactgggaatcaccatgagaatcaacctcatgcaaggcatgttgttccacctctagttccattggaacagaagggacacctaattcatgaattttctcatcaatgaagggctcatcggattttaagtcagaatttgctgccttgtcatcaggatccgctttggcagaaaagtgcatcaatgtatcatctggagcatccctggattcctcctggtccactcctgtccgtactgcagagacacaatagaggaactccgactcactggtcaccaaactacttgagacgacattagaatctgaggctggtttatcatcaatactttcaggcgttgctgtcagatccatctcgtggtactcatggcagaacgatctgaagtcctcctcagtcataacttctgatggcaatggcacctcatcaggtggagttgcaggttcccagagggaatcagcaaccggaaccggattcaggtcttcgattcccatattaccatgagggattaatagttctgaaataaaatcctgttcttcctcagagaaacatggttgatagctaggacacggatcagctagagcatgattcgctttgtacccaggatccatgaatgggtttgtaccaaaagaatcttgagcacgaggctccctcaccaaatcaatattttctggttgttcttccaccattttactattcaagattactgcaccacccttctccacatcacaatgatactgaacgtcagcactaagattggtctcgtctggtaattcctcttgacaaacaggatttttcggacaatgcaatgctgaaagatg

SEQ ID NO: 92779 - DNA, 1288 bp, Oryza sativa
gaatattactacatctgtaagagaacatcaataatcaacaacaggcatatctttgttgcagacagtacaactaaaatgtcatacaacaaagcttataagacaaacctcaccaacaaagagcctgtcaaaagccagcaaaagttttgcaatcaccagttccaaatgatgacacggtatataatagaaacttttcaaaaaaaacaaaatgctttaaattttacgaagtgttgaacttagatactgaccgaattgagttgaaaacactacaactattccttcaaaagaaaatatatatgaaaggcgctctcatctgactctctagaactttcgtctctattatgaagttcacaatgaaatgtctttgtccctcatctaacaaaatccaaactatgcagcatttccaacactccgcaatagacaaaattaacaaggttgaatacccttcccaaattacagaaattagctgcagtgttaattttctcttctattcccaaatacaacaatgtaccctctagtctaatgtctaatctcttcactcactaaaacagctatcaattgcactacgaaaaagaaggaactatcctgaaatccgcacagcgtgcaatgaagactaaaaaaagcaatatctgcagtggcccatcttgctagcccgaaagggatgcaaatgtaactcacaacccccatttgccaaggaaaaaaaacgtcatgactcaacccaaatttggaaatccaattacatgctcaaactggactcagaatacatccctcgtggtctccccaaaatttgtaacaaattcaacaggtgaagcaaattctaagaccaactgatgccatgaaattgagtaaatgagcgcaacaaagttgaattaaagtgtttccaaaaccatcgagttatctagtacatagaaacatcccaaaagcagatgaacacacacaaaaagaaattcaaacaccgacacaccgcatctcaatcgaccgtaccataagtccaaaacacatccagaaacttgcaaactccacagcgaggccactcactcactcgctcattcgctaacacgaaccctagcatctctccacacaggaaaaagaacaaagaacaaagccagtggtactcactccgcgagatccccgagctggcggagcacgccgacgagccccgccatggcgaccccctcgaggagcgcctccgggtcatccttctcccccggcgcgtacagctccggatccgacagcccgtactcgttccgtatctggtaccgtatcatctccgctccccccttctctctcc

SEQ ID NO: 92780 - DNA, 818 bp, Oryza sativa
taatgatcttaagctgataaatgctgttaaaactacttcagtgcagtacggttaactattgctctctgtttgagaatgcaggttcctcgggcatcagctagtgcagtagcatttggtttgggtctactttctgggaaagggaagcttggacctgtgaaaaaccgtgccttttctgttctgagtgagagtcgtgcaagtgatatttgtctgcgattctttgatagctgtgaaacatacaaggtactattgatgaactatggtaacaatgagataaaataataaacatatttggagaagaataatgtgatcttgtatctcgacatatttgttcccttctctttggatgcagacattttatatttataagacatgcaaatgttggatggatatcttaattaccaattttgaacagatttgttcagctaatcaaacatactgctacatgcacttgtgtgatcactctgtactctatactctgtactctgtactctgtacatgcatttgacgggtttttcatgtactgttttatgcatggtgcattcatacttctgcttatgtctgttggctattctctctggacttcttgttttgccatgtgattatcaatctctattcagtcagtgatagtaaaatgttctttttagttcgatatgctgtataagataactttcctctgttcatacaactgctattgaattgttactttgacaaaggattgtaactacaatactattttcaggactacaggaaaagaaaggagcctgatgttgaaaagcaaaaggaaccaattttagaacacgtcacatcggcattagtta

SEQ ID NO: 92781 - DNA, 782 bp, Oryza sativa
ttttttgggcagcaaaaggcgcatgtatatgggctgccagtccacacaatcgaagtgtcttactgggcctaatgcttatggcctcaaaacataagaaaatatcagaataagtccacctttaaaagtgacccgaatctaattcataaccctaaactgcaaaatctaattcataaccctaaactgtaaaaccggatgtcttgaccacccaaactgttgaaaccggtgcaatttgactcctttggtggttttggagggcggtttcgctgacgtggcgctgacatggcggtgttgacctagtatgtttagttaacgtggcgcttaggtggtatttgaattaaaaacatatacgtgggatccgtgtcattcacacacattaaaaaattgtgggacacactgacatgtggccccacatgtcatcatctctttcttcttccccaacatgatctcgtagttcttggtctgtgaagatgcgttgttgggtgctctattttcccatcgaggacgaacctcaatctgtgctcgagagatagctctccatacactgataagggatgtatggattcttgagaagagaggagccgtagtgcccccggaccgcccggaacccacgagtgaatagaaagttagatctacatgggatctcacctgaattgccccatctatcctcctgaggagaagtttgtttggtttcaaactccgattcaaacaggaggagtacgccatgctaatgtgccttggatgatccacatcttcgtgtcaggcgctgatgagcacattgaact

SEQ ID NO: 92782 - DNA, 1043 bp, Oryza sativa
gtcaacatacaagcacaaaataactccctcacccccaccatggcgatagtacacacatttatctgcctcattgactgcaaagcctgcagatgtcaatattgggtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggttgacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttaccggtcctttgtctcttactccttggaggagcttcactgacatcctcctcagagacaagttcatgtgtatgttcagtttgttctggtggtgtgattgaactgggaattatttcacagggttggttccaaccactatgtgtatccttcattgggaaaaagctctcaaagaaggtagcatcaccagactccataattgtaccaacatgcatgtccggtccctccgatttaactattataaatctataggcaatgatatgatgagcctatcccagaaaaacacagtccacagtcttaggtccaagtttgcgcttcttcgttattgggaccttgactttcgccaagcacccccatgtgccccaataagaaagtgatggttctctaccaatccatatcttatatg

SEQ ID NO: 92783 - DNA, 699 bp, Oryza sativa
cagaagcatgtgacccattccccattaggacggtggaaccccgtgcgacttgataagaagaaaacaatgagatgtcagcacaaacatgtacattggccccagtatcaacccaccaattagtagattgattaactgaaaaaacagtaggtaaattaccatacctgcttccatctccagtgttgccaatggtcacattagcagacttagaagtctaccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggccgtcacccattttgtagtcatgaaactgctccatga

SEQ ID NO: 92784 - DNA, 1269 bp, Oryza sativa
ttattctaactaaatctatcctctactttgtttgcgagttattcataacaagggaattttggttcaagttttgttggtactaacacatgtaccatggttttgctcaacacaattgcacattcgccaataatcatgttgataataatgaatcaaatgcttgcacatttgttttggcagtatatgacaaatcagagaacaagaattctgatttcatactgttcacacagaatgaaatattgaggagccgctacacttttttttttttgctaaagaatggcacgtggttaaaaattgttggcctatgacatgtgatgcattatgttagtgttttgtggcaagccaatcgtgtgataacaagccaaacactaggctaagttggtaaacctccttaccaaagatgtggtaaagtgtggctaccaaccaaacacctgtgtactccagtaaaccgaacagctgaccacatttatctagattctagaaacaactaaacaatatttactctgaattccaaatgttccgtgagattgaggaaaatgatttcgagacagatccatgtcctggcattagaaatcatttgattgggctgatgctaaagaccaaaaacattttccttgcatgatgtaggtgtggccatcaattttgtcaaaaaggaagacatccgtatcctgagagatatcgagcagtactacagcacgcagattgatgaaatgccaatgaatgttgctgatctaatttgagtgctggagtggcgctaccatgtttgatcatctggtctggcaacaactgagcttgtttgttgtgattttggttgacatgctttgccgtgactgtattgctatggactttaaagggttgcgagtctaatactagtgattggtttcgttcccctctcttgtgacatgatctgtatataattttagtgccagctcatgtaacactatgattgcatttctgctcagaacatgagacttgttcgttatatttattgccacaaggatttgatgatgattttctcgttgaaggtgtggtggtatttagatcttctgtgtgttgtgatctcaaatgtttttgtcaaagtgtttcatttgctccagttcttgaaagctttgtaatgtcatgctcgatgttgcgattatactggtaaatgggtttattgcacatttgcacccgtaggtaggtaggtaggtattcgttgaagtaagtaaacattattatgcgtttttacgagcttttgtatgaatcattagatagccaaaaaatggggctcga

SEQ ID NO: 92785 - DNA, 725 bp, Oryza sativa
aaatcaccccatagtaatcttggagatctgttaaacactagacctctctaaagcccagggagcctcgtaagcacaaatggtaccttaatttgcttatttaacaaagtaacacatattaatctgaagcgctagaaaaaaaaaatcaccagggcaggatcaacttaacatttccatgcatatttcgtcaaaagagtggcacagtaccctcacgcgcatttcatcaaacaggtcagcgcacgcaaacagaaaaccccagcaacgaaatgcacatatgactcaaacaccagactcacttgtacataacgtcgaacatctcgtcagtgaggctgcggaggttgtcatcgaaggtattgatgcgcttgttgcgagcccgtaggattgggtcggggtacttcacgaccttgagcggcggctcgaactggaggtcagcagctgcatcgtgcacacacaccaccagaagcagcagaacaaaccgggtgagaagcactacaaggcacctctgagcagaataacgcgccgtgaaggcggcggccacgacggcggctaacctgtggcgaagtcctcgtcctcggccggcggcgcggtgacgacggcggaaccgaagccgtggcggagaggcgcgaccgagcccgtgcgggagagtggcagacccgcggaggcgggggccgaggctgaagtgaaggcgagcggccatggtggtggaggactgggcgagtcgccgattt

SEQ ID NO: 92786 - DNA, 2802 bp, Oryza sativa
taattgcgccatgattgacaatgtggggctacagtaaacatttgctaatgacagattaaatagttttaataaatttgtcaaaaagtttcccaacagaatttgtaatttgttttattattagactacgtttaatacttcaaatctgtatccgtatatccaatgtgacaaccaattctaaaaattttccccaactaaacaaagaccttactttcagaatcaatgctatcgcaagttgacatctgtgtaacttaagagtgtttggataatgagaaatagagggtgggattgggattgggaaatgaatgaagggttaggattaaatgaaagagggagaatgaatggttaggatttaaagatgtcttttgatgggtgggaaatcatttccaatttccattagccaaacattgcctaagtgtttgatgcccaaactgtcctcaatacgaggttgtgtggttgaactgagctgtagtcattttcagtaccatgttcgatctccattgaacttaaccaaaaagcaaactgagacacagacacagagagtaaaaagtcaatcgaccaatgaactttgttgtttgcatcctggagcaccaatttctactggcacaaattctacatcatcgccagcttctacagcaatacaaacctgaaccccaaaaaaaagcaaaaggaagacaacaataaatgtctactggcagatttcacttggcgcgagttcttcagcagtttgaccatcgctaaccccctttccttttcttttcttctatctcttcttgtgatgttagttcagaaatctctttttcaatagccttcatttgtcgaagaacattggctccaaagtcatgagctgcttccttgatatgctgcaatgtataagcaatttgttatgtagcagctaatagaatggatcagggaaggcaagggaatgttgattagaacacaaaaccactcatctacaagcaataacatgcttagtgacattaaaaggtatagatgcccaatatgaaaagcaacgaatgtaaaaagcatttccaagttttcatttcagaaagcaacaatttcaatatactttgaaaagtcattacaaatatagctggaagcaactattggtttgaagagaaaaaactatgctgagtaatgttgcatgctctggtttgcatgtaaaaaggtctgaattacttacttcatacaacttaatcttgcattctagctcagcccttttagcttcaattttcacagtccggtctacttcaactttttcaactctgaatgatgtatttctaacaggttttgcttttggattcactgctaactcagacctgtaacaaagagaccattttaaatataatctagcgcaatcaaatgaaataagcttaaacatttttttttagttaccaatctatgcaactatctgaaagcgatcggcggtgctgagatcttgaatgcccaaccgtacttctattttcatcactatggaaagagttgaaataattagactgaattgctcatttcaacaattaattacgcatgaaaacacagcaattaccccatatcaatcttttgaggaggaagatacttcatatcaatcttttgaggaggaagattaattgttttctcaaacaatgtgttgtgaactgatacgcctactataccttgctgtctcaaaaatatcaaatgactcttcaatgttgccctactgagatttcatggaagaaatatatcagataaagtgctgacttactgaaattcatcacaatttattgagttaacttacatgttatctgtcatggtctctatctcaagccttttctgtaataaggatgttccgaaacccatctcaggaagttttaaaaattctttgtaaccctgtgaaacaattcaaacgaactgttagttcttcaagagttagttaaattgaaatttcaataaaatttatagcacaccagtttgttgatgtagcgcctgaaatcacgttcttctgttgcagctttgaaaatcccttctttggatacctaaaacacaacaggccatactcaaaaaaccagaacgcttcattttaacaaggaggcaaacaaaacaatctataacaaatcagatcttcatttagttagttgtgaggggaggaaaggaagctctgatgttttcatgcaagatactgacacaaaaagttatggaaacatagcatatacatggatattttttagggcccttgcccaacctaccagatgccttgagcttaagcaacacctttaacaaccattgatatttttaataaatgctggaaacggttctaacctgtttttcatatattctttcctcaatagtacacgaggttataagcctatagatgatgacattcttctcctgtccaattctgtacactctatcaacgcattgattatccaggctgtaaacaataaatatattaaataagtagtttcagcaaaaacaataatatggaatataaggataaaccgaatacctcggattccaagatggatcagcgatgataactctggaagcattagttaaatttagacctataccacccacttttgtggtcattaaaaatatgggaggcccatctttactttgaaagccctaaaaagattaaaaataaataaatagcatgcaacatataaagtaattttagtcacctgatttgttttaaaatttcagtcacatttgccatctcttccaaacatactcatatatgaaccaagcagaaagaaaagcaatacacttaagaagaaaatcaattctgcactggcagttgcataacaggctcgtttgcccctaatttgt

SEQ ID NO: 92787 - DNA, 2392 bp, Oryza sativa
acctttttaaagttcttcctggcttctgcgaatctctgttcatgcaaggttcccttctgtgcaagatgtgataaactatcaaagtcttgagacgagaatttctccctgatcggagctatcataccctgaaaagccaaatcggccaactgggcatcaagtccaaactcaacctggaacatttatttctcatctttctgaccctctgaatgaccccatgcccaggctcatcatgccttggcttaaacgttgttaaatcagataatttcatctgatgaatccccctgtggaaatagctatgaaaatgcttctccaaatcggcccaactgttgattgatccacatggcaaagaagaaaatcaagtgaaagccgatctagacaagccaatgggaccaacctaaccctcaaggcatccacagccgatgcttcaccacactgagctaagaatcggctaacgtgttcataggttgaaatgctatcttgccctgagaactttgaaaagtctggaaccttgaatcggtcaggcaaaggaaccctctcaaaccactggggtaaggatgccgatacaaatttccagcatctttgggcttaagcccgaactattctctcattacatctgcgatcatatcggcccatggtcgttgctgaggtgctccttgtgcttgttgcggcacaggctcgaactgattgtattgaggaacaaactggggctgagccgatcctccctgctgatattgaacttgtggcgatggaggctgatactgataattcaaattgcccccctggtaatttgaaagtttggctgaatattgcgcaccaaatgttcgggaacaacttgaggtaccaccgtttgatctggttgcacatgatgaaccaaatgttctgggacgactctacagcgtgctgcctttgctgattgtcaagtgttccaaacccagccgacgcattcatcaaaccacaacctgccgccttggtggcgtctgttgaatcggctgcacaacctgctgccttggtggtgtttgctgaatcggctgctgctggattgggtcaacagtaggttgaggtggtaagaacatagctgtaacctgatcttgcgttagccgattcacattctgtccactatgctgtagttgctctctcaccaacaactgaggattaactaattgacttagtgccgataatggtgcagcaggtgcgggagccgatactggtaccgtcggctgaaccgatggtgcatgaggaggaattgactgaacagctggctgattatcagtgattaagggccgataattcgggaagacacctcctggcaaataaaccggtcctgtagctttatattcagctatcgagccatcaaccatcgacttcaccatgtttgacaaagtgttaactaatatcccagattgattgatcaaagcatgttgcacggcatagtcaacctgatcctggaagttgttaaactgtagctgtaccgtgttgccatcttgattaagatttccaccttgaaatccctgagaaccatcaccttaaattccttgagaaccaacaccttgaaccccttgagagccatcaccttgaactccttgagaaccaactgtagcacctttatcacttggttgagctgcaccatctggagcttgttgtacctctctatccttggaagaacctgttctgggaacatcagcaattacttttactttatacttctgaacaattgttcccttgcgggtctgcatgaacgagttcaagaattggttacatgcttgttgcatcattgcttcaagatccttctgctgcttaggtgtcaagttgtccagagtgatggtcacgatgtcgccttcatcaacctcagataaaccaagcttctggatcttagatttaacagagccatctttaccagctgaagccggcgatgctggtggtttctcatccatgaggaaacgtcgttgtgatgctgacttgtaatcagtcccaccgggcgtgccaaaagcgtgttgatatgaaaacacggggcttgggagatctgcttaactccagtgcaggtccaaaactcgccttcgggtatgctagcgtgccagttgatttgatcctgcaatcaacaagaaacaaatacaaagaatccgtggttaaatccataaacgatagccgatcggtcaggtgccgatgacgtatcatttatctttgagccgatgtcatatatacatcgatcggcaatcattaataagtaagaaagagataaatttacttgatcggctgtagatattaatgatatataatctctatgtcgatatatacttaaaatcaagtgactgggatagatcggtcgccatgccgagacagtataaatcactttcatcgaaatatatactaaccaccagattatatatgctcatag

SEQ ID NO: 92788 - DNA, 6974 bp, Oryza sativa
  unsure (1)..(6974): unsure at all n locations
atttgcatggagagtatcagataatcaataaatgtctcactgtgatggcctggtgttattccaagctgacaccaagttgtatgtgatcaacctgaccacaagtgatgttcttaggttgcctgacaaccaagagtctgatacgctgaggcaggcaactgggctgggtcttgaccctcgcaccaacatgtacaaggttgctcgatacttctaccgttctgtagaccatactattgggacttatgatgcagctatggaagtgttctcaattggtcaggatgccttctggagggagacatcagaggttccaccatacccagttcgctctatggaaagtcccattcactccaagggatatcttttttggaatatcgatgagaggttcctcaaaggacaatcacgtggtttcctttgcttcagcttagaagatgaaacatttagtcttatcccccatccctgcccatatttgccattgaaccatggaacatcactcgtatcagagctagacggggagttatgcgtaggtttattcatatcaggtcaacaacagttatggatgtacaatggcaatcagtgggatcagcgcttcagcattaacgtacccgggccaaatgacttgtacattccattagatattcttcctcatgatcaattacttcttcaaaggggtccacatctgtaccaccacaaccaccagtcaagtgaagacataaaagaagtggcacgcatggatcaactcaactaccagagtcccccgggagaaccctacgtctacatggtgattccctacatggaaagccttgtccgagttacatgtaacatgtagaggagctgatataacataatcatgtaataatatatttggctctgctcaattttgtttgagatatatgaaatcatcatatttatttgtttgttttttatttgttatctcatgaacaaagttgagtttacttttaaaatttttcatggtggtacaatatcatttcttgtaagttctttttaatttacttagtacccctttgatatggaggattgtcatagaaattttgaggatgtaatttttttaaaggaaaatttcctatggagtctgttgattcataggaaagataggacatttttcgtagggttgtattgttatagttaaggcttggggggaaaataagcaagagggtctaacctcttggaaactttcctttgctttgttaatttcctatgatgctatcaaagggtttctcttcatcttttgtacgttttccattcccgtaggacaagaaaaatatgctaattcaatccctacgtctttttttctatcttgcgtttcaaaggggtccttaattggctcccttgtaaatttgttttctgttcattcgtattgctttacaatgacttttcgagtagggtaaactgttttgacagttcagaactggaaggtccacttgtagctgtcagagttacgtggaaccttgtgcttattggacaatgaacactgtataattatccaaaactaggaaaacggatatcaactattattcctcagtgctataattcaggcatacctgactaaaaactttctattcaacctaaaacaggtaaaatgtagcatttgtccatttgatggtcaatcctatgttggtaaaatatagcatttgtccatttgattttttttcctaccattagtgatctaatcatatcttcaccagaactataatagtaattttaattctatgttggtatgtacataaacttggttatcccttggcaactttgcaggatgggaaggtattgcctaatggacctgttgtgatttcacctgatgtttatttccttcattgtaccaggaaggtagcatcatctctccaatatttgcatattcttgatgacgacatcctccactattacccgctggcaaagacgccaaagtcgggcggcgaccgtgtgagcctctgaataatcccaccttgcttagcttgggaggaggaagccattttaaaaggaagagccacccttcccctattggactagtcttttagggagattgggcctttccctaagtgggtgtgccaaagaactgttggggtccggacaaccttaagttattgggcctcggccaaccccacctgggccggattgttatcatttggtatcagagctgggcccctgttaagggagtgggaatgatgaggacatcctccactattacccgctggtaagttattgggcatcggccaaccccacctgggccggattgttatcatttggtatcagagctgtgccgttgttaagggggtgggaatgatgaggatatcctccactattacctgctggcaaagacgctaaagtcaggcggcgaccgtgtgagcctctgaataatcccaccttgcttagcttgggaggaggaagctatcttaaaaggaagagccacccttctcctattgcttgcttagcttgagaggaggaagccatcttaaaaggaagagccacccttctcctattggactagtcttttagggagattgggtctttccctgagtgggtgtccaaagaactgttggggtccgggcaaccttaagttattgagcatcggccaaccccacctgggccggattgttatcatttcttctattatgacctgctgaataatgattagcaatctggtttcactgaactactaggatggtctgtataattggcaaccttaagttattgggcctcggccaaccccacctgggtcggattgttatcatttcttctattatgacttgttgaataatgattagcaatctggtttcactgaactactaggatggtctgtataattcaggctcagcttcgacaaagaaaagtagctaacagtgatcaacaatactgttacttttgtgtactgtaataaaattgttgtttagcatgttgtaatgtttcctttgttcttctcagttatacgaagagcaccacatgagtttaagattgcatgtatggaggtaattctctttaggcagttgtcttatgaggatcgggtttaatactcaatgtgctatgatactatgaaatattatgtgccagtaaaacaagctaattttatttgttagaataagaactatgaggtcttgtttgtatgtgccttttggtttcaattccttagtgaacttaaccgaacaagtccctaataaattatccctcatccgcataccatccctcctatggttaaggagtttgcttattagcttctccatttttaattcttgtatggcatcataccccatatccctcagaaatcactataagacntgcaagaattaagaaaagttgttattgtctcgaaattcctttctaacgggtacatgacaatcttagaaacacacattatttagattcttcgagagacctgaaactccatgttggtatcacagcaggttcttgaaattctttaatttttgttcttcggcagggcatgcactcctcccttctgattacaatccattttattctggatttgtcaacagagatacagataagcttagttacaaaaagatgggaattccaaaagggaaaatctttatcatcaacccgaaggtatgtctattacaccagttaaaaagttagtgatcccatgcttgtattgcctttttatagtcatcctgtgtgcgtgaagggggggagtagccataaacagttctgttgaactcctatacctccttacatacccttatccatgatatgttccctccaaacactcttgttgtgcaggttagcttgtcattcttcccttcttgcagtacgtactttttaagtaatgcatgaaaggtcttctctgccgtagcaattactatggccgacgatcaacgtcgtcccaaaataagtgcccctttcgaattcaaaatttcttcccatcttacctctaatcaccctcccactgccaaacgcacatcatttaataatgggcactatattgttttgttcttaaaccttaatctctaccaaacaatctaaaaggggcacttattttgggatgaagtatttactagctatgtgtgtgaacttgctgtccagaatcccaggcaccaatattttttcttgcaaaattgatgtcagttgatctgatgtggatgcatactgcatagttacagaaaggttaccaagttaagtaaccgtgttttctgcacatggataaaaggccacagagaatatatatatgttatgtgtgcaaacttttcatgagattagctagaccgaaaaacatgcacattcatgttttctttttctttggttctttcatactatcctggacaaactatttttatccttagtgcatagtcaactccagttctatgctgcctgagccatacaggttactgctgggagcaaagggcagctagtgtgattgtgttgtactcatggatggtcggactccataacatgtaaatttctttttgtgctgaactgctgatcatcaatgatgacgccatgcagaagactacaattcctggaattactggaagatgccatctccaaatgttgatctgtagtgtagttttaacaaacacagaagtagataccactagattctgcatcagcataacagtcaagttcgtgtacacaaattatcatcgctacgtcggggttctgtccaatctgtaaagcatctcaggagtttccatatttatggttttgatttgatctccaatgcaaaggttgtcattttttttttttttgcttcgacgaagctctcctgatcatacatcttttagggagtgatctgttatactcttcgttgaacttaggccttagcttgttagctttccaagttgtatcagcagctgctagccagcaattttttttttcctttatgtgttcttgtaggcttgtagctgcaactcctctgtgattagattactctggttcatggaagcaacaggcaacccaaaactgtcaaattacgctgtatgttgtacgagagagaacatcgtacatttcctgccccattttcactttcttgtgctgtatgtaaccttcaatgcctgtagctggtaaacgtttcatgtgctctgttatgcacgtagatggattgggtgttcgacaggagggcgaggctatagatggccaaagggcccgcccggcacggcccgcccaggcacggctgggcacggcccagcagccatcgggccggcacggnccggcccatgggctgcacctctcgcccaggcacggtccaacatctgtgtggacgtgccgtgcccgcccgaaggcatgggttggcccatcaggcccttttttaaaaaagtatattattcatccgtcctctttgggctatttcatatgtatggctaaaataaggccattttccgtccctgctctttgggcggacatatgtatagctaaaataagtctattttctgtccctcctcttcggctaacatatgtatagataaaaaagtctattttagatccatattctttcgtccatggcatataatatgtctatttttactcccctattttttttgtgtatcgggcctagctgccggcccatcgtgccgggccggctcggccgagccggccggcccaacatgccggtggaggggcccaggcacggcccggtggtcgggccaggccggcacgggcccaacctccgtcgggccgtgccgtgcttgggccgggccaaaataccgtgccatgggccgggccgttgggcctcgggccttttggtcatctataggcgaggctgctgcagcctcgccgccccggagcctaggtgaggtcaaacatagaagaggggagactagagataggtttaacttctttcttgattaattccacatgattgtgatgcctctacttatatagagccgacccctaacaaacatcctaacaaacttatctaataaagcctaacaaccttatctaatagagggctgctagggtacggtatcccgtccaaacgagatactttatattgatgatgtcacctccgcctcagctttatccactcatgagtccacgacttagcgccaccctacacgctcacgccacagccagtggaagagcacgcgtgaggcgctaggagaaggacacgacacgagtagtggcttaggtggcaaagttggtccctgcaatagcatgatgacccttgtatcaacaccacattgagaagaaaaaggatggtgatagggaaaggaatggaagggagaagacgagacaaaacgctggtggtagatggctcgccacccagccaagaggcaacaacgtacgttctctcccgataccttgatacctcgtacttggtacctatgggttatcggttagtacctataggtattagttggtacccgagacatcaaccatgataccacaggtaccaggtctgaaacctgtaggtatcaaccatgataccgcaggtaccagccctgtgtaggtatcaaccatgataccacaggtaccatgcctggtacttgtaggtaccagctgagccatggtgatatgccgcacgcacaacatacctgcgcacaatgtcgacgagcagccaatgtctgcagcaccacgttgattgtcaatcgaaacttcagatctagcaccttcatttgtttccccttcatcaccactaacagtagcgtgggaggattcacatcgatcaacatcctccccgacgacatgacaccgaggtggaggccacgggggttggtgcgatccatcgcctcatcgctgacatggctcaagcggatccaataatggaaaggccctaggtatctccagatctggtactggcagcgccctccttgactcattgatggtgaggtgggacagagcaggagggtaggtgagcaagagaaaggagcacaacccattttcaggcttccagccaggtaaggaagaagaggggaggaaggagaagggtggtgccggaagaagaggagaggaaggagaagagcggtggcggatgagaggcgtatgggcaactagaagagcgacaaggagattgg

SEQ ID NO: 92789 - DNA, 1787 bp, Oryza sativa
aggttttgcccttggcatttgcttttgttgagagtgagaataccgacagctggtactggttcctgaaattggttaaaacaaaagttgttagtatgaggccaaatgtgtgcctgatacatgataggcacgctggcattctgcgagcgatagaagagttgcagtttgggagtatggaacgaggataccctggtgagtgggaagatgtatagagtaggtggtgcatgcgtcatatgggagctaatttcttcaagcaattcaagaacaagatgtacagagtaggtggtgcatgtgtcatatgcgtcatattgctaagttcattgtacatcacatcgatcgtctcgtattgcagcgccgatgggctcacgtccaggttaggcagtcgtatcctgagtttgttatggagttcgaccgccttctgccgactgacgtcgtgtgggagccctacagtgtcgcggctacccaggctcgtgcgccgttgggtctgtccacactctgtaccagggaccaggcgtactggatgactacggttccgatggtcttcgacatctgcgttgagcctcacgcccctttccgcgtgatgcggcagttcggcttccgtcagccctttccagtaccgtttccgacgaccgtcctagctgctattcactggtaagatctttcactacgctttgagttgttgcattaaaatctacatgtccacacatatttgcaccatctgtcgattcacactaatatgacacattaattcgcaggtactcgcgcaagggtgtcacacctagaaattctcgaaccagaatttctaagctgaatgtgcattaaatccctgtccaggaccagccagggtacacaaacgataattgttgacatacagacccacgtcttacaaatataaaagattacaaatgcagcgggaaggattaaagcgagctaaaccgggaaacttgacttcagcagcggcgactccactccacaggcaatccttgacggcagcgacaaaaccaacctctctgcgacggctccaactgagaagaacttcaactctggtgtgagggaaaagagagcaagactgactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaatcactgtccaacgctacaccgaattgcaacaggcccaactaaccacctgaactacaccagttcattaagctaaactaggggtgagactaatcacggtgaatctggttgatcgcccataaccgcgggcacggctattcgaatagtttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttccgatcaagcagttacccactcccgcttgtggtaagcacggtaagtctcccagggtttcccgtgaaccggtccttaactgccatgggtgcgaccaacaaaaccatgcacccacagcccacca

SEQ ID NO: 92790 - DNA, 4946 bp, Oryza sativa
aaaaggttttacaatgggaaaggttgacaaaacgttttttgttcttaagcatggtgataatcaactatgtcgttcagatttatgtggatgatatcatctttggttgttcgactcacgctttagttgtagattttgctgagactatgcgcagggaatttgagatgagcatgacgggtgagttatcgtactttttgggattgcaaattaagcaaacacctcaaggtacttttgtgcatcaaacgaagtatacgaaggatcttttgagacggttcaagatggagaattgcaagccaatttcaacaccaattggttctacagctgtgttggatcctgatgaagatggtgaagctgttgattaaaaggagtatagaagtatgattggatctttgttgtatctaactgcttctaggccagacatacagtttgctgtgtgtttgtgtgcacgctttcaagcttcacctcgtgcttcacatcgtcaagcggtcaagcgaataatgaggtatttgaatcatacacttgagtttggaatttggtattctacttcatcttctatatgcttaagtggatattccgatgctgattttggaagttgtagaattgataggaaaagtactagtggaacatgtcattttcttggtacatcattgattgcatggtcttctaggaaacaatctagtgttgctcaatcaactgctgaatctgaatatgttgctgctgctagttgttattcacagattctttggcttttatctactttgaaagattatggtcttacttttgagaaagtacctctgttttgtgataatactagtgctatcaatattgctaagaatcctgttcaacactcacgcacaaagcacattgatattcgttttcactttttgagggatcatgttgagaaaggagatgttgaattgcagtttttggatacaaagttgcaaattgctgatattttctctaaacctttggattctaatcgctttgcttttcttagtggtgaattgggcataattcatccttttggcatggtttgagggggagtttgtacctcatggttttatcaagcaataatatgataatgagaaaaaaattgagaaaagagagctttgtttatgcatatggtattttcttgtgcatgctagcaatattttgaaggtttatttgtctctagcatagcttgtatgtattctagtcttttcatgagatttagattttgcttttaagggagatgatgcatgacacttaaattctacttgaattaagcaaatatgctatgttgatgctagcatatggtttgatctataaatgctctatatatatgctttattgacttgttattcctcaaatagctttcattgctcattgtgaaaaagagaataaaaaatatgaaaaaaatgaataccgaatccttggaaacagtcttgacgataaggatgtattcgatgtgagcaaaataatgggtgccgaatccctggaaacagtcttgacggcagggacatacccggaataaaagagaaaaatatgagaaaaaggcttaagaaaagaaaaaaattgaagaaaattctcttggttattttgtgataatggttatttgagaaagagtgattaatgcaataggtaaatgtgtttagtgtttattcttaaacttatgtgcttgttaagatgttgcattataaatcgtatgaaatcatgaattttgattgttgatttaagcttaattataaaatccttggttcatggttatactttaatgcatgcttgttctgttatagatgggttcatcttctttttattgcaacacatgacttgatatgctatatgtaagataagctcttgaacattaatgaacataattcctatgcttgatgaaatcattgtcaaaaggaggagaagtaatgtgcaaatttttggatttttgggagaagcaaggtgaatttttggagagttgttgagaagagcatgttttttgttcaattgggaatttctttcttttaaaaagggggagaagttttcttttggtttttcgagcacgatgtgtacgtttgtacgaagtgtgctttttaccacttttgtttttatttttccaaacaccaaaacattttcgatgggtttgccaatgtgttcatcaagggggagattgtaaaaatcaaaggtgttttttattattattctgtgatgaacaattgggcattggagattattggttttgttatttggaatttattcacgaagtggttttggagatgattggatttacaagtgaatcacaggttctattattttatgtgaccggtcaaaccgggcaggtattcccggtcagcccggcggtatatgcgtggtcagaccggccagcccgcggtctgactggccgacgctgtgtcggtttcggtttcgggttgtttgtttggatatccgtgattgtttcatgattatggcttctagatggatactatacgtatgtaatactgttgtttgctactaatgagtcaagttagagatagcttggtctcagaatatggtttctttgtttatttcatgtgtaggtgactcgatgcctcgggagagtatttgcggtgatggaccgggagtcggcttggggataagacgacgtccgtggtggtcagagatcatgcgggatacttaggctagagttgatgcacgtggttgatggagattccatatggcatacgattgaggtattgtgtgcgtatgggatgcggaatcgaatttggaaggagtccaaatttggtacgattggttatgtaaagtttgtttcttgtactagagggtttcctaaggtgtttaggactcttagtatgagtttggttcgtggctttaggctgcctacctcatgtataaatagagagggagcgtgagacttctcggtatcgctttagagagcaattgagttgagttttgagttagggtttcgagtttagtcgaaatttttgtaaggaatgctgttggtgcactttgtaaacacagagagaatcaacaaagttgtcatctactttaagagttcttcgatttgtgtttcaccgggtttcggcggtctgaccggcggcgcaccagcggtcagactagtggcatcgcggcggtccaaccggcgggcacacagcggtcagaccgtcttcggtgacaggaggcagtgacgagttttggcggttagaccggtagatcaacaccggtcagaccggcggctacgcttcggtcagaccggctaatctactccggtcagatcgatctcatcaaaattgagggtaacttttatttccgctaaaagttttcggtttttgggtataccaaccattcaccccccatttgttggcttatttcttatatttcgatcctacatattagaatgacaataaagctggattacacataggaaattaattcttcagattctaagacaatctgaagaaagaggaaaatgtggtagaaaggacatcacgtcggtttgattgtcaatgaggttcgtccatattgctggaatgctggacgagactgacgacctcgcctctcgtcatgtatcgtcatctctacttgttggcagccatgcaagttatttttcaggttttttttcagttaaaaaaaaaaagtgaactttctgttgttgcacaattgtagtggcttgcgattagaaaatttagaggagtttgaggtcgaattgtcatctcaatgactcaatttcccccctagcgaagcggttgcatgagcggaagcaatcctccttgcttttgaagctcgacattgcgcaggcattcgattccatctcctggcaattcattatagaggttctggaacacaaagggttcagtagccgttggtgtgcttggattgccatgcttttccgaacagcaagcacgcgggtcctgatcaatggcataccagggaaccctatcttgcaccggcgagggctgcgccagggggatccaatctctcccatgctgttcgtcctcgctatggactcgttaagctctcttttctctaaagcagagaatgaagggctgttacagccgctgcacctgccctaccgaacttccctctacgtggacgacgcggtcgttttcattcagtcggatcctgaggaaatcagcacaacaaaggaaatcctacacatctttggggaagcaacagggcttagggcgaatttcgccaagtgtgcagctctcccaattcagtgcaacgacgacaacattgcactgatccaggatgaacttccatgtcaggtcacagcattcccttgcacttatctaggactgcccctttccatcttccgtcttcgcaaagaagacctgcagccgtttgtggacaaggtagcctgtcggttgccggtatggaaggcagagcagatggcgcccattggtcgggtcactatggtaaatgcggtattaagctctataccgatctatctgctgatggccatcaatgtgccaaagtgggtgataaagagaatcgataaggtccatcgcggcttcctctgggcctccggtgccgctgggcttggcaactgaggacatcgccggaaaagccatggcatggactcaacgttccgatctcgcaaaaggagaggaacctgctccaagtctctttgacatgtcgagtcagcaatggaaagaacgtgctcttctgggaagacaactggatccaagggtcgtcaatccgcacccttgcgccggctatgcatgcagcggtcgtagcaagaacgcggaatcgcaggacggttcgcgaagcactccaaggtagaacatggatccgggatatatctgggctttgggaatccaagctatcctagagtacctcagctggtggacatctttgcaatccttggatgccctattggaagagccggtttcaatcatctgcagatgggagtcgttaggagaatactcagctcgctcagcttatcagtccatgtttgtgggaagggtccaattccagga

SEQ ID NO: 92791 - DNA, 1407 bp, Oryza sativa
cagtagttcatcaaagataagaagaacacattattgaaatctatttgtgaatctccaaccataattgataaaaagtgacatgattattgtctcaagcctatcgtatacagccttcataaactcgtcatcttcattataactttgtagctaagcccaatacaggagccgatacgttctgtagagaaacaaaactctcgtttgggtcgctaggagtagtatttggtaacgtgattcggaatttcggaccgtctcgttcgtttggttcctgatttttgtataaaaatgccccttcgtttgctagcgctctgacattacgtcaagtaaggagatgcgagttcgtgtgcaaaactgtttccatctttaatccgtgtgagttctgcaatacaaatatacaattacagctccaggaagccaagcaatggtcaaaaatcaaggtacaacttattgtacgcaacaaatgaagttagaaactaagtttccgaaaccctcttcaagtttccccttcctctagcatcatcggtcagaggggaacaaaattgtagaacaaaaacaattaattccacctataatcttcaaatgaagctgatagtggtccttgtcactctcgagcagcctcagctgacagccgcggcagcaggaactggtggcagatcaatgacaccgtggcaccgggcacaaagagtaggatggtcaaggaaagatccaacgtctcgggtataattccagcacctctcacatttttcgccatcggcgcgagtcacaccaatccagatgttgccggtgcgctcactgctaaaagttccagtgtaggatacaccagatgtagtttcggagcttacggaaggaaggatctccacctgcagaaacaaagaaagatggtgtaaaaaaaaaacttgaatgcagaagggcagcctctagttttgaatttacctcagatgtgataaacaggcggtgcagagcatcagcgtcattggttgccgaaaccagctcctttagtttggacactgtgttagcattttccgcgtggagataaacttttgcctctaagctagagcctatcagctttcctgttcgagcactctccaaattttgtcacctctgatctcaactgttgccaagtaatggaattttttaatcatgaaattaatcttaatacgaaatcataaatgcaagttcgctcatcaccatgaaatcaagaatagccgcaatgtcctataaactataggatcaggtaatttagcagaaatgatgctatttcagatcataagtagtagttactcgtgtatacaagaaatcttgtctgagttgcacgtctccaagttgaaggcagagccttatcttttaacgtaagtttgatattcgacctataggaaaaaaactgcaaagctatataacctatgatgatgg

SEQ ID NO: 92792 - DNA, 681 bp, Oryza sativa
taacgctgaccttgtgagacgtttagacctgacaatatgggaaacgatacaagtgtgaaagagcttgcatcatcatccataatttctgctgccattgcatatattatattcatgataaaaaatggatattgctggctgctgaaagtagagagagagagagagagagagagagagagagagagagagagaccaaagagttctgtaacttccagaagcttcaacacatatggtacttgaagtttaagagaagcgttacctgcatgcagaaatgtgacttccgcatagccatctcatgtgacaacaggcatttatattcttgccaccacagtccgatttttccataagctgatatatgtaaggtgtaacctcctacagttcaacattgatacaaggcccattaagaaagaggaaagggataatgcacagtttgaattctgtacctggaagcatatgaagtctgggttgtgaagttgaataagatctccaagagcgcccagccttctgtgcagttcaatatcctctctgatccagacattgtatgtcatgattttgaaggtcttcttgtttaaattattctcaaatttttctgcatgacaagatttgtattttagtgtggccatagcgaagaagaagaataaaagtacagctttgaaggaaaaataaacttctaattatctagat

SEQ ID NO: 92793 - DNA, 16697 bp, Oryza sativa
gtcgcgcgatgccgagcgcgagtttgagcaccgcggccgcctcggcggtgagagactggtggatggtgtaagcccccgcctgcatcgatccgtagataaccaccaccccccaccccccacaccaatccaacaacaaccagctcgccttctcttctcctcctcgaccacgtcgtcttcctcctctcgccaccaccacctttgcaagctgaggcaagaagctcactgccactgacttcactagttcactactactccttttatcagtttcactcaagcaatgcactagtaatctactactagtaaggctaaggcagctgcatgcatgagtagctagcttgtctttctgcaaatgctttttttctttatctttatagactgcatttgcatggcaatggccaatggcaagattctctctctctctagtttggagaagtaggaagaaggagaggggattgttggtttgtttgtctctttatcgagaggatgtgcgtttcgtcagcctttgctccctcactccggcctcggctactctcccttcaattctcttttcttctgtctcgtgttctcttctgccatagcataccactatgcattgccatggcgatggctttggcatgcatgcggcacgtttcctttgcgaattaggccatgcatcgtcgatcgttcgttttcaattcaacaaacagctgctgctggctgctgctgctgcaaatgctaatgcatgcacaaagtgcagggggtgttcccctcccgttccatccattttgcttctccggttaaggcacgtactcaccctccctatgtaccaaaaaaatggatttctgtaaaatcccaatgcaacggtaataagtagatgaaagtaccaaaatagctagtgatggagccagaatgatttttgagacctagcaaacttcaatataactatagtatttattatcttcttggaatacacaagatgcgcatctttgtattaggagaaataaagagtatttacaaatggagccaaacaagaaaaaaggagggggacgggaagataggagaaggaccaacaaacttaagcctattctcgcgccaatataaggaaacgatttaaagcaagacctaaatggttagcaccggcagcgccgtgtgtgccaaccgccagagagttgcttccgccggagagttataacaaatataactagtatttgttatagaaatttcattatcaatttacttatcaatattaacatttaatggaattttcggcggcgagcactggcgattgcccgagctagctgggcggtggcttcgccacttaaagtatcccttatcctatcttattataaagttagaacctactgaatcctaaaactcaacgtgcaaagatgacacatcatcgttcactaacaattattacatcttaaatatcttgcaagcatgctatattatctataattctattctataatttattaacttttagagctttaaaatacaagcatgttaaatcataacccacataattcacataatatttcaatatatctctccatcatttttataatatcctatatacctgtatattttatcctcacttagttaatattatttctctcttctatcattaatccatattacatcatttgtttttagccattggatgactaatctatagttcaaatatcttcatcctttcttctctcattaacatatatttccccaattgtttttagcccttcttttcttctctcataaagccacatcaccttacttttacatttgaatcatcattctatatactatttaaatgatcataaaccacatcaacttatttaagcttagttcgtctagctatttacacattatttctacctattgttatcatactaaatttctacagcaatgcgcgaggttttacctagttaataaaaaagttatattgaatggtgagttggtaggggtatttaagggatgatttttttatttcgtgcgccaaaagtaggtatggatgttgaatttaattctttttggacaaggttcaaattctagagttaatttatttttgaccaaggtagggagtacaaaataatagcaacattgtttaaaaaaagggtatccctttgccgtggctgagtttaggaataaactcttttaacttcttttaaccgagaaatcaactctaggttaagtataaaactaggcattttaaaccccacctatatacatccctatacaaaaccattttggcaaataatccttttgactttataggtggtataaaagagaatctaccattgcagtaagctaaggtagcccacgtcatacgtatcatctatgaaaacttattctagaggcgattgctattagtgacggcctctacaaattagctttccaaaggctgtcattattagtaactacgtctacaatgtccctctcttgcttctctattatcaatccctctcgagtctgtatctctctggccttgtacactctctatgccttcctctctaatgtcagggaacctccactattctctctcgctccttgttggctcaccctttattagtgttctctctctcaccagatccatgcttttctctcactgcagcttgggacacggcactgccggatcagatggagggaagagggatgtatgtgtgtgtgggggtgtgtggggtggggggggggggtggtcatcgaatccttatgagaagcatgtgagggtggcagtgctagaacaatggttatgagctaacgtctaccccatccctcttccttgtctacgctgcgatgggagatggagtaggagggcaacaacctcgactcttcgatcccctaccttgtgttggcagtagtggtggcgattgtcggatctggtcttctctttcaagctaagtcttaatttattcctcctctctatattatcctatctcttagccttttctcctaaatagatcgggaggccgactggaatccacatgaactcatccacggcggtgggggtagatccacatgagctcatccacacggtggcaaagtggatcaatgcaagcttgtccccggtggtggcggaccatggcaagcctgtccacagtggtggcgggcgaatcgagcccatccatgatgggagtggtgatgccctagcagcaatagagtacgagtgagtttcttttaggttatagaatgattaccacgagcggacctcttataagaaattaaacataatttagcagcctgtgaaagtaactgtttgagtagtcagtaatgtataacattctattataaaagatgtataaaatagttccatgtcagtaagaattagattacttacatatcgaaagaaaagtgccattaaaaaccagattggattgaccttaattaatactccctccgtttcaggttataagttgttttgactttggtcaaagtaaaattgcttcaagtttgaccaagtttgtagaaaaaaatagtaacattttcaacccaagacaaatttattatgaaaatatattcaattattgatttgataaaactaatttagttttataaatattattatatttatctataaacttagttaagcttaaaactgttttactttgaccaaagtcaaaatgacatataacctgaaaaggagggagtatgtacttaatggacatggttgttaagggttttattccggttttattggtgaaaatcggtttctaaagttggacatacggtgattgacattggaaatactactggaataataatccgaaatacatgtgaagatcgttataattaaaaggtattcttaaaacatgggaaatacaatcattaatttttcagcctttaggtcaagcaaagctcgtgctagcttgacctatcaacgatgggattttctacttcgtttgacccaactttgaacactcagagtgcatccactcaatgccagactcccttatctatcacaatgtccatacgaccgtataggagtttatttatttatttatttttgaaaactatatgctccatcggtttgtcgtcaagcaaactatcaacaaaaaccaatggaaaaaatagaaaatatgtaatgatgacaaaatttggttatccatttttatacttttttgtaaaaaggatgaatagaaattaagtactaaattaatatatactataatagacatatattctacattttttttggaaattaataaataatacatatttgggggagttcctagtcattattaaccaaacacataccgaattatttctatcattgaagtggtatttcaccatccgtctatatatgcggccaattttgacgaaaattaaactgcacgagctctcgtatacaagactgtcgttatatacctagttcgatacagttacaaagttgcatgcctaatctttgttgggagtacttgaatgcatattctctttttcttctttttagtaaaaagaagagcagcgcgtgataaggtgatcagaactttaagcgccagaaattagatggcctttgtgtttcagggtgtgctctttattcaaatacatgcactaatatatttgtacaattctttattttgaaaaaaggaacttttttgtagcggcttttgtgtttgcagttttttctcactttcttggtagggcaaagctaatagaccctgaccttggaaaaatgctggtcagtatctattttctgggccttttttaacattataaaataagttaactaggtatgtatacttataagttgcaaagtgggaacaaataaattcgggagtggtttctataattgcctggtacaggaaacgtttatacatgcgtctaatatctagttttcaaaggcgtttagcgagcctatgtaattcagcttatgtagaaatcggttattccacatgcgtaaaatagctctcgtgaaaaactatttacgcaagcgatattttaaggaccgcctgcgtaaatgggtcgtcgacatataggtgacctataacatgaggcagccctaaatttaagctccctatatatggaaaagaagcacaatatacatataggtgtttttctcatgcatattaactctttaggagttaaattggttttatgcttaattaataatgaaaaatccattctctttaaaaaataatttgacatgcttctcgtaaaattcctagtcagcctttcttctcgtttatttctactaagaattgtacaatagtacatcttgattttatttttctatttttattatcacacaatctatttaatttatggagagagccagccatttttctgctgcattttattaccttgatcacaaccgttagctaggaaagatgtcgctcattttgatgctaattaacacgtttcgacaaagccctagccgatgacgaatagagtaatgtatgcccaatgtcgtactagcagtagactgatcgaagccgtcattagcatcaaggtagccttttaatttggttcagacattctgcctttttgaggcttttgctaagggatattcagaaatcgagctgggctggctgggcgtgagagctaaagctgtactgtcactcaatttccaaaggttgccgaatttgacgttgtaatggaatgtctctttttgttcccctcgaaagcacaacaagctcactaattaaggagctggtggtatggtttagtgtgtaagtggcagacatcggacaatggtgagattgtacaagataaacttaggacagcacacctcatagtcatccatgaatgacttatggcctgatcttaaacaataaataaattaatactccatccaaatatcttagacgtatttttttaacttcttctcttaacatgttttgaatgcatggatgcatggagactataaatacaactatcttatttgaaaaaaactagaaaataaaatataattaaaactttttggatggagggagtaataacaacaacaacaataacaatacctaagctgtttagatgccactttcagaaaccactactggagaactaatatttcattgtggtactcaaaatcacaaatatctcggctagattaagaaccggtacaaaatcagatgtgtgttgtaggtaggatcataacgtgcgtgagaggtaagctgagagatcttgagttcaattcccacatcctacaaatctttttgacttggtatgttatctttagtaccggtactaaagatcgaaatttttagttccgatttacttgtcactgtttctacaaccggtattaaaggggtttctaaccggtattaaaaatcgtttcttcactagtgaacgtactattttgttctccaggtgaatgttgtttcattttaagacagttataaggtattggcttactctaaaaaactaaaaaaaaaccaaaaacatcatttaattttttttgcccggcctaaagttttttaaaagttcaacaatatcatgtattattatagatatcaacgacatatagtccataagattaataagaggatcatacatacagatgatatagcacattcaacacaccaattagtaaccaaccaagcaatctcatgataagagcgaacataagagcaagtttaatagcatagccaactactagctccaaattatctatatccaatataatagccaattcatacaatagttgcttactatactattaatacctgatcccacctgtcatatgcacgttacgtcttggagtccatgctgcagctggctatagatctgtagcccgctgctcttctctctctttttttatctctttaaaatatgtttatagctagcttatagtctgctattgtacctactctaatgttctctttcctaatatcatgaaaccaaaatttccctccatatggttccatggccatcctaaacgtacatcggcgatccaacgaccaaaaacaattctttcgacgtgtcagctcctccttggagatctctctctatagtgcacgtaaaatggcatcaaataaaggcaaaagaaaaagaaggaaagtacctagggttaagtgcacggatgcctttctagcagatcgaaaggggcgagaaaaaagcaaaagaaaagtggagtttattccggtgcttaagccactcctcgccttttctccaagctcccttcccaaagatatgagcagagaaaaagaatctctcgtttgtcactgcagcgatcgatgctttgctgcagtagtagtgcagctatagctattgtgtcattgtgtgtgagtgcctgcactgcattgcatgccttagcttccttttctctcagtattacttgctttggttgtgagagtgtgtgtgtgaatggctatgtaaagactcaaactaatcatgatgatgagcaggcacttagtttaataaagcatggtgtactcatctccacccctgtgtcttaacatgatcaggaaaggttttcctggcatgctgtgtatagctgctttctactaggtgtgcatgcaggtaggattgctgctctatctggttttatattttgctgatgtgttaaatgtggatatgtgaggagagtatatttttgctgatgtgttaaatgcgctagaggtagctataatatgagacggaggtagtggtaggtgttgaaaaatattatcttcaaaagtaagactccaatatttggtagaccaacctaatttatttatgctcctaaatatatgctgttacaaacttttctgcaaattaaactattggatcactactacagaatccctaataggggatggcttgtagataccggttcatttaaaaccggtacctattgacttttcccaccttcgtgggataaaaaaatatagaaccgtcatttaagcaactatagatatcagttataaataaaaaccagcaccagtaatatattataagtgctggtaattaaaaaaaccagtacctataatatattatatgtgttcttttataaaaaaaataacatccatgaaaccgagcagagtcaggattcttggcctccctgtttagcgcaaaggaagagggagccaagtggtccttatccacttcgcccccttcacctccctctcttcactcatctcgccaccttcacctccctctctatctcgcccatcttgccacttcacccgcccccttcgcctttcctccagcctcctctccggcgctatccccacccccactctggtgcctccctctattcccctcctccctcttcgtagctgtgggcggctttgccggttgcgacgacgggcggattcagcggcaaggaattatctcgtgggtagatccgacggtgtcagcagctcttgtgggcaaatctggtggtggctgcttatgccaaaggcagatctgacggtggtggcggcaactcccacgagcatatctggcggtggtggcgtttcccacgagcgaatccagcgacagcggcgatgtctctcctcctctctcccacaccgcgaccgcaaccagtcctcgtccctcctctccgccgcttgtggcgtcgtggtgtccaccccctcgatggtggtgactcctgcggatctggcagcgacaaccttggtgtccaaattagcaatttgtgctatgtgaaattgttggatattcagttaaaattttgggtgtttatgatgtgttgttggatggatcgatggtgatttgtgttgtgtgctttagggatgttgttggatcaatggtggtctgggtgtgatgggaaccggctcgatgcatcggctcgtgcattcgtggaacatcaaaggtgttcctccttattagtgcctcctccgtgttgccagtttggaaatctggcatctatcggggtttctcaactggcacaccaatggtgttttctgtagtagtggatcaattaaaagttgtgataacgatgactccatttatcatcacttgtaccacatttcaaaaagttgtgatatttattcatggcagtggtagtgttaagaacaaggaaaatgaacaaaatagaaacaagcctcgaatttttagatgagttattattattactattatgatggaaaacttcatatgacttatactaattatgaaataattaaaaagctaagatggcatgtgttgattctctagatcggcaataaaatttatagggtgtacaagattaaggagagatggtgacacagatggttatactggttcatgccctcggcagaggtaatacccttctccagttgtatgtagattagatctgtatcagtatatgcacaacacaacatgtgaatatatcgtagcgcctaagaaaatccccgcattagggtttccggctccgcctatatagacatgggggcgatcggctaaggttagtaggttatcccttataatccaggtattgccacctaattacatggaataacatcaattgccttatcgagccacacacgcactacatggacttaggcctacctggcccatctcatgctatgcgacccaaaggcccaaccatagatactcggataccatgtcccgcacagcatgcattcgaaatcggagagaatatgtttgtgtgaacaatgtagttcttcttggtaatattatgtgcaaaaatatgttaagcgactcatgtcgggcttgagtcttggcgggtgatctcgctcaagcttcgctcattaatagcactaggtagtagtgtgtgtgggtgatcattcatacaaatgtaggcatgctctcaaatatcaaaacaatgggcattatttaattcaataaccttaaatttaatcaactgaaataggataggatattattttggcatagacatccgatatttgatgggttatatattattttttatccttttagaggtagaaagaggaactacaaaaaaatatgttttatggtgcttggagggtgttggtatttcttaacgacattactagaaatataattctcagcaaaggcgcagaaatattcctagtatattatggttacagatatgatctacaagcgcacagatataccattgtagctttttacccggaagtattccagtgtatcgtatttatttaatcccaagggaagattgataagagaagactatgctaataatttatatgttattgtagtcagagtctaagcaggggttaactaattcaagggtggagtgacacgaagaagaagaactaagttcgctcattaaataaatcataggctatgtggagaaagaataagaaaagaatttatcctaatacttctaatatacaagtatatttaatttacactctctagtatacaatcatacagccaataccccctaactatgccttcctggtgtttcgagagaccaccccttaccgagttccttacaacatgatatttttagtatgttcacattagttggctaaaaaccacgagggcatatctggtgaaaactagctaagtgttggaaacacgtcaaaatcataccgaaaagttttgtaaattcatggaaaaaatattagagataggtgtagatattaaatatattttcaccaaatctcaaatcaaactcaactttctttaagaaaaaagacaaattttggttgaatagtgtcatgttactattcatcttaaatttatcgttttttttactcctaaatgaaattgagtttgaacttgagattatttggtgaggatgtatctcatatgtacacctatctttagtaatttttttcataaatgtgaaaaaattttaggtataattttcacaagtttctatcacttagctcgttttcaccggctatatccgcaaaaaccacgcatcatccaccttgtgtactttgtcttcttccttactctctaaaaaaagcaagataactccacaagcgatgacacacattatcggtttacttatacatataaacaattaaccattctaccaataactgagctcgttaaagtgagcctaacatgtatactcaggaatatctcatattatttttttataattattacacataattaatattagccaaaaacgactatataaacttaaacatgggttaattttttagaacatttcccttatttggaacaaatctggatatctgtggttttacattacgggtgccccaatgcaaaacccgagaaacccgctaggttttgtgaaattttctacttattaagttatatcacgaggttgccacgaaatttagaatgcctagctagctcctgtaattaaatgatttgatgcctctgaatgaataataaaattgtacaaaattttggtacctccgaatttaaaattttaataacatgatagaaacaaaaaaaaaacttgtaatgaagctctactaagcagcatttaaggataggtcataggtgtgcttgcatttgcaacgactcagccgaaaccacggaaagcaaagctggactttgccctttttcacggcaaaagtgcaagactcctgactcctgatcattctttttgccaaagcaaagagatacctttagtttgttgtatctacaacacaatatctatttatttactaaatgtcagttatataatgtcctggaggcacatcattgttgtaggttaggcttagtacgtacttaaattaatttcttcaaagggtttacatgttgacatcaaccaacaggtgattctaatgaaatttattgtatttttccttcagactcttcagctgcagccaaattacaccacatgcataattaatagccaatattaataaagaacccacgtagtgctgacgagagacagatggacgttttggcatcaaaatgttcgaagtttcttgtgagtggagagaataataaaggcaaatatggaataaatgagagtaggaatgtggttaattagttgttataattatatttttcctaatttggaatgcaaaaattctggccaatgttacctaacaatggaactctgccctcggtttaattatttggagtggttgtagttcaaagagagaaaaacgcattatctaatgcagtcaccacagaagtcattttgaatagcatagtatgaaaaaaaagtagtattatccatattaattacttattcaaggaaaatgacaacttaattgtactcatttttatctccacaataatttgctcacaggatcaacttgctccaagtttatcaatttaatgagaggtgcattgctaaatgtggaataaatcacaagttgaacaagcgaataacattatgactttggaattatcctggaaaaaatgatgtaaaatcctgaagagatccaggactactcagtgccttcaggcactagctacactagctattaaactaatgcaacatatatactatatgttttgcactgttggccgaataatacatgcatcatttcagcataatggctgctataggtgtgtgcaagatctacatgtccatgctagcaaaggacagcagatgagccagcatgcaataataaaatgtggctataaatcatgaatcttccaaataccatggcatctgtcttgcttttcattctttgtccccccttttctacactctgtgtatcctagttagcttttttgaccagtttcttttcttaaaaagcagtgaaagtgtactcatatgttgctttcctttacacttttaagcaagatggctcatattggagcatagccagttgcatggtataggtagagagtagctgcatgcatgagttgttttagttgaatccagtcaacagcctttcccactgagcccaaatagtggcactcccacaagaggtgaagcaagtaattctctctgctgtttctcatagtagtagcttcatagggttagggcatttgtgatttgtgtacatgcttctagttagtgtaaggccctgtttctttgagggtctaaaaaagaagtccctccactttaagtcactttaagtctgtagagtcccaaacaggagggactaaaaagggactaaagtgctttagtccataagtccctaagggaggagtttattgggactaaagtagcttttttccacctgctgccctcatgcatggacatggtgcatttctctttgcatagttttagaggtaacatggtcattgtgcagcgcatttaataaactttagtcccttttagtccctataaccaaacaatcatagactaaagtgattagtcctaagactgaaataagtccctaggacttatggatccaaacaccacctaagctatggaatagcacactgccttaattaagtagttaggttacattatattaccgctttgtttcatatataggtttgttaattagctgctctgatctgaagtaggaatgacgcttagaaggttctgagaatggtcttgatggagggtagatgcaggtggtaggctactgtgctgttggcacacctcgaacagttgaggccgagtttacttacaaactttttcttcaaacttccaacttttccatcacatcaaaactttcctacacacgtaaacttccaacttttccatcattacatcgttctattttcaaccaaatttctaattttggcgtaaattaaacacaccctgagtagagatacacaaagaagacgacaagaatgttacatggccattaattctactttatctttgtaattatataaagagcaaaaattatacacttgcagtgtttgaacttgtagcgttattaatcctggccctagactttgaaaatgatctagctagcctcataatgtactcaattaatatacccatcacaagttcaaaagtcttacggtcccctccaactgcttacatggctgctactctagtctactaagtagaggaggagattgtgggcatcaggtctgcgccgggcttaggcggtgtagtggggttaacactagctgtgagtgcatgagtgggagagataagagcaagtttaatagtatagtcaactactagctccaattcatctatagtcaatctaatagctcatccatacaatagttacatactacactattaatacctggtcccacttgtcacacactgcgttggagtcagtgctacagctggctacaaatatgtagcccgctgctcttttctctccttatttatctccttaaaatatgtttgtagctggcttatagcttgctattgtacctgctctaagggaagtagagaaattaaaggagatgagagatgtgagaggtctactctcaaaataaatccatcttcacttattccacacatatcaataaaaccaaaaagactcgaatccccttactttaacaaattataatgtaattattttccattttatctgctcccaatgtatttgtatctcttatttttacaaactccgatgtaataaatgttgaaaaatggacttattttgagacatacgagaaggataaaaaaaagatcgtgaaataggatagaggagggagtaagtagcagccacattggtaacatacctcagttggatgatgcatgtacgtctgtggaacatttcagataacaatgcaagatgataccatgccgaaagtttaagaaccgtatatgcacataacatttccggtctaagaaaacttcattagggacctcgcagcggtctaagcactactacagaaagggccataggtgccggttcctaaccggctataggtgccggtttcctaaccgacacctattggtcggcaccaatactagcaaccggtacctatgaagaaaataaaaccagcacctttagctttgctcgagtaaaaaaaaggaccggctcggctcgaattgagctgagctcactgagcactgtcattgcgtcatcgcccgagttgctcctaaatcaaattaaaatccccaaaatcccaaaatccccaaatccccaaatcatccacaaatcgccaccaaaatcaattgacatcacagtatgaacatactccaatccacaaatccaccaaaatatctaaaaaaatcatccatagatcaaccaaaacatctaaaataaatccataagaaacgagggaggagagcccgcttcatgctccaccatcggcttcgtcgccggcgagcccctcttctgccgctgcccgccgcctgccctcccgccagatccggcggaggggagggcgctgcctccgccatcgtgtgccacctccgccgccgcccgccgcctcccctcccgccagatccggtggaggggagggcgctgccgccaccgtcacacgccgtcttcgccgcctcccctcccgctagatccggcgtaggggagggcgccgcctctgccgtcgcgcgccgcccgtcgtcgaggtacgccgccgctgccgcgcgcgacacatagaggcgagagagacgagaagcaagagagaaagaggcgagggagaatgagagagattcaaagaagacgagagaagacgaggcgataaggttctcatataggataaggccaatggtcggctcggctcggcagcttggataggtgccggttattttaaaaaacagtataggtgtcggtttttctttataaaacctgcacctatattatattaaaggtgtcgggttttttttaaaaaaccggcacctatataggtattggttcttctttagaatcggcacctatagttgcttaaaggtgtcggttttatgcattttcagcccacggaaaagggaaaaacattataggtgccagttttagttattccggcacctatagtgtcgatctccatgagtttttttttactagtgaagtgtgataactgataaatgacaacacgtgacgcaatgtaaggtagtacatatttgttggagtttgtgaagaacaaagagtacctgaatccttagagtatatggagaaaacatgcgatcgaatgtacttgtgattctcataagtaattggaacgaaatgaatcgtctaactaaagttgtgcatgccacaaattaaggccaaacatagatggacataaaaatgtcgaataagcaggtgcttagcacctcgtttacacctaatttattactcacctcatacatgtacttggagctaggtgctctctatatggttgaaagacttgagtttactggtggataacccacttgttgcagtgggatttcggaaatctttttagcacttccaaagcaacatcgagtcaagaaaaaaaaattctctatgcgtcatatagttttgaacaattttaaaataaatatcattctatgtcatatctaacaataaattttgccataaataatacctcgcataacaaacttaaaaatatactagtctcatacataaatttctacactccacaatttacttttttgttttttctgtctgaatatactttatgtttcttggccaaaattggtattttagtaacaaaataactattaaatgaaaaggttatggaatacacacacacatgttaaactattaaccacatgcacagtactctcatggctttgataaaacacgaaagtgattcggttgctcttcatttcgtgatgaaatatatggatcaatttgtacaacgcgtgtttaagtttttcagcaaaaaatgtcttcattaagtttcacttatatatcactggtggagaaaccatctttggtcggtcgaacagatttcacaatagtcccggttgtattaaaaaccgggactaaaaacatctttagtcccggtttaaaagatcaagggtactttttcatctttagtaccggttggtgttaccaaccgatactaaagatctatttgtagtcccggttggtgttaccaaccgggaaaaaagatcaacataagctttactcccggttggagttaccaaccgggactaaaga

SEQ ID NO: 92794 - DNA, 589 bp, Oryza sativa
tatacctgtttttttaaaccaaattagaacaagcacgttcgtgcgaatgcgcgggctaccttccaaaacaatcaggtaacatcaaagcaaaaccaacacataagaaataaacaattattaaattttattttgtgaatctccatccatagaagggaactatatattatatataagtacttccaagttccaacaaacagccacacagccacacaggtgcacattcgggccattatttagaacgcacaaagctgatatatagcatgcagccatgcacgcatgcagatgcaggagcatgacagacccagtgtcagccactccagtacatagggctacaattacaactatatatacgcgaccaatccctaaaccgagcaagctatatgctgcttcaggctgcagagacacccacatagttttaattaattaagggattgatctgtcgccggagtttcatcagttggcgacgacccggagtttcatcccggcggcgcagtggccggggacgccgcagatgtagtagttgacgcccttcttgaggaggaacgacgcggtccccgtcgccgccgccaccgagtccgccgagctgccc

SEQ ID NO: 92795 - DNA, 1015 bp, Oryza sativa
cgacttcaccgccggcctgcctccgtcggcgccgagtggtgcctccgcctacacgactggcctattatgccgctgctgttgggcgtctacgacttcaccgccggcctgcctccgtcgccgccgattggtgcctccgcctacacggctggcctattatgccgccgctgttgggcgtttacgacttcaccgccggcctgtctccgtcgccgccgactggtgtcctcgcctatacggttggttggtcacaccaccgttcatgggcgtccacgtcttcaccacgggcctgcctccgtcgccgccgattggtgtctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgctgctgttgggcgtttacgacttcaccgccggcctgcctccgtcgccgccgactggtgccctcgcctatacggctggttggtcataccaccgttcatgggcgtccacgtcttcaccaccggcctgcctccgtcgccgccgagtggtgcctccgcctacacggctggcctattatgccgctgctgttgggcgtctacgtcttcaccgccgggctgcctccgtcgccgccgattggtgcctccgtctacacgggtggcctattatgccgccgctgttgggcgtctacgaattcaccgccgggctgcctccgttccgccgagtggggcctccgcctacacggctggcctattatgccgctgctgttgggcgttacaactttaccgccgggctgccttcgttgccgccgattggtgcctccgcctacacgggtgggctattatgccaccgctgttgggcgtttacaactttaaccgccggccttgtctccgtcgccgccgac

SEQ ID NO: 92796 - DNA, 835 bp, Oryza sativa
gttgccaagattacacgcggtggacaagaatgaccgatttgtgaccggtctgacactgatcatatcgtcagcgcacagccatgctcccacgacgcgctcacccccggcggaagtggaggtaggcgtgggctgtcccatcggagcgtcattcggacagcaaccgtgctgatctccgcccgttcaagagaaaaagaacagtccagtttggaaagagaagggtgcatgtggtatccccttgaagtataaaaggaggaccttgcccatagagaaggggctttttgattcttttccagattgtgagcttagaacgggggagaagtcagctcacacttgtagcccattcatacacagatccaccaaaacacaggagtagggtattacgcttctcagcggcccgaacctgtatagatcgccggtgtctcgtgtttctggctggcagacgatctttccacatacagagagagagcgagagcttgagatttcaccctaagcccccggccgaactggcaaaggggggcctgcgcggtctcccggtgaggagccaccagctccgtcaccattcaagatgggcattcgaatgtgccatagtacagcatgaatggatggaatcaatttctgatacttcttccgttccaatataagtatgcaacctagtacggatgaaacatactacctccatattttaatgtatgacgccgtttgtcggtgacacagggccgggggtatcgtgactagaggattgggttgccgcggtcgcccacgtggcctgaccccctcgggggggtcgggcccgagggtaacgtggccacccctccctctgtctccccgaggggtc

SEQ ID NO: 92797 - DNA, 1948 bp, Oryza sativa
tattaatttcgaaatttttagtatccgggggtggttagttttaatcgtcagctctctttctctgtttgcttggttctggggggggttttcaaatggggacgaccaggagaaatgttaacaccggtgaaggcaaccaacccgaaggcagcaaccacaaccaccaaggcaatccacctccacctccacctccgcctccaccaccaccgccagacaccaacgccattctcacccaaatcctcgcccagcaagccaacatgatgaccgctttcctccaccacctccaaaacccgccacaacagaatgctccaccaccacctccccaacactctaaactcgccgagttcctccgcatccgcccacctaccttctccagctccaacaaccccgtggatgctttggattggttgcatgccgtggggaagaagctagacacggtgcagtgcagtgatgaggagaaagtcgtcttcgccgcccatcagctgcagggacccgcatctctctggtgggaccacttccaggctacgcagccagagggacagccgattacttgggctcgcttcaccgccgctttccggagaacccatgtgcccgctggagtcgtggctcttaagaaaagggaattccgagagttgaagcaaggcaaccgctccgtgatggagtatttgcatgagttcaacaatctggcccggtacgctccgcaggatgtgcgggaagacgaggagaagcaggagaagttcttggcaggaatggaccctgagctgtccgttcgtctagtctctggggactatcctgattttcaacgactggtggacaagagcatccgcttggaagctaagcacaaggagctggaatcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagggtcagcaggggactcgtgcgccccgtcctcctacgccaactgtgcagcctggtcaaggccgcagggacgctcaaggtcagcagcgtctgtgcttcaactgcttcgagcccgggcactatgcggataaatgcccgaagccaaggcgtcagcaaggccaagcgcctccccgctccaacaacggtgggaaggatgtcattcggggtcgtgtgaatcacgtgacggccaaggacgtgctgacaactccggacgtcatcgttggtacgttcctcgttcattccatccctgctaccattttgttcgactctggagcttcccactcgtttatatctgtgccattcgtggggagaaatcagttgggggtagaaaggcttagaaaccctctgctcatcaccacccctggaggggttatgacagcaaagtactatagccctgccgtccctatagaaattcaggggattccttttccctcggatctgattctgctagacaccaagaatttggatgtgattcttgggatgaattggttggctcaattccaaggagtagtggattgcgcgagacgcactgtcactctgtaccgagggccggaacaaccggttgttttctttgtacccccaacctctgtcaagagttcagaactgcatcagataggactgtcagaaatccccatcgtcagggagttcggagatgtgtttccggaagaactacccggtatgccgcccaagcgagagattgagttccgaatagatcttgctccaggaaccactcctctgcacaagcgaccctaccgtatggcagcaaatgaactgaccgaagtaaagaaacagttggaagagttgaaagaaaaggggtatatacgttcgagtacttccccatggggtgcccctgtgatttttgtagagaagaaagaccagacgaa

SEQ ID NO: 92798 - DNA, 2810 bp, Oryza sativa
ctattttctctagtactactaatcctgttgaagctggtgattggctgcatgctatagagagaagttggatttgcttcagtgcactgatcaggagaaagtctcatttgcatcacaccagttgcatggccctgcctctgaatggtgggatcacttccgcttgaataggactactgctgaacctatcacttggcttgaattcaccgctgctttccggacgacgcatataccatcgggagtggtgtctctcaagaagaaggaattcaggtcgctcactcagggttctcgctctgtcactgagtatctgcacaagttcaatcgtttggctcgttatgctccggaaaatgtgcgcaatgatgaagagcgccaggagaagtttttggaaggacttaatgatgagctttcttacccactcatgacgggggaatatcatgatttccagaagttggtggataaggctattcgccaggaagacaagtacaaccgcatggagcaaaagaaacgccggattgctcaattcaaggcacaacaggggaatagtcaaaggccgcgtcttactttgggaccccagtccatgccacagggaggttcttcgtctgttgttcgtccgcagcgtcagatcttcaacaacaatactggcaacaacatccgcaatcaagctccacgccctgttgcggttttgacacagcaacaacctgctaagagggagcaaggcagcaagcccgtggtgtgtttcaactgtggagacctaggacattacgctgataagtgtccgaagccccgacgcgtgaaggttgtccctacccagagcaactctaccgtaccagcatcaaaggctcgtgtcaatcatgttgctgctgcagaagctcaagatgctccagatgtgattttgggtacgttccttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcctgttagaatccaaagaccttgatgtcatcctagggatggactggttagccagacataaaggtgtgatagactgtgccaacagaaaagtaactctcaccagcaatgatggtcgcgttgtaacagttcatgcattgttttttgagtctttaaggtcaagattgaaccaaatatactttggaaaagattcctatagtccgggagtatcccaatgtgttcccagacgatttacctgggtatccgccttaaaaggatatagagttcagaatagatttggtaccagaaccactccgatccataagagaccttatagaatggcagccaatgagttggcagaagtcaagaggcaagtagacgatttgcttcagaaaggatacatcagaccgagttcatctccatggggagctccagttatttttgtggaaaagaaagaccatacccagaggatgtgtgtggactatcgtgcactaaatgatgtgactatcaagaataagtatccgctacctagaattgatgatttgtttgatcagcttaaaggtgccaccgttttctccaagatagatcttcggtcagggtatcaccagttgaggattaaagaggaagatatacctaagccagcttttaccactaggtatgggttgtttgaatgtactgttatgtcttttggacttaccaatgcccccgctttcttcatgaacttgatagtaaggtgtttatggaatacctagacaagtttgtggtggtctttattgatgacattcttatctactcccgaaccaaagaagagcatgaagaacatcttcgccttgcactagagaagctacaagaacatcaattgtatgctaagtttagtaagtgtgaattttggttgtctgaagtgaagttcctgggtcacgtcttctcagcagagagtgccgtcgatcctagtaatgtggaatccgtaaccaactggaaacaaccgaagatagtttcagagattcgcagtttcctaggcctcgcaggatattatcggagatttatagagaatttctccaagattgataagcccatgacacggctgcttcagaaagaggtggagtacaagtggtcagaagaatgtgtcacgaccggaaataacccaacgggctttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgagaaacagcagaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaggacatttagttgctcaaagctattttgtaaacacgatcctagaactatacaatgttattaatcaaggccgtgaacccacacgaacctgccttaacccaaggcctatgatgatttagaccgaactggcaacccgaccctgggtcccagctcgtcctaagccaacccaggccaaccatttcacattttagttgttaagcaggt

SEQ ID NO: 92799 - DNA, 2794 bp, Oryza sativa
tgacggccgggcccacctggcagccgcgagggcgcgcctgaaggcggcctcgccggcacgccttacgggaccggcgcgcccgcgccccgatggtcaccgccggcgaccatcggcgcgccggagcggcgcccgagagagcggagagaagggggaaagcgaacggcggtcttcggctcaccccgggacaacgacgacgacgagaacggcggccggagcggaggaaagcggcggcgcggttcgggatgacgatgacgacggtgctccggcggtcggcgggcgaagcggagcggcggacggggtcggcggcaacacggcgaagcggatggaggtgtcgccgagtcgggaggaggaccggagcgacgacggcggcgaaacggagctcggcggcgacggcggagagagaggagcacggcgcgagcacggatccgacggcgagagcgagcggcgagcggcggaaacggaagagcggagctcggggagcaattatatagcaccgagagggggagaacgcggccggagaggaaggaaacgggcgcggggatctcgggctccatagatgtcgccggcgaggattacgggatgaatccggacggatccgagggagagagagaggggaaatcgggggaaacgggagagggaatcacggggagtgattcccctctctttaatgccccccgggaccgccggatgccgcccaatccgcggcggccgccgcgctagggcacgggcccgcggcggaccccgcgggaggaaggcgatgacaagtgggccccacccgtcagcgagagtggcgggcgggcccgcctgtcaacggcgcgcgcgcgcgcggggagccgatgggccgcgggagaggagagagagagggagagggaagtgggccgagccggcccaagagggaagggggggaaaaaagaacttcttttagggttttctttttataaaacctttttaactttgttcatttcttttcaattattatttgtgctctgaaaattccactaaaatttatttacgcattttaggcttttagaaaatatacaaaaatcctccaagcctcatttgacttttatctttgcacattttaattgttggaggctttctcatgaattttaattattctttgcacaatttcgaggatgaattttagagtcgatttgggacgcgacaataacctagggtcaagggagctctgataccaacttgtcacgcccggaatttctagccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggggcagacggctccactccacaagcagcttgaccagggctacacctaatcctccacaccatcagcaccactgtagaactcttcctctgatgaatgattgcaaggtgagtatatgacatactcagtaagccacgcagcaaatatgcaagtgcacaggataacaaaggatgggatagtatagggctcatttgcaaaagcagcatttagcaaacatttgagaattataaaacagttaagtgataattaaacaatattaattcaacgctatacaacataccctgttgcataggcccaaccattctgaacaaccatacccggctgtacagatctatctgcaaaccaggaatgtaccattccaaaccaggagctaatcaaattattaccagttatagcatcatttattatggtgagaagtgtgagactaatcacgaaagacattgttagacccgcccataaccgcgggcacggctattcgaatagttttactctgatcagaggtgtaccactgtacccacaagacacagccccacatcatgtcaccatgtgccgcaataccaccacggtacctcggaaaggagctgtgacaatacccctcgtacaacacaatccactacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatgtgctcacaacccaccattatcaagttttagtgggcaagtaattaattaacaaatcacgattgaccatcgtgaactatcattaagccatcattaaataatagtgagtcatatgttatcctaatagtgtgctaatgtttctaagcatggttaagcaatcacatctaatatctagctgaaccaatatatagagctcaactagtcaagttataataacccaaggtatcaaggaataaagtaatcaagtacaaaagggccataacaaaaaataggttaattccacccaatgacattcgaaaatagatgcaatagttgaatagaaacaatagctttaaataggatcaacatgctcaaagggttgtttgggatctgtgtgacttgccttgctggccttggaactcttcaaaatcttctcctgcgaaaacggactctccggaaacgtcggaatctaaacagaaaagagcaaaaacaccaaaacagcacataaacaagcatgaccagtacatgtggatatttttaatatgtagatctcaattttagaaaaatt

SEQ ID NO: 92800 - DNA, 3939 bp, Oryza sativa
tatgtcacatgtatacaacgggttccaaggccatggaatgcggagtaaagatgtgtcttgtgggtaaagatgtacacctctgatcagagtaaatctattcgaatagccgagccctcggatatgggcaagccgagcaatgtacccaagttagtggtttaattcttaaaatttgcttaacaactaaaatgtggaaaggttggcctgggttggcttgggacgagctgggacccaggtcgggttgccagttcggtctgaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggccgctagtccgctgctgtttatttttgattgtcaggccttaagcgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaatggtcgaaggaatacaacaattaacatgaatccaatctcttccaagcaacaagctataggaacccttcccatcgatgacaaaaaatgttgtagggacggttttgctgccgactgtcagctccacattcaaaaccccttttgtttccgatggattgccaccaaaatctttgagcaccatgtttgtcttgatgagatcatccgaatttctgcctagcttcctgaatgtagcatatggcatcaagttcacagcagccccacatcaaccatcatcttagacatcggcttcccaatgacatagccgttaatgtacaatggtttgagatgccgattgtctgtcccttttggcttctcaaaaactgcttgctctagtgacaaaaccaacctagccgaagcttcctcgacttcatcaacatcggcttgttcagctccaaattccgcagtcaatgtaaaaaccaagtttaccgatgcagtcacgacactcttccctttagcaaacctttttgcttcatcggctttgacctcatcggctgtggcagcttggttcttaacacgccactcttgcctcggctttgttttcttcagccgattgttagtctcctgttctacctcatgaaagcgcactctgttccttaacctttgaacccttctcttctgattcttcgtgaaaataccagaagggcaccattgagcttttctgtcctcatcatcttcttgatcacagtcttggtttaccggcccaatctttgatgaacaggaactcttgtttgcctcagccgattgcttctattataagatcgacttgagctccctgcagcctcgctgcatccagggcaatcttcaatagacggcagcctcatacctttgttccagcagaatctgaaaaactcgtagtcccaatgaggatcaaaatcaccatcaattttttcataatacctttcctgctactgcttgtcatatgtcctctaatacttgttgataattctagccgaattcatctaaaagtttctatttttgcctccatcggctgtcctcccagatatatgcaccatgttcaccgggaaaggattaccatcaaccttcatcggcttctttgagtcatcaaatttaatctttcccccttcaatggccacctggatttgctgcctgaaaactttgcagtcattagtagaataggaaccagagttatgccatttgcaatacctcctcttgcctagttccaaagccgatgatatcaaagtcaaatctctcctcttttccagaactcttccccatgggcaaggtacaacctatttactcctgacccattcggctgccgctacttcggaatcatcctcttcatcagaaccatacatgtaaggatacacatgattgattttcttgaaattcttcttggcctctgcaaacctttgctcatgcagagttaccttccgtgcatggtgagataagctttcaaactactgggatgagaatttctctttaatcggagctatcaaaccctgaaaagctaaatcggctagctgagaatctgttagagccaagctgtagcacctattccttgtttccctaaatctctgaatgtagtcctgcacagattcaacatgcctttgccgaattgctgtcaagtcagaaagtttcatctcatgaattccactgtaaaaatagctgtgaaattatttctccaaatcggcccaaccattgacagaattgtatggcaaagaagaaaaccaagtaaaagccgatccggatgaggacaaaggaaacaacctaactctcagggcgtcaacagccgatgcttcaccacattgagctaagaatcggctcgcatgctcataagtcgaaacattatcttgccctgaaaattttgagaagtttggaaccttgtatcgagcaggcaatggaaccctctcaaaccactcaggatatggatgccgatataagtttccagtatccttcggcttaagcccaaattgctccctcattacatctgcgatcatatcagcccattgtctctgctgaggtgccccttgcgtctgctgctgtatcggctcaaactgattaaactgggagcaaactgaggctggggtgaccccccttggtggacctgaggtgaaggaggctgataatgataattcaagtgacccccgttgtaattctgagtatttcgttggatgttactgtcacaccctaaaaatcccaaatatataaattgttgtttaattggaattattagaattgattttaaaagtctagaaaagaagatctaattttaaataataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaagtcttcttttggctttgggccgaaagtcggcccaaaaccctctctctctgtccctcggcccaagtccgcccagtccagcagcgcctgcccgcgcgcgtgcgtttccgtcgctgacaggtggggcccgcctgtcggggtcgtcgtcaacctccagccgccgccgcccgaaaccctagccgagccgcgccgccgtctccttccaaattcggccgatcctttccgtttccggtgaaatcaattgagggaaaatgatcttcgggatctcctctaccttttctcttttggaatcatcggctaaaatcgcttggaaagtgtttgattcgaggtcgattcggatcggtctctctctctccgagcccgagctttccatctcgccgccggttgccgtgggcctttgccgccgcctcctagcccctttaaaaggatccccggtgtctcctctacccgccgccaccctcgccatcgcctctcgtcgccggtagcgccctagcgccgtgtaacctagcgccgccgtcgtcgccgccgctccagccgtgcgccgccgccgttccagtcgtcgccgtcgctcgggaaggtcgccatcgtggtcgccaagtcgtcgccatcctcgtccgctccttcgccgtcgctgaagactgccggaggaccgtcgccgccgtcgacccgatcttctccgccccttcgacctcaacgccgtcaccgggtgagttcgccgggtcgtcctctacccg

SEQ ID NO: 92801 - DNA, 618 bp, Oryza sativa
tcatccatttcgttcttttttttttctaaaaaatatattttctcttgtttggaggggtatttgtctgatattttgccattaaactgctttttgttcctgcaggaatctcttatggtactgatgaccagagtctgaaggaagcgtttgctaactacggtgaagtcattgaaggtatgtctcttgtttttttgttttttggtttttgtttttttttgttcatattgatgataagcatgttcctatacgtatgaacaatcagtagtggtgatatttttcagctagggtgattgtggaccgtaccactggacggtcgaggggatttggttttgtaacctacacatccacggatgaggctgcagctgccattactggcatggacgggaaggtgtgttgtgcaaactttgttatatctattggtttgcaattcaacttctacttgaggtttaatgcataggtgttttatgtctaaattaatctggcatccttatttggtaaatatttaaatcaatttgacttatgaatgcaatgcatatggtgtatcagtatgtggtatggttgcttcaaaggcactctagttggtactgaagatctttactttgatgtactgccttgcaaagt

SEQ ID NO: 92802 - DNA, 1249 bp, Oryza sativa
actgtgatgcttcgcgccaaggattggggtgcgtgctcatgcaggacggtcatgtggtagcctatgcctcacgccaactacgacctcatgaaggcaactaccctacacatgacttggagttagcagcggtggttcatgctctaaaaatctggcggcactatctcattgggaaccgctgtgaaatatatactgatcataagagtttgaaatacatcttcactcagtcagatctgaaccttcggcaaaggagatggttagaactcatcaaggattatgatgtgggaattcactatcatcctggtaaggctaacgtggttgccgacgctctaagtcggaagagccattgcaatactcttaacgtccgtagcattccgcccgagcttaatcaacagatggaagccctgaacctaagcatagttggtcgcggattcttggctgcgttggaagccaagcctaccttgctcgatcaaatccgcgaggctcagaagaatgatccggacatgcatggactcctcaagaatatgaaacagggtaaagccgcaggtttcacagaggatgaacacggacctctatggaacggaaagcgggtgtgcgttcccgataacagggaacttaaacagctgatacttcaggaagctcacgaaagtccttattccattcacccgggcagtaccaagatgtacttagacctgaaggagaaatactggtgggttagcatgaagcgggaaattgcagagtttgtggctctatgtgatgtgtgccagcgtgtcaaggcagaacaccaacgaccggccggacttctccaacctctccaagtgccagaatggaagtgggatgaaattgggatggatttcatcaccggacttccaaaaacccaaggtggatatgattctatatgggtaattgtggatcgactaacaaaggtagctcgatttattcctgtgaagaccacttacggagggaacaaactagcggagctctacttcgctaggatcgtgagtctccatggtattcccaagaaaaatcgtatctgataggggaagccaattcacctctcacttttggaagaagctccaaaagagctgggtactcgattgaatttcaacaccgtctatcacccgcatacagatggacagaccgagcgtctaaatcatatcctagaagatatgctccgcgcatgtgtcctagatttcgggaaaacttgggataagagtctcccctatgccgagttctcctaaaataacagcta

SEQ ID NO: 92803 - DNA, 747 bp, Oryza sativa
catgatttggagttagcagcggtgattcatgatctaaaaatctggccgcactatctcattggggatcgctgggaaatattttccgatccataagagttggaattactttttcccccagtcagatctgattcttcggcaaaggagatggttagaactcatcaaggattatgatgtgggaattcactatcatcctggtaaggccaacgtggttgccgacgctttaagtcgaaagagccattgcaacactcttaacgtccgtggcatcccacccgaacttaatcaacagatggaagccctgaacctaagcatagttagtcgtggatttttggccgcgttagaagccaagcccaccttgctcgatcaaatccgcgaggctcagaagaacgacccggacatgcatggactcctcaagaatatgaaacagggtaaagccgctggtttcacagaagaggaacacggaaccctatggaacggaaaccgggtatgcgttccagataacagagaacttaaacagctgatacttcaggaagctcacgagagcccttactccattcaccctggcagtacaaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggattt

SEQ ID NO: 92804 - DNA, 502 bp, Oryza sativa
tcctcgtttacggagtagtcgaccacggtgtcggaggcggagtcctgcgtggagacgaagctctgggcggcgaccatggcgatgtccccctcctcctcctcgtcgccctcccccgacagcgggcgcggcggcgccttgacgggggcgagcaggcggtcgtagtcgacgtcgtagtcctgctcgttgtcgaggtcttcgtcgtcccccacgccgtccccgtcgtcgaggtcgaagtccccgaagtcgtcgtccatgtcgtcgtcgccgtaggccgcggagacatcgcgccgcaggaggggcagtggggtggcgccgcgggagaggggggcggcgaggagaagggacctggaggaggaggggttagctagggttttggagagcggcgaggggaatggataggggaagccggagacggagacgacgagagagagcgacacggtggccgccatgtctgagcttttttttttttttttttgcgcgcgcggtcgagagcgagtatatc

SEQ ID NO: 92805 - DNA, 1687 bp, Oryza sativa
aataaagaaagagagcgaggaaacaaccaacggttacggacataatagcgcggaatccaaaatttaacatgggttggcccacattgactcccaggccatctgctcacacgccacacggtctcatccacacagggaaatgcacgaatcatggcgcaaatcctacggatagaaaaacgacaaatattgggggtgaaaatctgttgacaaagatctagcaaaatcgttcccaaatatgcagagtaagcctttcaccaaaaacttccccactggatggtaaatttacaattttgcagaggttgatcctcggtgacaattatgtgcaattagcttgattcacgtcgaatttgcaggttgtttaattttctggatcaatggtccagtttgttgggctgtttactagtactactgaattatgcagagaatgtggccccgccccgaattcagtaaaccttccaccttaactgccatgttcgtgctaagcctgcaattttgcaggcagatgatcctcctcttccctcgccgaaatcagcatggtacccaattgtgcgaaatttgcttgattcaggtggaatttcctttcctatatgggtaaggacttgagacccgtgtttagtcttttagtttatttagtgcgtttcacgttttgtttgtcagagctgcagtctgcatggtaagaatccgcaattgatgcatcgttacctactagtaactgccaaattctaatcgagttaccactagaagaaaccatgtaaaatctgcaaatccatttgatgcaaatcatgcttctatcaggaaaacaaatcactgcaaacacatgatgaacggcatgcagcattgatgcaatccatcagatcacacacattcacaattcagacttggaaacattttgtggtagaaaagggagaaattaatactactatccagcatttgtagcaactgtaccaatccacgattatgacatcaaattttgactgaaactgtaactgcattatccttggcagcaagaggactgaaactgaaactgcaattgcaatcttgaagcaaatcttgaacaaattgacagcaagaatacctgtaccaggacgggacgatcgatcaaactaacataacggggtagaagccacgccggcggtgagtagttcgacgggacttgctccggcaaagaacttggccgctggcaaccacgttgaagtcggcggccggatagtcgtccgcattgtacgatctgcactgcagcgacgaacaggaacagcatccgcccacccagcgattccaagcaccctgaacgcgcgcggacgtcttcggcggataggggaggacatgggtgcagagtggttgatggcggcgaaggttgtggagactgaggagcgcgtcgtgtggcccaaggagatgaagacccagccaccgtcgtagtagcccaagtaacgcgtggcgcgtgcgtcgtcctggagcgcgtgggtggcgcacccggcgagggtgcggcgcgccggacgaggatcgacggggatggctgggcgcgcgccaattgtggcagacttggtccgccggtggaggagccaaatgtgggcgatcctgagcagcatggcgtagccctcgccaacgacgtcgacgtggtccttccacgccctttcgcctcgccccgccccgcccgccgtgtcgaggtggagcagagcaggttgcggttccg

SEQ ID NO: 92806 - DNA, 1637 bp, Oryza sativa
cagaggctgaagagagatccaaaggcgccacacctgttggggagaaggatcctcggaaggaagtggaacgtagacggcaggagaggaggaggaaggacgagaaggataagggatcaagcaagagcaattcagattgcgaggatatcgagagaagagtaaccagggaaggggagagaaagcgggattctgatagaagaaatgagccagagaagcgggatgcaacaagagttggcgctgagggtcataagccctataattttgatgctaacaaccagggtagtaagacagtacagagcaaggcaaagtactttggccgtatgacaggcggtctgttatcttcttcaagaggttttggtggcggttccttttttggtagaagtgctcagacctctgctcctcaagttaacaaggtgactaaaccgcttgttactgtaactgaccagagtaacgtagtcaaaagagatgcccaacctcctgcaacagccaaatctgctactgctggaggaacgacaaattcatggactaatgttcatcgatctgtgagtaacaaaggcattattaattgctgcagcagtctatctgttacgattacgacatgtgccattaattgttttcaccctgactatcgtcttacaaataccgtttgcatttttgttatgcttttatgcaggttagtccaaatgtgcagtcacagcctactggacttaaaaagtcatggcaccagctgtttagtcgctcagcatctgtgtcaccttgtcctgatgttcctgctacagcccgtgaaatgaacgggcaaccagaaccatatggagcacaaattagcaatgctcaaatcttcctatcgcagtatccccctctggacagtaaccctagttcaagccgctgtatgcaatttccaggtttcccaccagtgaatggagcacctgccaacatgtcactctctcattttccagctggacatatgccctactattgtgagccagaaccaacagtgtttgaagaaccagaacaatttgaggacccatgctatgatcctgatgcaattgcgttgcttgggccagtttcagagtccctagataactttcctctcgacttggatagcgggttcatctctagtgacatcaccaaggaaacacatgcgaagccttcaccaatcgaatctcctctttcaagatcacgtacattcgaggataatcctattaggcactcaactggaaaagggcctaatggttctattttgcttgaagctagcaatgaacatgggggcacatggcaaatgtggggcacgccattagttcaagaaagtttaggtctacgaggtcctcagactgagtggctcctaccaaacacaaatcaatttaaccatggtccagtcatttgaatggtggaacaagaagctcagtgggttctggtttggatgacaatgatttatggctgcagaaagcgcctttccagcaaatgcctcttgatacaaggagtctgttcctttcacatgatgtctcagagaatgctatacacaacgatttggattttggatcaccaaacaaatcagcccgtttgcaccccattgggccacctggtcattcttggtccaagtaagtatgttgtgacattcttgtaccgctttcagtattttt

SEQ ID NO: 92807 - DNA, 1032 bp, Oryza sativa
tctgcatatattcaggttatatatttttttctgcatatattgaggtttaattccttgacaacatttttgttgggatctcgttctgattgaaaagcaaggtatcggaccagaagcaggcctcacggttacctagatatgggccatgcgtctgtctgtctcatgggccttacccatggcctaaagacgcctaccaataatcgctaactaaaacaattttatttattattattaaataaatcatgtgttaaacaaacttgtgacagaccttggtagtccttgcggagtaatagtgctgacttgttgatcctaacaacatggcttgactccaggccggattatcattgataacaaaacaaaacggaagattagtaggagtaataatacaatgtcacgattactgaatgacgccctaacagaacgttggcggttcggcatatactcatttttagtgcacatttttagagatcaattcatatggaggaacaaataagcataccactgcactgacatcaattgtaatcaaggcatcggaacagcagggtccggatggaatggataattacatgcatagtacagagcagaggatgggatggagtggataagaccatcctagctggatagattaggaggacatactctattattaagataaagataaaattaactaatggagccgattagattattactaattgatcatcgtgatcgtcatcatcttcatttgtctgcatcttgcagcaggaaggaagggtagcactaccagctccacctctcgttctcctgcccgtcgtcggtggtggccggcggcagctgcgagtagaagtcgtagtccaagctgctgctgttgttggtcttggataatgggttgtagtagtggtgcgcgagggcggcgccgccgaggacggcgagggtgagggcctgcgcgtgaagcctggcgtggatcagccgcatctgcggcgtcttcctccgcccgtacgccaccgatgcgcccaccgccgtcgcccacagccctcctgttcgtcacagatcgat

SEQ ID NO: 92808 - DNA, 795 bp, Oryza sativa
gcaacggaaaccacaccacaccccgatacgactaggatttcctctctgcttcttcgatccccttgtattacaatcgatcctgcaagagaagcactctataattgcagcggcaagatcgattttttacaaaccaacaaagcagaaaggattcacgcgccgccgcttgcgatttgtgagttgtctttcccctttcgattccccctcctctcttccttcccctatcgtcaactagctcgagttgcttgcttgttccctctgctgcttcctctcttgtgtggattggattcccggcctggccctttctttttcctcttctctcctagattagaatcgtcgcgatttgattcctcaatctctcgatttggccgccctatctgttattaatccccaattgttcttcacacacatactcaattgcaggtcaattgcagccagaaagaggcgatggatttcaaagtcgcttcctttctcctactcctgttaatcgtcacctgcggagctgctcaaggtcaaggcaatgattttggtacgccctaatccaacaccttcccttcctcccttacctatgctcctcctggctcctgcatgcagtttggaaccaacatgtcaaacattctcaagggaaaattggacaagttttttattgtgcgtagtaaagtatcattctaaaatttatatatatgggcagctgctgtgggtattttatttggttgaaattcaacttgaggataacctgctactgatcctcttagcttggttattcattgcctgcaaaatgcatccattatttttgtt

SEQ ID NO: 92809 - DNA, 2072 bp, Oryza sativa
gggcccaatgaaactacttaggcccagctatatacaggcgaccaggtcggaggtgttccgccacatcctcgccggcgacgacgattgcaaggcccccgccggggactttctgtcgctacgggagctgacccacgaggaggtctcccacctcctcgccttcctatacacgggctccctggcgacgtgcacggaggagcggcacctgcacgcgttgctggtcgccggcgacaagtacgacgtgccgttcttccggcgagcgtgcgaggcgcggctggcggcgggggtggaggcgggcaacgtgctgcggacgctggaggtggcggagctgagctcgagcgcggcgctcaaggagcgcgccatgggggcggtggtggagcacgcggaggaggtggtgttctcgccggagtacgaggagttcgccgtcaggaacgccgccctttgcgtccagatcaccgcgctctgcttgccaataaagcatttcccgccaagacgccttaatatcccttttatttttcttcgtttagaatttagttagacgacgtacgatgtataagtgtaattaaatgatagtacatgcatatctctggaattaatgtgatcaatatatacaatttagattctttgcacgaatatttaaacgacaaaacgccggtcttgttcattcagcacccaaaagatgagcaaaattttacaacataattaactgaaaatatagatagtatactatgtatattcctcacaataagcttgcgctgcggcagatgagtattaagtcgaaacataaagtactttttttagaactaaacatagagtagttcattgtggatcaaattgatgatccgtccatgcatttcttgatggcttgcagcactgcatgccgaaccatttgttcatccacgcttctctctgcagcttcactctgcaaatacaacaactaagtactaataaataattcactaaagagttagggaaatgctacaagacgatatcctatttggacgggataatatctcaggtggtgtccccccgttcgaacgggataccgtcctgtagtattcatcaagatttattatgtaagtactccctacattccatattataagttgtttgatttttaaagtcaaaaacttttaagtttggtaaagtttatagcaaaatataataatatttttaatgcaaagcggtgtagcaaacattggatcgaaataaatataatgctaaatttaatgaaactaatttgaaaatattgctaatcttttctataaatttggttaaatcaaaagaactttgactaaaaaaaagtcaaaagtattatcaacgagtactattcttccgttgtcacaagaaaggggccgggttaattagccaaattaatcaacgaaattacttaatctatcgatagataattagtgtggtacgtactttggctggatccaaacgcttcaaaacgaaatgcggtgtcatctgcgcacgacacgtcagcatcaaggacgtcgaggccaagctcctcgaatgcttctagcaccgacgtcagcaactcaggctgactcttctccatcgacacattgattcgaaaacctctcttcttctctagctctaccgatgaaacactcacctgcatgcatccatacgtcttcaatgctgcattaagttctttttttttcccaacttgaaggaagagtcacattttatgctatgatgagctataaacttaaagtatcatgaggagcagttgtggagctatcaccaccgtcgaacccagacaactaatagtgtttttcagtgatcgactgatttttataggtattagcggctatctacagtggagacggtagcaacgtagcccaagcgtggacaccgtacaagacttgcccgcgagctatctccgttgctgaagaggagtgatccaaagctatattcttcataacttagttcgctccatcggtgaaggcttgtgttaattagactatataaatttatcttttttaaggaaaactaaatagatttgcattattgttgtactcagtccaatcttaaatatttcacgtttaaaatataatttggataaatca

SEQ ID NO: 92810 - DNA, 867 bp, Oryza sativa
tcactttagcgcctagactggagttctagctcgtctgcatcttcatcgaaggactgcattctcctggcggagctgtgaggcacatcaaactctcccacagagcgcagaatttcctgctgatgtgttcacagcttgcctcaccacacccatcaaaatggcactgcactggttcgtccccttctcatgtttgattgttgtagacagaatttctcatgctgtatctgcatcaataatggttaatattcatgtatataaactattaaaatttaaaaaaaaaactattcaggttttgtaaccgatcgttactccgtgattccatggaacacaatcttatcgaccaaattcctggaaggcaaatgaccgcaaaactcttctaggggagttgaactgaattttcactgctatcacagacactattgcatggaatgttcttcctcatggtactgatagtcgttttagttacaattaatgccagtgatcaattgctttctcattcattttcttttaatctgttatgattcaactttcactgcgcagatctattccaaagacttttcaggcaggatcttttggttgctagtctctttcgcaacttcttacttgctgagagaatcatgcggtccgcaaattgttccccaatttcataccttttgttgccaccaactcatcagcaccatatgtggtaattgatggcactagccattctttttatagtttagctacctcttctgcattttctttaatttcctaaattttaattttagggatgcatgggacatggctgcagagatctgcctttctaagcttcctcaattaattgctgatcctaatgcagagtttcaggtgctattaaccgtctttgctttt

SEQ ID NO: 92811 - DNA, 1501 bp, Oryza sativa
  unsure (1)..(1501): unsure at all n locations
gcagaaataattacagttcaatgcatagatgagtactttgcattccttcaagtggacaacatttgcagagtaaaatagcaaggtctacaaattcaatattacccgtggacatgtcaaaggttgatcagatgaggaggaattgctcaactggtagtaatcagttaggacgatgaagcataacctaatcatagtgcacactgaagctctaaacaccataacaaacagaaaataatgcgctttcacaagttaggctaattgttgtgaaaaatctgcaacagactaggatataaagagttctatacattgcgatctcaagctgttgcatacccatgactcatggaatcatgcctaaatacacttacaaccataatcaaattcagacctagtagacgaatcacctgattgggaaggggaataccatgagacatgagaaacgaccaaatcatacaatttccttatggaaattaaaaaaaaaaaaaaaacgcttccattgtgccccttttcacctttcacatacagttgatatatgaagcttctgtaaaccccaccncnnnnanaaanaaaaaaaaagggggggttggcccagaaacacgttcagcatatagttggacagtacattcaacaacacaagtctaccgattacaaatatctgtcagagcccactaacatttttattcatctttcatanccagaagatggcgtncgtttctgcgcaccctcaacaagcagatatancnnggcttcacatacctgcgatgtgtctgcctgatccctaggttcctcattgagtgaggaataaaccatccatgcatggtccaacttccgctctggccggaccactactgatccaggaacttcagcatccttccttgtcacaagaccatcactcttctcaccataccttgccaccagaagttgtgagcatgctgccattgcagctgaaagtggcattacaactgggatcctagtaggattcccatcagctgcagctgggagctccaagtgtgcaacatgagagagggctgtaagcacactgggagtgatgctagcctctgtgtggaacgagacaatgggaacctcaggaggcaatgggttctgccgcaggaattctttcctcctctcatatgtcaggtcttccagagcctgaagatcaccctgaaggaaaaaaagaaaacaataaacatcagtgtcgtccattgtgcaggccgacaaggtaacgatcaagctcatcaagacaaataccttaaggacttttgataccaaaatctccatgagtttacgtaacctgacatagtcaccaagctggccttctcgcaagatatctgaagcaaccgggcttcctccatatgggctttgagctaaagccaaacctgcgaccttgtctttcagttgtggccagtaaagggagagggctgctgctgcatctacaccacccttgctatggccgagaagtagcacccgcttcttcgatccccagtatatttcttctatatattccttt

SEQ ID NO: 92812 - DNA, 569 bp, Oryza sativa
taaaggtaggacccagtgagcaagaagggagggtatttgtatagatgggccaggtaggagattgcagaaagtctttattgttgtcttctgtcatgatttatttgtattttctcaagctcacaactctactaagttattcccatgaatacaataggaaattagactcgtactgccaggctttagataatttggatgttctttagttcttaggaatcaggctgactaaaattagcatagtgttataatctctttcctggatcactgtgcattttttacacatattaatatgttttcagcaagagactgggctgtgcaagaatcttcttcaggagtatgcacagaagatgaattatgccattccatcttatatttgcaccaaatcagcctaggcttagctcctttcatatgcactgtagagattggtggaatacaatatattggtgctgcagccaggccaaagaaagatgcagagataaaagctgcccgaactgctcttctggcaatccaaggtattgttctgttcttctctaagggtctttttattttttttatattatccaggctattca

SEQ ID NO: 92813 - DNA, 736 bp, Oryza sativa
tcctgtagaatctccagtgctttgtcactgtggcgatcttttcctcagctatcctcttgtactgccatgcttccatcctctgctcctccttctccttctgaagctttcgaatcattgacaaggctgcacttgcagaagttgctgaagcttctctctcctcttccaactccatgaataacttcttcatcataatgtactgtgcgaatattgctttttgtaactgagtatcttcagtttctgccatctttctcaaaggctctgattagtatatggtttactatttgccttagaatctattaaattcatctattgaacctgcaatatttaaaaaaacttcactttattctctgaagacatgcgaggattggatgaagctgaaaaaggaaaaaaaattggagttgattttgaagtgtaaaatcaactcagcctagaataatactgtcacaattcttccgcaccataaaaataatattaccgtacatatgattcctttctagtagtttggtgattatgtaattgtatatgtgatatcataaataacacaaatgagtttcagtttttgcacctactaaaacttaatccaggatgtgttaatatttctatcatagggtaaaacttccatccacattgtacgcactacggaagtcatatcatgtatcctataatgcttaaatttatgcccctagcctaaaatgtgtgatcctgccatgaagaataagagaaagagatgatatta

SEQ ID NO: 92814 - DNA, 1087 bp, Oryza sativa
  unsure (1)..(1087): unsure at all n locations
cttattctattccagccgccactagctatagctcggttacaacttataaaatactatagaaatatcccttggatgttttcgaatctgatgccgtgtttttttttcctttttcaatcatgttatgcgtgcacgcatgcagcgtcgtgggcaatccaatgatatgcgggagcatcagcggcagccatgcggggaacgcgaacgcagcggagtgcgccaccgtggtcgccccggtcaccgtgccattcccgctggactccactccgagcagcagcagcagtgagtccaacctcctctcgtcttgtctttgcattcttgggatcgatcggtttgggggatcggagggagtttaatcgtgttcgtttgggcgtatgtgcatgcatgcgcggtgtacgtgtgcactgcaggggcggcagcggcagcggtggggaggtcaaagggtggaggaggcgccgcgcggttgccgatcggagtagggacaagccttggcgcctccgcgcttgtgctcctcgccgtctcctgctttctctggaggcgcaggcgccggcaccgctgcctcctctcgggcccctcctccgtcctcggcatcctcggtacgccacgtccccatcaacaccagtactaaaatgcacgatcgatcagttagttaatatgtgagtgtaattggtgatttcagagaaggggagagacgtggaggatgggggaggaggggaggtgatggcgaggctggggaacgtgaggcagttcgggctgagggagctgcacgcggcgacggacgggttcagcgcgaggaacatactggggaaaggagggttcggggacgtgtaccgggggaggctctccgacggcacggtcgtggcggtgaagcggctcaaggacccgaccgcgtccggggaggcgcagttccggacggaggtggagatgatcagcctcgccgtgcaccgncaccttctccgcctcgttggcttctgcgccgcgggcttccgcgagcgcctcctntctacccctacatgcccaacggcagcgtagccttccgccttcgaggtacgttacgtacgcttaacgtgacacacacaacacagtggtagtg

SEQ ID NO: 92815 - DNA, 682 bp, Oryza sativa
gggacgtacgggttctgtataccctacgtaccttgctggttcaaacatagcaactgtatgcagcatttatactcacaagcaattggcgttttgttgtcttgtgctgcgcattgagaactgaaattgtttggagcaaattttgttgaaacatttgttacgcaaaaaatttatgaagggaagccgccgctggactggcagacgaggaagcggatcgcggtggggacggcgaggggattgctgtacctgcacgagcagtgcgacccaaagatcatccaccgcgacgtgaaggccgcgaacgtgctgctggacgagtgccacgaggccgtcgtcggcgacttcgggctcgccaagctgctcgaccacggcgactcccacgtcaccacggcggtgcgcggcacggtggggcacatcgcgccggagtacctctccacggggcagtcgtcggagaagaccgacgtgttcggcttcggcatcctgctgctcgagctcgtcaccggccagcgcgcgctcgaggtcggcaagggctccggcgtcatccagcaccagaagggcgtcatgctcgattgggtaagcatgcacttccacatttcttctccaattttcagctttttttagctgctgtttgagccgtgatcgaaaagatgttgcactagttcttgtttgacgaattaaaagcctcggt

SEQ ID NO: 92816 - DNA, 1164 bp, Oryza sativa
agttaattggatccatgccactgcaaatataacattagatccatgccactgccatccagttttctgtcaatctccgtcagctctctccctcttcctctccttgcttctcctccaccttggcgaccggcacgacgcacacgatggcgcgcgaggtgcgacatccaggggcggacgccgaggcggagctcaccgtcgaggaagcggcggcccatgcctactccaagagcccacggcgagcctcccacctacctccccaccacgtggcctacctacctccccacctcgtacgttggtgatggcaaccggcctcgcggctcacttccagtccgtccccattggcgatgccggcgccgacgcccacgctactgctggcgcacttcaccctcccaccgctcgccggcgaggacctcacctcctcttcgtaaccgccctccatggccacctctccaccatgctgtcgcccgcctcccgcctccctctcccgcttcctcccccagctcaccccactccgcctctcccgcctcatcctccacctcacgccctcgccccgccacgacgatggccacctccttgactccctcctgcaccacgccttccagacctcctccagcacgtcctcctcaccgcccgccttgccgttgttcgctccaatggcgccagtggtggcgtgcagcagcggtagaagttcttcgtctggtgcaggggaagaagctctccttggccatgctcgccttctgcgtcatgcacacccacggcctgctcccttgcgtcgagtcctgcaacgtcttcatcttcaccgcgctcggcctcaggctccccaagatcgccgagcctcgcaccaacgcacagcacccatccaaccatcgcctcccaggcagacaccccaccgtagcttcatcgccactgctgccaacgcccatctcgtctccccgccgagagagagaggaagagagatggaaggagaaggggggcaaagtgacatttcacaggtgagattagacagagattgacaaaaaaaaaactagacgggagtggcatggttccaatttccccaaatttcagtggcacgtagccgatatagcaaatagtagtgatatttttctaatatgccatatttgcagcggcaaggagcttatgcaaacatatgaatgatcgctccagaaa

SEQ ID NO: 92817 - DNA, 964 bp, Oryza sativa
tttttaaccgactagctatttgcccatgttgcttaggtaaaaattaacttggacaaccaaaaccactaaaagtttgaggacagaagatagaagttgaaatgtacagattatctcatttaagatgtcagcgctttttaacagactagctatttgcccatgtgttgcaacggatggaaaataaatatagtataagatctaagttaaaacacaaaaataatctaaaaaatgtatattatcatcgcataaattttttttagcactacattcgtacatgcatagatcctacacacaaatccaaggagacccatgtctatcgctggtccttgcgcagttgcgccagaaaaccattgattcagtttgacatgtggcaacacggttcagtgattataccaactttggttgtctacctgtatgattgtctctgcaagtggaatagttgaactcaagtgtaatgatgctatattttgatgagctaccacagaccagatgcaatacatgtccaagaaaacgattttctttcatttttttcctattttaggagcagttctacatcaatattaataaaccagataagtccaacataattttcaactaccgtacagaagacatgttataataagcttttaacatacctgcataaaattgtaacgctctcttccaattgattcattctcagcaatggaaaaatatgccagcattggatagtgcccaatataggatgcatagctatccctttggatgtttactgcccattcactgcaataaaagaaatcctcaatactaagttactacattcccaacaacacatttttgtttattttggaaaaagatatacttacaatcgattcaagtcagcatgccctgtgcccacatatttcgcttgaagatgctcaagttgagaatttatgttgaacctgtcgctagcctttaaagaagatgatttatcatatcaacatcatggtca

SEQ ID NO: 92818 - DNA, 997 bp, Oryza sativa
gggcatggtccccaaacatcagaatgtattaatatgaaaggctcacagttacgaagaccaatcccaacatatgtagaccgagtatgttttccaagctcacaagcatcacacaccaatctatgcttatccactttactaaagagatctagatacaacttactcaaaatctcaaaagatggatgtcctaactgacaatgaagcaaactgatctccttctcaacatttccaaccaccgcagctagccccagttcctcatgattgatgtaccacaacccatcacacctgactctagtcccaatcctcctcccagtccccttctcctggaacagatgagagttctcatcaaatacaacaatgcacttgagttggtcaatagctgagctaactgagagaaggtttactggaaaggaaggaacatgcaagtcagaggataagtttattgatgatgtgcactctactgaccctataccatgaataggtttggatgtaccatcagcgatttggatagtttcaaagtggacataaggggtgtatgatgtgaaggtattatgcaatcctgtgaaatgctttgatgctcctgagtctatgatccaatctataggatgtctgtatgtaaatgcaagtgcctgtgcctgaataccttcgcccacttgagcgtagttggcgaagtaccaaaagtgagtggtggtgttggagctctcattgatcttgttcttctgccattcctcccactgtgtcacctgttcacctgttaaggtaatagctttaccctcctctatggctacatggcatgaggagcacttcgcccctaccacgaccttcaccaccacgatctccacaacgacctcttctaccactgtggttccccccaaagtaaccagggtctcatccaaatccaccacgggttccaccaaatccaccataccttcctcgaatcaaccccctaccgccaatgttccgagaagtgggacaattgagctcacatgacccacttgtc

SEQ ID NO: 92819 - DNA, 1082 bp, Oryza sativa
atgttgattactaataaataacctctcaccacatgaaggtggcgtcgggcatgaccatcccaacggacccttcaggtacttaccactgcaggccgattccagcaggatactccaaggtcgaagttgagttggtcgaaggcgcgtacgaggacctcgaactggattaccctggaggagacggtgagacgcatctacgagacacaagccatgcaattattctatggcgcaggctgtacatcatcctccctgggcgacaagcggcgtctcgtgcaccatcttctctggctccgccatctcctccggctccgccatctcctcctcaggatcctgcaccgtctcctcctcaggatcctgcaccgtctcctcctcatgctccagcaccgtctccacctcaggctcctgcaccgactcctcttcaggctcctgcaccgactcctcctcggtctcctacaccgactcctccgcaagctcctcttccggcaccttcaaagtcaagggccccccaggctccaccgcctgcccacagaagggcaacgaagaaggcaaaaattgacgccgccaagaacaaggacccggggtacgattgcacacaagaggagcttgacgcttacatggcatcagaagtcaagagacaattcaagcctcaaagtccagaaaagaagattcctatagacccgagtgtcatgaacttcttcaggggtatgtctgcacctgccaaggaggccattaagctatcggactatgagcgaacgctgaagaaagcatcttctggaaagtccaaactagtccctcagcttggagagcaaccaaaccaggagatcgagccgttggtgaccggtaaagaaatgacgatagaagaatttattactgacaccggtctaactacggatcaattgctaggagtcacaccaatcgaaaaggcggaagtgaaatacatgtacgaactcggtaaaccgcttgtcaagcctgagctgctgcagtccctacccacacaaatgtacaagttccatccgctgtacatggagatgagcgccaccggtagagagatgatcggagcgaggatcagggacacggacttcttg

SEQ ID NO: 92820 - DNA, 1060 bp, Oryza sativa
tcctgtgaagggggaaatagttcttgctcagtttagtgctgacaactcctggaatagagcaatggtacgtttcacttctatcctgatcttgaaagttgcctgtatgtctcacttctatgttgcaagtcaaaactaattatgtgttggggtcatggtttaggtttatgctaacctaagcagcttactagaacttcacaaaatttcttttggtatttacatttttccttgcaaagggggtttaatggcattaattgtgttgtgactttagaatgataatatgctatctttgcaaatcaattgttcccttggttagctgttctgtatagtcaagtaaaaatttctacaagtggtgggtcataccaattgagtaattgcttattttcataaatgtttgggccacttgagttaatttggacccaggaaatgggtgatattgttagaatccattgtaattcatttgacttgctcaaacttgtgttcctgctaaaatgaaggattggataaaagggacttagatgatatattctttagttgaatatttaagggacttggggcattagtgttttatgccaatgttgtttttacctcatagcttcgctaatgttctgctgttgattgcctaaacagctagtgatttcatcctgttgttttaattacatgatccatcatccatgggatcatctctaggaaattgcacaaactcatgttttattcttatgaaccattttagtcctggacttgttaagttgaacattcccgttttagtttctggttttcaaaaataattaggaagtatatccattttaactgatctgcagattgtgaatggacctcgaggagctgtatcatctcaagacgacaagtttgaagtattctacattgactatggcaaccaagaagtcgttccttacagtcgcatacggcctgctgacccatcaatttcctcttcgcctgctcttgctcagttgtgcagccttgccttcataaaagtgcccaacctagaagatgattttggccatgaagcagcagtctatctgaatgattgcttgctcaacagcca

SEQ ID NO: 92821 - DNA, 1067 bp, Oryza sativa
ggtggaaggcacagatagtttcagcaatataattggctcagtgtattactctgatggggatacattgaaggatctggcccttgagcttgttgaaaatgtacgatcaattatttatccactacctttcatttgactcacatgattctttttaagatttattttaataatgagatctgcttgcattgaaattcttttgtatgattaattatgcagggtcttgccaagtatgttgagtggagtgccaacatgatggacgttgatgcaaaaataaagctgaagaatgctgagcttcaggctaagaaggaccagttgagaatttggacaggatttaagccaccagtgacaaactcgaagccaatccacgaccagaaattcactggaaaagtgggttccctgttctcacaagtagtgtattcaacatgatcatgcgattgaagctaatttgctttgtgttgatcctttcataggttgtagaggttgtgagtggggattgcatcattgttgctgatgacgcagctccttacggaagtccttctgcagaacgccgggttaatctttcaagcattagagctcctataatgggcaaccctcgtagagatgagaagcctgataattttgctcgtgaagccaagaattcttgcgcacaaggttgatggcaagcaagtatgtacataggttttgagatattccatcaagagttccataactagattgttacctctgttgaaaatgtactgattttttctccttccaattttcagcgatctgttcagatgttatactctagaaggatcagcactgtggatggacagcccacaacaaacacagctgaagacagggttttggattatgggtcggtttttcttggttcaccttcgcaggctgatggtgatgatgtttcttccattccaagctcaggcaaccaacctggtatcaatattgctgagactctgctctcaaggggctttgctagaacatctaaacatcgggactacgaagaaaggtcacactattttgacctgctgttggcggctgaatcacgagctgagaaagcaaagaaaggagtt

SEQ ID NO: 92822 - DNA, 1703 bp, Oryza sativa
ggaagttgggatgtgcgagcgattcttctctgcaggaggagataacgatttttttttggtgggacctgcttgaaaaaaaaattgatggtagacctcatctaaagctacgcgcgctgggagatggagcctcatttacttttttcctacatgatgcttgtgcttcttggtgagccgggacacatttgctattgcctgtagagtggtacgcctagtacgtacgaggcaggagacagattagcagctgcgtgctttcctctccatctgatggtgacggggatggccacgattaagttggaggaattaattcaatcgattggggtgaactgatcaagtgaaagcatgaacgagtcggtacgaattaatgagaggaggagatctgcgacgtgggtaaagattagaggagggacatgtgggcgtggggctcattgatggatgttcgcttcaaaatataataagctttgactatgaatttatttagatgtatgtattcagttttgtaactaaaatttattatattttgaaattagaaatcatggagatatagagttgtagttgtatttttctacggtactaccagtattggtaggggcgatgaatgtccgtgtcttaggcctcggctagcagaagtgaccaaatatagttcagagtttagatctccttcgaaatagataaatttactaggaattttataaaaattgaactaattaatatgatatttctgtgttccaacaaagacgtccacgacgtagcgtcaaaatcaatacttctaaagctggcattggaacttacaaatcgattggttcaaggaacttacaaatcgattggttcaagtgatagagctaaacttttgagataaatctagaaattatataagaggaaaaaatcaagaaaaagaaagcatcgtctcgatctagcacatgctagatgttttccaactaggtagaatagtatgtatctgataccttgaaattatagaaatttgtcctcattcaatcgatgataattggaatgattagggagaaaattagagattaaaaaatgatatttaaaattttaaaataaattagataatctctattaaagtcctctaaacttaatgtgttgtaaattaactctaaatatacatgggctatataatactcgtaccaacaaaaaaacataaaaaagggtgtgactatgatcacatactctttatttaattaattatgttcaaaatgataaaggatttattaaggataagtcttgcattttctccccctttgactcaaaaccggtcacgcattaggataataaatccatcgattatttagttggttatatagatggccaaaaggcccgaggcccgacggcccggccgatggcacggcgtttaggcccggcccaagcatggcacggcccgtcaagggtcgggcccgtgctggcccaacccggccaacgggccgtgcctgggcctcttcgccagcacgttgggccggcacggcacgatgggccgcatgccaggcccgacacataaacaatagggagtaaaaatagacatattatatgccacggtcgaaagaatagggatgcaaaatagacttattttacctatatatatgtcagcccaaagaggagggacggaaaatagacttatttttactatatatatatatatatatatatatatatatatatatatgtcacagcccaaagaggagggatgg

SEQ ID NO: 92823 - DNA, 747 bp, Oryza sativa
ttttagaataccatgtatccctattcaaccttgtttcctcgtctgaaatttttagcccttatattaattctctgcgttgccctcttgtaaatagcattcagacagagaaggagaacaaccgaactctcccagtcaaaattccagatctagcatgtcaaaatcttttcctcaggtgtttcacaaggtttgattctttttaacctagataatgttgaaaatggaagtgtatcaattatcaaatgtcaggatatgatagatcacatgaactgtgtatattcacaagttcatgaagaactagctgttcagcacaatatctttttcgtatgaatactaaatcataagttaaatctggattgaagtgttgttttgcaagcaattggaggagtggattgtgatgtcttttgaataggcctactattcttgctgaatttaggaaatattgtgcatctgttctgtcttttacgactgaagaacaaacaatcactaaaaataaaacgataattttaattatttgtttcaagcatttttcagagaatgtaaaaaccagaaaactggagcataaaacataactacattctagtttagttatgctgttttctggttcagatcattgatatttgaattcccttatgtgtaattgtgtggtgaggtgcagaaacttcctatgggagacgccgtgtattattatttcaaggacatctatgatgctcttcggatagcacaagttggtgtacgtttgatatttct

SEQ ID NO: 92824 - DNA, 999 bp, Oryza sativa
ttcaatggtgcagcaaaagtactgaaatctttgacgaaacggtggtagaatcctgcaagaccaagaaagctcctcacctgtgtgatggtttggggaaccggccaactccttgtggcttcaatttttgactcatccacctcaattccctatggagtaacaacatatccaagaaaagagactcgttccgtgcaaaagatgcacatttcaaagttagcaaacaaacgtgcatcgtgtagagcattaaaaacagcacgtaaatgatccatgtgttcatccaaagacttgttgtaaatcaatatgtcatcaaagtacactaccacaaatcgtccaataaaaggccttaaaacctcattcattaagcgcattaaagtactaggtgcattagtcaaaccaaaaggcattactaaccactcatacaaaccaaatttagttttaaaagctgttttccattcatctccaagtttcattctaatttggtgatagccactacgcaagtcaatctttgtgaaaataatagagccacacaactcatcaagcatgtcgtctaacctgggaataggatgacgatatcggacagtaatattattaatggctctacaatcaacacacattcaccaagaaccatctttcttaggaaccaaaattacaggaactgcacagggactaaggctttgacgtacatacccgcggtccaaaaggtcttgaacttgccgctgaatttccttagtctcatctgggttggttcgataagcagcacggtttggcaatgatgctcctggaatcaaatcaatttgatgctctatccctctcatgggtggcaatcctgggggtatctcagctggaaagacatcctcatactcctgcaaaaggttagtaacaacaggaggtatcgaactagcaatatcatctaaagaaaccaaggcttgtttgcatatcaagaaatagcgcatatcatcatttgaaatatcagcaatgtcacatttcgttgcaagcataaca

SEQ ID NO: 92825 - DNA, 1770 bp, Oryza sativa
tgaagtttcggcttccggctaggttttccagaggggatataacctagactattatgcggtggaattgggatatggtggcagcgaagttgtagggtgttctggtgatgcgtggtgatctggatgagtgtttatgatggcggaaacggctctcaaaggatgaaccctaacacacggtgaaaggtagcggctagggttacaaaggataaaacacatgactagactaaaatacgtactagaccagcaacaggaacttaaactaggactcaaactcaacactacagactctgaaaaagaatcatgcaaaggctaaacacggtctaggttaaggtaactaacaactaattttttttggcttttctgtagactctaggataattgtgaaaacaaaaactaatctagggcaaagaaactgagcgaacctgacggtgaacctagagctctcataccacttgatgtgcgctagggttcccgatcttccgaaaggttctgataaacaacgatttgggcagagtcgcgacacaaatcgatccggcttcttgaacgcgcacgctcttgagccccgcaatcgcagcaccacgtctcctctggttatcacccgtgtcgaaacgcggatgacctcgccgagaaggctaatccctgtttgccaattgaagaacacaaataaaaacgagatagaaaaacaaccaaaattgcagatgaatgattaagctcacgagttggggtcttacaaaccgatctagcggcgaaactgttctcgacagattaatctaagcaaaacccaaaaacctaaagatggtggcgagtactgatatatagagtttagggtcgtgcaaacccttctcgacgcaaccctaatgggttccaacacaatacacgggccaaaggcccaaatacgatgacgcagcaccgggatagattctggacgtcaacttgttcggtcaattcccgttactccggaaagaatttggacatgggaccaaaaccattggaaattttatcttcttagctttccatcgatataaagaacgccccaatccgagtacgtatgcgacctgggcgcctgttttagtgcagactggtcctggactccgaattgcacccgacgtcgacttggtttgggcctccaccttgaattggacgtccccgatgatcctccatggctctcagaccttctccaagtgtctccttgtcccctccattgttcctaatcacaatataatcaataggtagcaatctattctcgaattcatataaagaagaacataggaacgagctcacctctaaatttaattgtcgcgcacgagctcttgttatcggtccttgaatgaccgttggaggattgttgtgtgtatccgaggtagtgatgtccgcatcacaatgaggtcacgatcaagaacaaatatcctttaccgcagattgatgatttgtttgatcagctaaaaggagctaaagtgttttctaagatagacctacgatcaggctatcaccagttgagaattcgtgaagaggatatccccaagacagccttcaccactcggtatgggttgtatgagtgcacggttatgtcctttggacttaccaatgcacccgcattcttcatgaacctgatgaacaaagtgttcatggaatttctagataagtttgtggtggtattcatcgacgacatacttatttattcaaagtctgaagaagaacatgagtaacatctccgttggtactcgagaagttgaaggagcactacttatatgccaagttcagggctgcaggaat

SEQ ID NO: 92826 - DNA, 2052 bp, Oryza sativa
catcctagggatggactggttagccagacataaaggtgtgatagactgtgccaacaaaaaagtaactctcaccagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatatatttggtacctggaacagctccgatccataagagaccttatcgaatggcagccatgagttggcagaagttaagaggcaagtagatgatttgctacagaaaggatacatcagaccgagttcatcaccatggggagctcccgtatttttgtggaaaagaaagaccatacccagaggatgtgtgtggactatcgtgcactaaacgatctgactatcaagaataattatccactacccaggattgatgatttgtttgatcagcttaaaggtgccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaatttgatgaataaggtgtttatggaatacctagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggttttcaagtgtattgcgatgcatccaaacttgggttaggttgtgttctgatgcaagatgggaaggtggttgcctatgcctctcgacagttacgtccacatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcaaggaactgtatggttgggtgagagaatctgtgtccccgacaacaaagatctaaaagatgcagttctgaaagaagctcatgatactttatactccattcaccctggtagtactaagatgtaccaggatctcaaggaaagattttggtgggcaagtatgaagcgtgaaatcgcggaatatgtagcagtatgtgatgtttgtcagcgagtcaaggcagaacatcagaaacccgccggtttgttgcagcctttgaagattcctgaatggaaatgggaagaaataggtatggattttattactggtttacccagaacgtcacaggccatgactctat

SEQ ID NO: 92827 - DNA, 897 bp, Oryza sativa
agcacagagcatactgggctatcaggaactggaacatggactttaaaggagtaggagaatggagaaaaatacaaattgctgaacttgaagaatggagagagaaggcttctcacaacgcaaagatatacaaagaaaggacgaagcgctggcatgataaaaggataaaaatcaaaaaattcaagccattagacaaagtacggatattcaactccagggttaagcttttcggccacgggaaattgcacagtaaatgggaaggaccgttcgacgtcatcgacacctcttcgcacggggcaatcacactccgcgacgattcagttaatatattcaaggtaaacgatcaacgcttaaaaattttccttgagccaaatgaaactttagatgaagaagtggatgttattaaattaatcgataatgagccataatgatctcatctattgcatgcttaaaaccttgtaaagttgtcattttcgtgcttagcttaggaattagtgggcctaggtgacgacgggaaaaccgggacggtcgtaatagtatagtaggtccgttatccgcaaatcgttagagacaatttaatttaaatgcaataaataaataaaaatcagaaatggggagtcccttacttctagaattcatacattacatagaaattctgttaattacatctccgtagagaaaacccctgattaggaattccaacaagaaagaaaataaaattacatgactgctaaaaggctaaaaagaaaaatctatcctaaagctccagatgtcgcagccgtagaatcttctgtagatttccatttatatctttatttcattttgggagtattttagatgcccactaatttgttggtttttaatatcactgcatgtatggtagcaaatttatacatagct

SEQ ID NO: 92828 - DNA, 1511 bp, Oryza sativa
gggcagctccaactggtaagcgacttctccgcgccgagcaatgatacggaaaggacccacataccgaggtgcgagcttcccttttgtctgaaacctgtgtacacctcgcaatggcgtgacccgaaggtatacaaaatcatccactgcgaattccaggtcacggcgacggttatctgcataacttttctgccgggactgtgccacctttagattatcccgaatggttctgactttagcttcagcttctctcaggatatcagtcccgaacacttggctttccccaacttgatcccacaggagcggtgtccggcacttgcgcccatacaacgcttcataaggtgccatttgtatgctggcttgatagctgttgttgtaggagaactcggcataggggagactcttatcccaggtcttcccgaaatctaggacacatgcgcgaagcatatcttctagaatctgatttagacgctcggtctgcccatctgtctgcgggtggtatgcggtgctgaagtttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcgcaggaatgaatcgagctaccttggttaatcgatccaccactacccatatggaatcatatccaccttgggtctttggaagtccggtgatgaaatccatcccaatttcatcccatttccattcaggtacttggagaggttggagaagtccggccggtcgttggtgctctgccttgacacgctggcacacatcacatagggccacaaactctgcaatttcccgcttcatgctaacccaccggtatttctccttcaagtctaagtacatctttgtactgcccgggtgaatggaataggggctttcgtgagcttcctgaagtatcagctgtttaagttctctgttatctagaacgcatacccgctttccgttccatagggttccgtgttcatcctctgtgaaaccagcggctttaccctgtttcatattcttgaggagtccatgcatgtccgggtcgttcttctgagcctcgcggatttgatcgagcaaggtaggcttggcttctaacgcagccaagaatccacgaccaactatgcttaggttcagagcttccatctgtttattaagttcgggtggaatgccgcggacgttaagagtgttgcaatggctctttcgacttagagcgtcggccaccacgttggccttaccaggatgatagtgaattcccacatcatagtctttgatgagttctagccatctcctttgccgaagattcagatccgattgggtgaagatgtatttcaaactcttatgatcggtatagatttcacagcgattcccaatgagatagtgccggccagatttttagagcatgaaccaccgcggctaacttcaaatcatgggtaggg

SEQ ID NO: 92829 - DNA, 2214 bp, Oryza sativa
ttcttcatgaacttaatgaacaaagtgttcatggaatacttggataagtttgttgtggtcttcatcgacgacatcctggtgtactcgcaatcagaggaaaaccatcagcagcatctccgtctggtgttgggaaagctgcgggaacatcaattgtatgccaagcttagcaagtgtgagttcttgttgtccgaagtcaagttcttagggcacgtgatatctgccaaaggagttgctgtggatcccgaaacagtgaccgccgtcactgattggaagcaacccaagacggtcactcaagtccgcagctttttgggtttggccgggtactatcggaggttcatcgagaacttctccaaaatcgctcgacccatgacacagttgttgaagaaagaagaaaaatttgtgtggagtccgcagtgtgagaaagcattccaaactctcaaagaaaagctggtttcctcgccagtgttaatcttacccgatactcgcaaggacttcctggtgtactgtgacgcttcgcgccaaggtttggggtgcgtattaatgcaggaaggtcatgtggtagcctatgcctcacgccagctacggcctcatgaaggcaactaccctacccatgatttggaattggccgctgtggttcatgctctaaagatctggcggcactatctcattgggaatcgttgtgaaatatatactgatcataagagtttgaaatacatcttcactcagtcggatctgaatcttcggcaaaggagatggttagaactcatcaaggattatgatgtgggaattcactatcaccctggcaaggccaacgtggtcgccgacgctctaagtcgaaaaagccattgcaacactcttggcgtccgtggcattccaccggaacttaatcaacagttggaagccctgaacctaagcatagttggtcgtggattcttggctacgttggaagccaagcctaccttgctcgatcaaatccgcgaggctcagaagaatgatccggatatgcatgggctcctcaagaatatgaaacagggtaaagccgctggtttcacagaggatgaacacggaaccctatggaacgggaatcgggtatgcgttccagacgtcagggaacttaaacagttgatacttcaggaagctcacgaaagtccctattccatccatcctggcagcacgaagatgtacttggacttgaaagagaaatattggtgggttagtatgaagtgggaaattgcagagttcgtggccctttgtgatgtgtgccagcgtgtcaaagccgagcaccaacgaccggccggactcctccaaccactacaagtgccagaatggaaatgggatgaaattgggatggattttatcaccgaacttccaaaaacccaaggcggatatgattctatatgggtagtcatggatcgactaaccaaggtagcacggttcattcctgtaaagaccacctatggagggaacaaactagctgaactctacttcgctaggatcgtaagtctgcatggcatccccaagaaaattgtatctgatcggggaagccagttcacctctcatttctggaagaaactccaagaagagttgggaacccaattaaatttcagcaccgcgtaccacccgcagacagatgggcagaccgagcgtctgaaccagatcctcgaagatatgcttcgcgcatgtgtcctagattttgggaagacatgggataagagtctcccttacgccgagttctcctactataacagctaccaagccagcatacagatggcaccatacgaagcgttgtatggccgcaaatgccgggcacccctattgtgggaccaagttgggaaagccaagtgttcgggaccgatatcttgagagaagctgaagcaaaggtcaggaccattcgggaaaacctaaaggtggcacagtctcggcagaagagttatgcagacaaccgacgccgtgacctggaattcgcagtggatgactttgtgtatctccgggtaacgccgttgcggggtgtacacaggtttcaagcgaaagggaagctcgcccctcggttcgtgggtcctttccgcatcattgctcgacacggagaagttgcttaccagttggagctgcccgcctccttgggcaacatgcatgatgtgtttcatgtgtcgcaactcaagaaatgtcttcgagtgccgtccgagcaggccgactcagagcagattgaagttcgcg

SEQ ID NO: 92830 - DNA, 737 bp, Oryza sativa
tatacggaccacaagagtctgaagtatatcttcacccaacctgatctaaatctccgacagcaaagatggttggagttaagcaaggattatgacatgagcattcactaccatccgggtaaagccaatgtggtggcagatgcattaattaggaagagctactgcaatgccctatgcaccgagggcatgtgtaaagaattgcagcaggagcttgaacgtctcaacgtgggaatagtagaacacgggttcgtagccgctctagaagcatggcctacgctcgtggatcaagtcagagcagctcaagtgaatgatcctgaaatagcagagctgaaaaagaatatgaggctcggaaaagcccgggacttccttgaggatgagcatggcacgatctggatgggagaaagattgtgggtgcccgatgacaaagagctgaaagatctgatacttactgaggctcatcagactaaatattccattcatccgggtagtaccaagatgtatcaagatctcaaagaaaaattttggtgggccagcatgaggagggagatagctgagttcgtcgcgctctgcgatgtttgtcagcgagttaaagcagaacatcataggcccgcaggattgctacgacctcttcaaatcccggaatggaaatgggaagaaattggaatggatttcataacaggtctgcccaggacatcatctggccacgattcaatctgggtagtcatgggggctgcaggaat

SEQ ID NO: 92831 - DNA, 2332 bp, Oryza sativa
aaccaagaatttgacttagaaattaaggataaaaagggagtagaaaattccgcagcagattatttgtctaggctgtagatcattgacatgtaggaacaaccaataaatgacttcttgagagatgatatgctgatgacggttcgtgactccagccgtggtatgctaatatagtgaactatatggtatccaagtacataccactaggggaaaatcaatgaaagctgaagtatgaaagtcgtcatcatatatgggatgagccatacttatatcgggtctgctccgatggcttactaagaagatgtgtgccgactgaagaaggacttaagatcatagagcgatgccatgcctcaccctatggtggccattatggtgcattccgcacccaggtcaatatttggcaaagtggcttcttctggccgacaatgtacggagactcaaaagagttcgttagaagatgcacaagctgcgagaggcaaggaggaatcactgctcatgatgcaatgcccctcacatacaatttgcaagtcgaaatattcgatgtttggggtatagactttatgggacctttccctaagtcccgcaactgcgagtatattctggtggcagtcgactacatctccaagtgggttgaggctatgtcgtgcagtgccgcggatgcaaagcatggcaagaagatgttcacagaaatcatcttcccaagatttggtacccctaggatggtcataagtgacggaggttctcacttcatcgacaaaaccttccgagacctcctacgagacttgggagccaaacacaatgtggccactccttaccatccatagatcagcggtcaaatagaaacatcaaacaaacaaatcaagaatattctgcaaaagatggtcaacaaaatgggaacatgatggaaggatagattgccggacgcactatgggcataccggacagcatacaagacacccattggaatgtcccccctatcagatagtctatgggaagtcatgtcgactgttgacagtcgttatcgataagttttgaccgtcaatattatcaaaatagaggagaacttgtagtgcttgcaatgcatatatatgttagattaataatattctactagtattaggtatactaaccttttgcagagaatgaccataaagtggaggagaatcgacatcaacacaaatgataaatcaatcgggcgatgtcgagaatcagacttatgtatgaatgggccaagaacatagaattgacatgacaaactgggccaaaattcacaagtccgcggagcagaacaacggaggaggctgccagccgaaagtgggctagtttgggccagcccctggttcggctgaacctccctcgcctccgttggatccaggttttggctggacggttgagatgaagccccaatgacggtcggagggtattaccgaccattccaaccgcgataaccatcatagttcagctataaaaggagctcctcttctcacttcactcacacacctcaagcaaagctctctcatattctctcaagtttagtttagtagtatcaagctagtataatagaattagagtagaaactcaggagtccggaagccttcggaagtgttcgggtatggctctagtagcttttctcttctcttttgtaagctttgtactattattagaatactcttctatatatatttatggtattgaaatactttccgagtatatgaatgctaactttacattatgttcatgttatactaaatatactgctagcttatctgggagatgctttgctgcgggtataatgtttgcttatgcaattactctatgtcatgacgatgatattagagtagtatctggtagtttagacgtggtgtgtagattacgggatatcattattcggggttatatgctgcggatgagaggtgggctgctgatggtgacagctcagtacgggtatttctaagcgcgtgtatataatcctaagttaattccttggggagagtactcatccgtatttagccccggttgtatggtcatgacgagctgtcgtaaggaactcagcagtcaggtgtggcttctcgaagtactaggaggacatcggatagagggtattagctagtatatcgaaataactagaatgtttgtatattatgtatactagaagtatacgaatagatttcctttctattttttttcagttagcttagatattatattatgagaatgagtagcaaatgcttgtgtgtcactctaccctttgtttatcttaacccctgcttaggttatgattatcacaagtaatatataaattattagtcaagttttctctacatgatcttcccac

SEQ ID NO: 92832 - DNA, 3951 bp, Oryza sativa
acacatggcagtcctaccgatggcgacaccagggtaggcactcgcccctcgcggccccaccaatggctgccccaccgtaggccctgactcccacacaccaagaataaccactatgcagggatactgccttcgctcggctatgtactccgctaggtctatacccatacgagaagtacggttgtacgagggtcgtttcatgcttaacttcatggctcggtccttaactgaccagggacggcactagccttttccggacaccacccaagtaccccagctgccccggtcgaaaacaatgtttaattttgtttctcttttcacaattcatgttatccttgtcatggcaatgtggtgcccacgcctccacatgccgcatctcaactaccctcccctaaggtagttgtccaagcatatagcatttgataaatatgagaatgcatgattctaattagcatgactaagcatttgttcaatgtcgactaaatacacacgttagcagggtttacaatggtcatacaggtaatcaatatcaaggcatggcatacttaacaagtagggcattcatattcacatatgtatagcatgcaattttatttaaatcaacataattttcgcaataggttcaacatgctcaaagattagtgatgatcgacttgccttgatcgcagtcttgctgacccagatcttcattaactcagcaactccttcggaatctaaatttacgtgcgaaagattcgatttgaattcaattagaattcaaattaaatcaccaaaaattcaacattacaaaaataaatagcaaaagtggttccatcagcaagatgttgattttagatgaatttaggttcaagtttcattcaaatccgagctaaaatgagtgagttatgcttgtttaatgattcaaatttgaattaattcaaacaattgtgaaatggcactgtgcagccgagaggggcattattacagtggctgacatgtggggtcaccccatttctttttcctctgtttttattttctatagaaaatgtacagagtcattgacaagtgggaccggccctgtttgaccctagtcaaaaccggttctttaatcccggtgggtcccgcatgtcattgacagtaacttcataatcaatttttcttagattttcctaatctcccggtcccacatgtaatagagtaatttgcattagattaaaagatgattactgtgcactaatcacaatgtggggcccacagctcccctctctgcctttcccctttctttctctctcggtcgtcttctacctcgcgcacgcggctgaacagaggagcagcgcgcggcggtgcgacggcccgagccagaacggctcggcgcgcggtggggaaaggcaacggcgcatcaccggaaacccatcggcggcggcggcgaggcacggcggccacccgacgcgcggcgcgacggcgcgcggcggcatcgagatcgtaagaacggcggcggcgcaatggtggtcgattcaagtgcaaatgacttcgatttaaccatctagggttcacatggagtatagaaaagcaaaaatctagccgatgctacattggaacgaggtctctccacggcgagctcaaccatggcgcggtagcggccggagtcggcatggctacggcagcgcgcaccccaaatcgagggggctgctagcttctaggtgtccaggcaatgctacaggcgcgaggtcttaccacgaagtggcgaaacagcgaagttcgacggcgagtggcgcggcgcggttgaaacaggggcggacggcggtcggcgacgggcgcaggtgttcgacgctcgtcctccctcgcatagcggcctccggctccctccaacagcagtaacggcagcgcgcacaccacctcagcacacccccgccacccacactggccgagaagccctgtggcggcggcgcagccggcgctcaccaggtgttcgacactcggcggcggcgtgatcttgctcctcttcggtggagcaaaagttttagagagaggaaaagtaaatgggagattgagttcggataagaacgagccaaggtcaagtctatataagcgagagggagagcgattccttaatggataatggtgagcgatgacacggctttgtttcgatctctcccaggttctggttcagtgtacaggcgcggcatgattgcctacgcggtagtatgcaggagaggtctcgctagctggagaaaggggcgccgcattacccagcggtcgcaaccgggggtgacaagatggagacgcgacggggacgcgatggcgacaagagcgacggcgatgggcagtggtaacggcttggataggggggcgcagggctatgccctagggtgacgcggggtcgtcgtggcggctgttatccttccatcccgagggcgacgtgcgaggggacgggatgacgcgggcacccgtggcggcgcagcctttggcacgggcttttggcggcttggtcggcggcgggcccacgtggcgtggcatgacgcggtgcggcgcacgggcacgactagtgcggcgcacgagtcggaaggcaggcgcgcggcacggcagcggttggagagggcggcgtcgggtgttcggtcgggttaggcacagatcgaacacctggcgcgcaatgaacagtagcgccaggaaaagaaaaaggaagagaagagaaaggataagggaaaaaggaagggctaatctgccaaatggcttggaattgagttgtaactctatatattttggattcaagaattcaaacatttgatttgaatatttatttggttatttattagttcccaagtgaatttgcttcccactagatcatcccaaatagaaatattttaatttgcaaaattaacttaaataattggggggggggggctttgatagtcctaaaattatttaaaatattcaatgggtccagtactaatacaatagcacgttggttgaacttatttgcataacaaggtattcatgtaaattgtaattattatttagatgcgcatctttactttgatttttccattgagataatttacagtttggcaagcaatatcaaccataacatccatcatgatgcaaaagttttaaaaagttcaaaattttagtgatttttattattgaggatttttaagatgttacaaacctatcccccttaaataaatctcgtcccgagatttcttaccggtcattaaacagatgtgggtattcagtctttagaaattcttgactctcccacgtagcctcctcttctgtgtgattactccattatactttatacatgcgccaaactttggtccgggttctcttctcagcctcatctaatactttcaccggatgctccgggtaggtgagatcactactaatatgaatatctcccaatggggtttgctcctccggtactcgcaaacacttttttagctgtgacacatgaaacacagggtgtacatcggaaatattttctggcagtgctaactgataggctacttcccctcgcctggcaattattggaaatggtcccacatatctcggcgcaagtttccctttgaccttgaacctcttggttcctcgcagcggggacacttttaagtatacgtgatcgcctatattaaactctaaatctcttctccttgtatctgcatagcttttttgtctagattgtgctacttttaaacgatcacgaatcagtcgaactttctcctcagcctccttaattatatcgggcccaaatacagctcgttcaccggtttgaccacattagtggggttcgacaacgtcgaccaaacaatgcttcatttggtgacatctttaagctggcctgataactgttgttatatgaaaattcggcatatggtaggcacctttcccaatccttggtgaaatccaaggcacaagaccttcacatatcttctagcacttgatttgttctttcagtctgtccatctgtctgcggat

SEQ ID NO: 92833 - DNA, 1579 bp, Oryza sativa
atagagtcatagccagccgcggtcttgggcaatccgacgataaaatccatgcctatttcatcctacttccattccggaattttgagtggttgcaacgatcccgctggccgctgatgctcggccttcaccctctggcatacgtcgcatagcgctacgtattcggctacatcccttttcatgttgggccaccaatacgcctctttcaaatcctggtacatctttgtgctgccaggatgcagtgaatatgcaaattcatgtgcttccttgagaattaactttctcaaatcaccctgttcaggcatataaatcctctttttataccacaggattccgttctcattgattgaaaattctttggcaaatcccgcggccatacgctccttaatttctcggacctcctcattatccttctagatttcctctatctgtgttctcaaaagaggttgaatttctagtgaatttacttcaccttgaggaattaaatgtaggttgagtctagccatctcctcttgtaactcaacagctacgtttttgctgcttagatgattgcaccggcccttgcgacttagagcgtcagccacaacgtttgctttgccggggtgataatggattcccaaatcataatccttaatcaattccaaccatcgtctctgccgtaaattgagatctgactgagtgaaaatgtatttcaggcttttgtgatccgtgtatatgtcgcaatgattcccaatcaaataatgcctccatatctttaatgcatgaactacagccgccaattccaggtcatgagtagggtaattctcctcatggggtcgcaattgccgtgaggcataggccacaaccttttcctcttgcattaatactcctcataagccttgcctggacgcatcacagtaaatgacaaaatccttacggttgtcagggagaaccagaataggtgcggtagtcaatttttccttgagctgctcgaagcttgcctggcattgttctatccactcaaatttcttttctttctttaacagttgtgtcatgggcctagctattttagaaaacccctcaataaacctacggtaatattcggccaatcccaaaaagctccggattttcgtcaccgatttgggtgccttccattccgtcatagcctccactttagcaggatccactgctactcctcctgctgatattacgtggcaaagaaaggcaacctccttcagccagaactcacacttgctaaacttcgcatacagttgatgttcccgtagtttctccagcacttggctcaaatgctctgcatgttcctcctcatccttggaatagatgagtatatcatcaataaacactactacaaatttgtccaaatattccatgaacactttgttcataaggttcataaagtaagctggggcgttggtcaatccaaaggacatcactgtaaactcatataatccataacgtgtggagaatgcagtcttaggaatatctctgggcctaatcttcagttgatgatactcagaccgaagatcaatttttgagaacaccttagcccccttcagttgatcgaaaagatcgtctatccgag

SEQ ID NO: 92834 - DNA, 1568 bp, Oryza sativa
ttggctggacgactaggcggaaggcctactgtgacttcgatctcgctttggttggcttttggacagcgagacacccccctctcctcatagatggctatgagttgaagagtagtatgtcattggttcgatgttagcttgcgtgttgtatcctgttgaactgcgtatatgtgcagtccagtgcatcatttgtctgtgtaatgattgtggaactatgtggcatgttatgatattagtaatgatatgttatgttgttcatgagtttgtttcaccatgcttgctatacaaagatcacattaacgaatataataaaaagggtagagatagttaaatatttacttacctagcatgcttcaacagatggctgggcggcgccgtgcaaatgagaacccaccagaggccgatatgaccaccttggctggggttatggctgcacaaacccaactgctgcaggccattgttaacaaccaaggaggccgtggaggctcaagctttggcgagttcatgaggactaagccacccaccttcgctacggcggaagaacctatggaggctgaagattggctacgcatcatagaaaagaaattgactctggttcgggtacgcgaagccgacaaagtgatcttcgcaattaaccagctggagggaccagccggtgattggtgggacacatataaggaagctcgggaagaggatgctggagaacccacctgggaagaattcactactgcttttcatgagaacttcgtgcctgctgcggtgatgcgcatgaagaagaacgagttcagaaggtgccggcaaggaaacacaacagtgcaagaatatctgaaccggtttactcagttggcccgctatgcaacaggggatctcatagatgaagaggagaaaattgacaagttcattgaagggctgaatgatgaattgcgtggacctatgattggacaggatcatgaaagtttccaaagcctgatcaacaaagtcgttaggttggagaatgatcagaagactgtagagcacaaccgcaagaggagacttgccatgaatcgcccaactcaggaggagacttgccatgaatcgcccaactcaaggggtgcctcagcgactgaagggaaccgcttcctcgggatggaagcccaccggggccacaaccaaccgccctgctccatctagcaacttcaacaggtcggctgcaactccacctcgcacaccgaccccaacattggccgctcctagatggaagaggagtggaagttgcttcaactgtggggaacccggacactatgctaacaactgtccacatccaagcaaagctcctatccgcaccggagccaatgcgacggcagttcgcgggaccactacccctgccgccgctcgaggattattcaggacaccacagaccaaccggtctgctaccgggtttggacgcgggcaagtgaatcatgtgcgagctgaggaggcccaagacgaccagggcgtactgatgggtatgttttctatcaatactaccccagtcaaagttctcttcgattcgggcgcatcgcattcatttatatctttgaaagcaagtcgac

SEQ ID NO: 92835 - DNA, 873 bp, Oryza sativa
ggttcgcgagctactgttgtgaaacatttaccgtgccaaccacaagccagcgtgggcaatggctttatcttttgtatagcatgattcattatagtgtgccagactgtgaaggggcgagaagtccattgcctctggttttgagggggagattatgatgcaggaacggtgcactgtgatgagttgtgttgtgcgaggggtattgtcacagttcctttccgaggtaccgtggtggtgctatggcgcatggtaacatgttgtgggattgtgtcttgtgggtacagtggtacacctctgatcagagttaaaactattcgaatagctgtacccgcggttatgggtgagttgaacaatgtttttcgtgattagtcccatattattaatcaatggtaattgtgataattaatgtgactcctggtttggaatggcatattcctggtttggaggtttggtttgttcaaccggggttggttgttcatatgaggttgagcctatgcaacacgggtgtgttgtatggtgttatttaatattgcttaattattcaactgttttactattctcttaaatatttattaaatgctgtttatgcaaatgagctatattatgccatcctttgttatcctgtgcacttgcatatttgctgtgtggcttgttgagtatgtcatatgctcattcttgcaatattcaatcatcagaagaggagtatctcagcgaaggtgatgatctggaggattaagcttgttcctggttaagatgcctggaagtggagtcgccatagctgttccgtagtttgctttacttttgtttttccgctgcgtagaatgtcattctttgagaggaactatccacctctgtaataatttatgggctgcagga

SEQ ID NO: 92836 - DNA, 702 bp, Oryza sativa
aattcctgcagcccagtcccttgttgactctgctgttgctgcggctgcgggacgcgcaccacgaattgaggtcgaggcgcggagcgaggctgctgctgctgctgctgcgaggaggatccccctggatagggattggtgtagcggaccctttggttagcaccctgttgattgcggaaattcgccaagcggcgcttgtgcgactccagctccttgtgcttagcttccaagcggatgctcttgtccaccagtcgttgaaaatccggatagtccccagagactagacggacggacagctctgggtccattcctaccaggaacttctcttgcttctcctcgtcttcccgcacatcctccggggcgtaaccggccagattgttgaactcatgcaaatactccatcacggagcggttgccttgcttcaactctcggaattcccttttcttaagggccacgactccggcgggcacatgggttctccggaaagcggcggtgaagcgggcccaagtaataggctgcccctctggctgcgtagcctggaagtggtcccaccatagagatgcgggcccctgcagttggtgggcggcgaagatgactttctcctcatcgctgcactgcaccgtgtctaactttttccccacggcatgcaaccaatccaacgcatccacggggttggttggagctagagaaaggaggtggaccgat

SEQ ID NO: 92837 - DNA, 941 bp, Oryza sativa
attcctgcagccccctttgacactttgaaggacaagcttacacatacacctttgctacaacttccaaactttggtaagacttttgagttagaatgtgatgctagtggagttggcattggaggtgtgttgatgcaagatggtaagcctgttgcatactttagcgagaagttgcatggtcctgttttgaattattccacgtatgataaggaattgtatgctcttgtacgttccttagagacgtggcgtcattatttgtggcctaaagaatttgttattcactctgatcacgaatcgcttaaatatcttcgctctccacaaaaatgaccggagcaccccaaggtgaagtacttggtcgaatgtaccctttctgcagttgcttgtcaacctgcttcttgacctctgtcgcgtcccaaaacgaccctaaaatatatcctttaaattatgcctagaataattaaaatacttgtgaaagccttcaaaaattaaaatgtgcaaagttaaaagtcaattaaggcttggaggatttttgtatatttcctaaaagcctaaaatgtgtaaataaattttagtagaattttcagagcacaaataataattattaagaaataaacaaagttaaaatgattttataaaaagaaaaaccttcaaaaaaccctccctcactctcttgggccggctcggcccacttccctccccctctctccttgtcacaccctgaaaattcaaaatatataaattgttgtttaattggaatttttagaaataattttaaaagtcttgaaaagaaaatctaattttaattaataaattccaatataaaatggggccagataaaatttcattaaatactttgcttaattctataattcctagatttttctgggatttatttgagctaagaaagtatttgtaataaatggaattgcatttaagaaataatt

SEQ ID NO: 92838 - DNA, 2373 bp, Oryza sativa
cggggcgcgccagaaggcggcctcgccggcacggccgacgggaagcggcgcgcccgcgccccgatggtagccggcggcgacctccggcgcgacggagcggcggccgagagaggggagggaagggggaagcgaaggaggcggtccacggctcaccccgggacgacgaggagggcggaaacgacaaccggagcggaggaaggcggcggcgctccgacggtcggcgggcgaaacgaaggggtggacgaggttgacggggacgcggcgaagccgaaggagatgacgccgagtcgggaggaggtccggagcgacgacggcgacgaaccggagctcggcggcgacggcggagagagaggaagacggcgcgggcacgaatccgacggggagagtgtgcggcgagtggcggaaacggaggagcgaagcacgaggagcgattatatagcgtcgggagggagagagggcggccggaggggaaggaatcggccgcggaaatctcggccgccattgatgacgccggcgaggatttcgggagagattccaaacgaatccgagggagagagagagggaaaaatggggggaaagggagagggaatcgcggggaataattccccccccactttaatgcgcgcggggatggcgggatgcggcggattcggcggcggcggcggcgctagggcacgggcgggcggcgggcgcggcgcgaggtaggggatgacaggtgggccccacccgtcagcgagggtggcgggcgggcccgcctgtcagcggcgcgcgcgcggggagggagccgatgggccgcgggggagaggagagagagggagggagagttgggccgagccggcccaagaagggaagggggggaaagaagacttttagggatttttctttttataaaacctttttaactttgtttatttcttctcaattattatttgtgctctgaaaattccactaaaatttatttacgcattttagacttttaggaaatatacaaaaatcctccaagccttatttgacttttaaatttgcacattttaattgttgaaggctttcacatgaattttaattattctcggcacaatttcgaggatgtattttagggtcgttttgggacgcgacattagtactccgagtaaccaagcactctcatcacaacgtagcccctctgtcagaatagagattcaaggagtaccatttctggccaaccttattctgttagaatccaaagatcttgatgtcatcctagggatggactggttagccaaatataaaggtgtgatagattgtgccaacagaaaagtaactctcaccagcaatgatggtcaaattgtaactgttcatgcattgccctctgaacctttaaggtcgagtctaaaccaaataactttggaagagattcccatagtacgggagtaccccgatgtgttccctgatgatttacctggtatgccgcctaaaagggatataaaattcagaatagatctgataccaggaacaactctgatccataagagaccttatagaatggtagccaatgaactagcagaagtcaagaggcaagtagatgatttgcttcaaaaaggatgcatcagaccaagttcgtctccatggggagctccagtaatttttgtggaaaagaaagatcatacctagaggatgtgtgtggactatcgtgcactaaatgatgtgactatcaagaataagtacccgctgcccagaattgatgatttgttcgatcagcttaaaggtgccaccgttttctccaagatcgaccttcgatcagggtatcaccagttgaggattaaagaggaggatatacctaagacggcttttaccactaggtatggattgtttgaatgtactgttatgtcttttagacgtaccaatgcccccgctttcttcatgaatttgatgaacaaggtgtttatggaatacctagacaagttcgtggttgtctttattgatgacattctcatttactcctgaaccatagaagagcatgaagaacatcttcgtcctgcactagagaagttgcgagaacatcagttgtatgccaagtttagcaaatgtgaattttggttgtctgaagtgaagttccttggtcatgtcatctcaactggaggagttgccgttgatcctagtaatgtggaatccgtaaccaactggaaacatccgaggacagtttcagagatccgcagtttcctgggtctcgcaggttataactggaggttcatagagaatttttccaagattgccaagcccctgacacgactgcttcagaaagatatgaagtacaagtggtcagaagagtgcgagcagagttttcaagagttgaaaagtcgcctaatatcagcacccattttgattctgcctgat

SEQ ID NO: 92839 - DNA, 1360 bp, Oryza sativa
attcctgcagcccgattttgcctgatccaaagaagggtttccaagtgtactgcgatgcatccaagcttgggttagggtgtgttctgatgcaagataggaaggtggttgcctatgcaactcgttagttaccctactcatgatcttgagttagccgcagtggttcatgcgttgaagatttggtgtcactatctttttggtactcgtacggaggtgtatacggatcacaaaagtttgaagtatatcttcacccagccggatctgaacatgagacaacggaaatggttggaattgattaaggattatgatatgggaattcattatcacccaggaaaggctaatgttgtagcagatgctctcagtaggaaaggctatagtaatgctacggaaggacgacagttgccgttggagttatgcaaggaatttgaaagattaaatttgggaattatcagtagagggttcgttgcagccttagaagcgaagcccactctcattgaacaagttagagaagcccaaattaatgatcctgatattcatgagatcaagaagaatatgagaagaggaaaagctatcggtttcttggaagatgagcaaggaactgtatgattgggtgagaggatctgtgtcctagacaacaaagatttgaaagatgcaattctgaaggaagctcatgatactttatactccattcacccaggtagtactaagatgtaccagcatctcaaggaaagattttggtgggcaagtataaagcgtgagatagcggaatatgtagcagtatgtgatgtttgtcagcgagtcaaggcagaacatcaaaaacccgtaggtttgttgcagcctttgaagataccagaatggaagtgggaggaaatcggtatggatttcattactggtctacccagaacgtcatcgggccatgactctatttgggtgatagtcgatagacttaccaaagtggctcatttcatcccggtgaggaccacctattccggaagtcgtttggcggaattgtatatggcaagaattgtgtgtttgcacggtgtgcctaagaagatagtatccgatcgaggtagccagtttacttcaaaattttggaagaagcttcaggaagagatgggttccaagctaaacttcagtaccgcttatcatccgcagacagacgaacaaactgaaagggtaaatcagattttggaagacatgttgagagcttgtgctttagacttcaatagaagttgggataagattttgccttatgcggaattctcgtacaacaacagttatcaagctagtcttcaaatggctccttacgaagcactgtatggtcggaagggccgcactccgcttttgtgggatcaaacgggag

SEQ ID NO: 92840 - DNA, 1502 bp, Oryza sativa
attcctgcagcccagcatttagctgaaccaatccaatatataagtttcatgctaatcaaattataacccataggaaaataaagtcatctacagccattaattaattgggaaaggttcaccacccaatgacattcgaaaataatgcatagttgaaataaaataatagctttaaacgggttcaacatgctcaaaaggttgtttgggatctgtgtgacttgccttgagcttccgcaaacacttcggaaccttcctcgacagaaacactctcctccggaacgtcggaaactaaagcaaaaagactaaaatcaacaaaacagtacaaaaacaaacataaacagtatatgtggatatttttaacatgtagatcttgattttagaaaaatttagcaacttgaaccacctgaaacggatctacggttatttagttatgattttccgaagatttaatctattagaaaaacgggaaaaagaaaaagatgatgatgtcatgatgacatcatcaacggtggccggaccgagatggcgacctcgccggagctagggtggtcggctgcgaatttggagggtatgtacacgtagaggacgacgagacgaacccggcggtactcaccacaacgtctaccgatgaccgacgacggccggcgacgagagggtggcggcggcggctcgggttgcgtggtggcggcgggctacggcggccggcggcaaaggagaggtggcagccgggcttctccacctcctggaaaagccaaaggcggcgacgtcaagcgacggcgacggcggaggcggcggcgcggtgcggatggaggatggccagcggcggcggcgagctaggtggcggcacggcggctctaggagtcacgagagaggacgggagagggggtaaacgaaagaggaggactagggggtcctatttatagccttggattgaagagatcggactcctcccgcaaggaatcgatccgggaaatcaaaaactcggttttgaagataaactcgaaaacgagttcgattcgggcaaaatactcaaccaattgctacgattcttgaggggaaagatagaggaagatgtgaggataaaaacccccctaacaatcggactcgggatggccggattagacgcggatttgagggagaagggggcggctcgggcggcttgcttggccggccggctggctgctagaggttagggaagggtccgacatgtggggcccacatgtcggtctcccgagtggagggggcgacggcggcgggctgggccggctttgtcgcgcgggagagatgaaatgttgggccaaaaatggcccaacgactttagggagggattttagaactttttaattaaaataatttgtgaaatgttgttccaattattaaaaatacttcccttgctcaaataattcccagaaaaatctagaaatagaggaacaagaatagtatttaataaaattttatctagttcatctttatgttgaaaattttcctagattactagagtttag

SEQ ID NO: 92841 - DNA, 823 bp, Oryza sativa
ccgcctgcacggctggcctattatgccgccgttgttgggcgtctacatcttcaccgacctgcttgccttcgccgccgccgactggtgcttccgcctgcacggctggcctattatgccgccgttgttgggcgtctacatcttcaccgacctgcttgccttcgccgccgccgactggtgcttccgcctgcacggctggcctttatgccgccgttgttgggcgtctacgtcttcaccgaccggcttgccttcgccgccgccgactggtgtttccgcctgcacggctggcctattatgccgccgttgttgggcgtctacatcttcaccgaccggcttgccttcgccgccgccgactggtgtttccgcctgcacggctggcctttatgccgccgttgttgggcgtctacgtcttcactgaccggcttgccttcgccgctggcgactggtgtttccgcctgcacggctggcctttatgccgccgttgttgggcgtctacgtcttcaccgaccggtttgccttcgccgctgccgactggtgtttccgcctgcacggctggcctttatgccgccgttgttgggcgtctacgtcttcaccgaccggccgcctcgtccgccgccgactggtacttccgcctgcacggctgacttattatgccaccgttgttgggcgtctacgtcttcaccgaccggccgcctcgaccgccgccgactggtgtcaccgcctgcacggctggcctgttataacgccagctgatgctatcttcttcacggcggcctacatcgctgtcactactaataggcatcagtatcttcagggctgcaggaat

SEQ ID NO: 92842 - DNA, 5013 bp, Oryza sativa
attcctgcaccccagtgttgtttggtttagataacaatctgctaaaaaattgtttgtttttagataaataatctgctcgatatttgccgaatatatatggtgtttagtttggataatttgtagcttgggagaaaatggatggatgaacaatgcgattgtctttgcccaattggcaacggatgaaaatttgtatgacgaacggaaatatttattttttaggtaggtgtcgaaacatgaattcggcaataataaaacggggtagcgcacgagacctaaaagtggatggatgcagagacaaaggatttagacaggttcaggccctctcaatgagaggtaataccctactcctgtttggggatttgaatccgccgggtgtgtattgatctgacgatcaggttgtctcatgccccctagagggcctcctgcccaccttatatagggtggggggcaggattacaagatagaaaccttaaccaacacggtatcggcttcctaaatctactttacaatattatcaaatcaggactttaggccgctccataatataaaagaaaacgtaatacccaagtcatgatctgttacatattccatacatatatgttatcccctattactagtcggataaccatgccgtgtgggtatggggtacccataatctccacagtagcccctgagaccttcacagtcaaaaagataatcttctcccgaactagattattccaaagccgagtgcttcaatcatctttgccatgatctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaagtatgggctgcagacatattaggcctaggccaaaacatatgccttcgacaccctttaaaggatgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaaatccaaattaaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccacggaggcgaagaaaccagtcggcggcagtcaggtcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcggagatgtcagggtcgatgaagcagaggtgctggtgatgatgtcagtgacaataatccagcaaattaatgttatagctgtgtagatgcttcacttggaggagagttgatgttgttgtccaactcgtccaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgtccaagtagaaatcatgaatgttggagagcctcttgttgtagtaaaataacatggcatcgcatgccgagatgtcgaagctcacaaagacgtcgtggttggtgaagtagcaaaacttgcgaagtagcagcaatagagtttgctggtaccgaagataataaagatgaagtcgctccaccatgatgacaaagttgtgttgccgtgatgaagtgacagaagcaaactggtagtgaagacgcgcagttgtgaagataaaagcactagtcggcggcagcataaccagtcggcgacggaagacgatgatgttcatcagtagtggtagctgtctaaaccagacgtagaggtgagggcactagtcagcagcagacgtagacagcttgtgttgaagatactgatgcctattagtagtgacagcgatgtagccagccgtgaagaagatagcatcagctggcgttataacaggccagccgtgcaggcggtgacaccagtcggcggcggtcgaggcggccggtcggtgaagacgtagacgcccaacaacggtggcataataagtcagccgtgcaggcggaagtaccagtcggcggcggacgaggcggccggtcggtgaagacgtagacgcccaacaacggcggcataaaggccagccgtgcaggcggaaacaccagtcggcagcggcgaaggcaaaccggtcggtgaagacgtagacgcccaacaacggcggcataaaggccagccgtgcaggcggaaacaccagtcgccagcggcgaaggcaagccggtcagtgaagacgtagacgcccaacaacggcggcataaaggccagccgtgcaggcggaaacaccagtcggcggcggcgaaggcaagccggtcggtgaagatgtagacgcccaacaacggcggcataaaggccagccgtgcaggcggaaacaccagtcggcagcggcgaaggcaagccgcggtcgaggcgagccggtgatgatgttctgactgatccattcctggagcgtaagagataagcttaaagccatgaatctcttttatgcatatctggatctggatcctgcagaacaaacatataggatgagtagtatctgatataaatataatactcgagaaaaaatcaagcattttaaaatgtttataaatatgtatttcttctcttgtcaattgtgatttcctcgagcagatgactccttacgtttaaacactctgcccgactagtcatagtccccaagcatcgggagtcggcctaggcacttcccaaacatgcatatgagtgacatgagttcgtcattaatggaacaaagtttcacggattagaatttactactcaggtacttttgcaattattaagagcagaaaataaatttatcttatctctatgcttttgatttattccgaataatacttagcaccttgcgttactcggtccatccaacgagcccccgggtgctaggaatcggctcaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccggccgtgtaggcggaggcaccactcggcggcgacggaggcaggccggcggtgaagtcgtagacgcccaacacggcggcataataggccggccgtgtaggcggaggcaccactcggcggcgacggaggcgggccggcggtgaagtcgtagacgcccaacagcggcggcataataggcggggtgcaggaat

SEQ ID NO: 92843 - DNA, 2367 bp, Oryza sativa
agtgacaaactgacaataagattaatctatagcaacgataatatttcagtgtagacgatgttcctggtagtggaacaaggcttgccatcatcatcctctatcaacaacttgaggccttgcttcgatgtagcgcgcgaaacagcgacatatagctgaccatgtgtgaagacagggtttctgaggtatacaccaacattccccaaagttgcccttggcatttgtttattgtcattgcataacatagcctaattgggaactgccttcgctggagcgtgaaaggccactttggactgttcccacttaggacaatccatggaatacagaccagctggccaatatttgtgccagtcatgattttggactcgaaaacataatcactgagtcggatgaccatcaatcttgtctcattgcaaaggccgagtgattggttaatgttgcgaagcaggactacagctgaaccaattttgagggatatgcgatgttcctggaaattgtttatggatattgagtttagaaattctatggggtacaatagatcaaaatctacaggcttttcaagtgtatttgaaatagtgtcgctgctaagatagtcctttgcatccccaggcactttagcaagcatattatcattaatctcatcaacaactgtattgacaggacagacaattgcacgctgagaaaggtaaggaatgcagtcatagttcaattcaaaatctgggtacacagcatcaattatagctgtaatcttgtcaccgcagggagtaagcagcaactccttaggtatctctatccatgtcctctcaacctcaccttgtcttttgttcatgggagcacgaccctcaccaatgtcaagaacccatttagcaaactctgccaattcacccctggcttgctgcgacagggatggattatgtagcctcatgttagtggtaaggtgtaagacttcaacatgcttccatagtgcagacctaaccagcgaagcatctaccacatcagctcttgtacctttctcaatcaccggtaagacttgcctaaaatcaccaccaagtaaaatgggtttacctccaaaaggcttatattcattagctggttcatcagcggattgaatatctcgtagagttctatccaatgcctcaaagcacagcttgtgtgtcataggcgcctcatcccatataatcaatgatgctttcctaataagatctcctaggattgtccctctacgaatagcacacatcgaccgatcatgtatatctataggtatccgaaaccatgaatgagcaatccttccaccaggcatgagtagagctgcaaccccagaagaggcaactgcaagaacaatttcacctcttgatctcaggtttgccataatagcattccacaagaatgtcttccccgttccaccatgtccagatataaaaaaaaatacacttttcgtgatggtctatcctgtcaaaaatcttgtcatatatcatcttctggtcattgttcaagctggcatacatggacaaagattcttgatggaggctatgttggttaaagctaagatcttctaagataagcctgtttgctgcactggatcctgaacaatcaactggtgtggcaaattgtatgatgagattgataagccattatttgagaacatggcatccaactctttgagcaaggtatcctgcaacataacttctggaatagctgtgcgctgtactccaagagctttggttaacttgtaagcaaaatcatctaccatgtatctccagtacttatcaaacaaaaccctaacatcacctacatcacagtgtgctagtacagtcatgaaaaggttcctgagctggtatgaagtagcccagataactgcctcctcaaagaggtgatcccattcagcgtcatcaccaatgagaccacgtgcctgacaggcttcacgataggtgccatacagcacaccttcatatgtcctaatatcttcaaaactcatacatcctcgaactaccatgagcaacattctaaggtagaacggctcccagtacttggatggatgtgccttaatctccctatcttggttcctcttttacgctttgtccaaactttcttctcaggatcccagctaaacttggtaggaaattcacaataggtgagatccctggcaaagatgtgacgttggttggtagcaaccattcagtaagcattgttctagaggaatcagggtcttctatgacctcttcaaggtcagctccatcatggtatgtcacgaactgcatgctcggcaagtgcacaatgaggcgttcaacagaaggactccttccatggatctcaaaaccatataatctccagaatgattcacaagttgataggtatctggatttgatgtgt

SEQ ID NO: 92844 - DNA, 700 bp, Oryza sativa
aaatgaaacaagtaacataatcatcagagatcgaagctgagtaaaaaattgctcagatattacaaattacaaagagtagccttgagcatacacgtcactgcattatcatgtgtgatctctgaactatataattgatgcttgttgctgcgcatatgtttccctgaacaggtgtaataagggataaaagaatgttcctaagagtatcctggcactgatgttccaaaacaagcagatgctaacaaacaatacactaagtttctacaatctagtatgcttcgaggtaaacaaatttctttggagagtatttacaagcaaatttgtttccaaggataaaggttgtcatatagaattaagaaacattttatggagaacttttgcaacatcagcttgctctctatatatagcccggtatcaattgttaccaagtatcaatgtaattttatcccaatcatatgaagcaaacactcgctgttaagaaacagtctgttcacatgtatgaaaagtgaaaacatagatgacaaatataggtgatcaaagaatgttgaactaacctgcttaatctcagagaacttaacaagcaagtcctctggaatagaccagtcataaacatctatgttctgctttatcctttcttcggtcacactttttgggagtacactgtgacccatctgaatgttccagtgcagtgccacttgtgcag

SEQ ID NO: 92845 - DNA, 898 bp, Oryza sativa
tacatacatgaccatgcattctatcaagagagctccagaaatacacattccattgcaatctttctcatgggagatagatggagaaggaagatggcctaaagttatatattgaacatcagaagtgatagagctgcatgttcagcaatacatcttctagatctcaaaatgcacataagccccaggctcgctcaaccatacgagctggctggcaataacttgcgctaaatttcatgagctcatacatattgtttgtcgagacctaagggaatcgaaatgtgatgcatattgacatattgtcaggcaagagctaaagataatctgttgctatcctaggaccatcagttatgatcaactgatgctgatggtgaggccggtctgagagcgttactgccattctccattgtagaatcatccacaaactggctcgtgccatgtagttgctgctcgccaatttgaatgacgatatgatgtgttctccttgctacgctgggtattctggtactgacctcctgtttgcctccctgcagcatacacctgttgattgttctggttctggtgatgaactgttgtttgccgctgcgtgttatatgcctgtggatgattattgttctggtaatgcactgcagtttgccggttggtagtatacccatgtggactctgacctgacctgcttcctcctctggctggctggtgatgatgatcatcgtatgggttaggtgccacatagtcaagatatcataaaaatctgtcatgaggactcactaaggtatttgtataacggctggcactggctcttccaccaagttttgatccaacatcaggtgtgcaaagcagtgacaataatccatttcggtcagtaagcgcatgcgcatcagaaacaaacttattgctcgcgttg

SEQ ID NO: 92846 - DNA, 896 bp, Oryza sativa
cctgctcctggacaacgtccggaattcgcccagctgtacatatatgacaccgccaatgagctccagaataggcttaatatttttgatcacactgataatcctggggatgtccctgatcctgttattgtgcaagagcttatctcgatgcttgatcagttcaatcctcttgtgcagcagttccgtcttgctcgaaacaagctgctttcttcaagtgctcctgagattgctatcaagctcattgggtcaggccattctcagagtgaccgttacagccttcccaccacctctgagttggcagcactgattatacctagtgcatcttgtgaggtatcaaagtttgatgtcattgtgcagaagcattcaggtgagttatgtcagttgtcacctattcatccagcccttatgtcattgcagtacccgcttctattcccatatggtgatgtgggttttcatactggtatcaagcttagagaggtagatgatcagccacccggtagtcacgacgaagcatcgatgcttgaattttatcggtacgagtcccactatcgaaaggatgagcccaatccattcacctgttgtggtaggctttctgatcagctcgctgtgaatgctttctcatgtatagagacatctcgactcatataccatgccctcaaccagaaaaaacttcgctctgagacacatcaaggtatatctgatgctgttgctaggggagacagtgatggaaaggatgttggcaccaagtaattttgccatcaagtttcataggaggaaggcgatacatggttcaaaactaccatgattcaatggcaatctgccgttcttacggtcctcctcaaatattctcaactttcacctgcaattctaaatggccagagattattgaagctattcgt

SEQ ID NO: 92847 - DNA, 715 bp, Oryza sativa
tggcgatgaatcctgcaagcaccaagaagtgagccccacacttgaggactcggcctaatgtgcattccctgtatgagctcaacggcttcgtccaaatgcccggcacgaccaaggagatctaccatgcaggcatagtgctctgcacgaggggtgacattataatccaccatcgactcaaacagcctcttcccctcatccacgagtccagcatggctacaagccccaaggacactgataaatgtgatgatattgggtgaaacgcccatttgggtcatgtcttcaaacacctgaaccgcttcatggccaaatccatgcatcccatatccagatatgagtgtattccatgacacaacatccttccggtgtcctattaaatcaaagatatgccgcccagcttcaagacatccacatttcatgtacatcgccatcaatgcgttcagaactgaaacaagtgagtcaaaacccctccggaggatatacgcatgcaacaatttgccctgcccgagagcgttaactccagcaaaagcatgcaagatgcatactattgtgactgaattgggtacaaggtcttcatcagaagccaccatctcctggaatagcaaaatggcatcacctggtctctcgttcttggcatagcacccaatcatggcagtccacgacacaacattcctctctggcattgtagcaaacacactctcagcatagctgacgattc

SEQ ID NO: 92848 - DNA, 1080 bp, Oryza sativa
atgtctaaatgtgcgaaccggatagtgatctgtgcacatgtaattcagcgtgctaattcgagttctatgaatattaggttgcgacgacgtgccaggacaggatgcacgagattgtcgccgaggagcacaacaagggggcctccggcgaagtggcgccttggagggatgtgatggagaagagcttcgcgcggatggatggggaggtcggtaaccgggcgtccacccgcagcgacgacgagcccgcctgcccgtgcgagcagcagacgccttcgcgtcgcgaccacgcgggttccaccgccgtcgtcgccgtcgttagcccaacacaggtcgtcgtcgccaacgccggcgactcccgcgccgtcatctcccgtgccggcgtccccgtcgcactatccgttgaccacaaagtacgtatatgctcgcatcacagggccggctgagcctttcccgtccatctgcaaaaaatcgttagtttcttgtccatgagcgtgtgcctgacatggttgctacttgctacctcggaacggttcagcccgatcggcccgacgagctggaacgaatcgaggcggcgggcggccgcgtcatttactgggacggcgcccgggtgctcggcgtcctcgccatgtctcgagccatcggtgagctgatctagttttaccttcttctctcgtcgtctcaagaattttgatttggcacccggatccgaaactcacctgcgtatgggcgcgcaggggatgggtaccttaagccgtacgtgacgtcggagccggaggtgaccgtgacggagcgcaccgacgacgatgagtgcctgatcctggccagcgacgggctatgggacgtcgtgaccaacgagatggcgtgtgaggtcgtgagggcgtgcttccacaacaacggtccgccggcaccggccgcgcggccgagcggcgtgccctcctcggccgaggcggcggaaaccgagaacggaggagccgcatcggtgaaggggataagcaaggcggagtcctccgacaaggcgtgctccgacgcggccatgctgctgacgaagttggcgctggcgcggcggagcgcggacaatgtcag

SEQ ID NO: 92849 - DNA, 1441 bp, Oryza sativa
aagggaggtggcgatagctcctcactcatcggcgccatgggcaccgctgccaagaacagctgcattgacgtcgtcatcctcctcattatggcgttggccctgtccgcgcagctcgcacctgttaggcccgatcgaaatcacagcaccggctgttgctttctcctactgcccgacgcctaagcctccgatgccgcctaatccttaaaatataagtatttagcaagatactaagtacaatgacttagtaaagtggaaaaaaatatatcttgatcgtgtaaagttgtcaaggataatgacagcataattcatgctttcatctgcctctccaaaaaattgagacacgtacatgacttgtgtaaaagacaaatacaacagctggcgtaagtgaacatgctgaacgggctggtgcacacggtagtcggcaccaaggccagcgacacatgctgcccgctgctgtccggcgtcgcctccctcgcaggcgccctccttgccatccgccgaatttggctcaacaagtggtggagattgatgaaaaaaaaaagaagagaaagagatgatgaagaaaaaaatgtatttgacgggtgggtctcacttatagagaaagaagatagaaaacataacggcagtggcacgattataattttgtaaaatttcagtgacacggctacaaatagacgcactgtaataatatttatctaaaatgttatattttcaatgacatggattgaattaaacccttacatctaaacttgcgtgtcagtgtctcacaatacatcagtagtgctacagacaatctccagttccccgctgccaggaaccaatgctggattgcgggaatcaaccaaaaaatggctatcatctcgggtgatcatattactcgatctgacccgttgatctatagaatgggcggtcaaaaaacgggtccagtactccagtcatgtaccaacccttcgtcccaagtgccaactgcgcctgtccgatcggttccgatccgaccaagccacacgtcgccgaatccgaacagctcttccacgaaccacttgcccctcctcacgccctctcctcgtcggtttcgaaccatctagaagcgtcgccgccgactcgccatctcctctctaggtcaccggatttcctagccggcggcgagctcgtcggctcaggcggcggcggcggcggcgatggactggagctccgtgactgcggaggatctggtggacgcgctgcgggaggtggactggtcgacgccgccgcgccccgtctccgagttcttctcccgcttcaccgccccgcgatcctactccaagtggaccagccgcctcaagtgcaacctctactagtaagtagtacggcttctatctcgaatctacctcccacctctgtgcctctcctcacgaatcgaagaatgagtgagctagattggttggcccactgtgatttgggt

SEQ ID NO: 92850 - DNA, 2548 bp, Oryza sativa
attcatgtttgatatgcagttttgcagttacattcaatgagaaagtcacaaggacagtcagacaattttcaccacatttagcagcaaagatgaggccacccttaaggtggggatcctctccccctatttcttctataacattcttctttttttaaagagtctcagaagaacgggctaacaacattgctgatatttgcagacctgtcattcgtggccgaccaagctcaaaaagatcaattcatatttgtggccggcctcgatgggtttttgttgtattattttctgtcggttagtataaagcactgacctccatacatactattctagaccatagttttttttttataaaaaaaacaactaaataaataatgaactcaacatataatttattttatttttgcagtaagctgcttcctctggatgacctcatgtagtctccttacggttctgtgggcactaattgttgtctgcttggtaaggccaaacttgaggtttaaaattttaaaattgtgcatgtgtgcctaatatataagtttgtgccttgcagcaaccttgcttcacgccagtttcagaacacctaatctgaaagcacgcctgaacacattcagggaggaatttcgagcagtatggcggaattatagcgagttttaaacgccctttttgtctaccccatgtgagtgccttcatcgctgtcttatggtcgaaaattgaatctagcgaagggcttaaagtgctacctgttctgtcagtgcatcattgtggagctgcttattggatgtctctgcggtggtgcaatgtagaaggacctacttcagtgtgctttcgaatttcttgattttctctgcagatttatgtggtaaaaatgttaccaagttccatatctctgctgcctcttgcgactctttaattgtgggagattaaaaataggcatgctattttctccagtttatggatttggctttagattgtggattattctagtcccccaccacatggatctccatagttttagcttctggtccaaaacttctactgtattttgatacattggggaaggaacagcatgtaaaagagacagctatcctgaagagaagaaaaaagatattgttgtgaaatgcctgttatttttcatcgttcttttacagtaatggcacattttgtttcacataggtgatttccattcttttagatttctccatcaaaaagctcctcgtaggttttgtagacactctcggggtgagcaaatccatctcctctgatttgcttaacctgtccaacatgaacaatgcattttcagttattacaattccaatacaaggcctacaactacaagaaacccttggcgtatccactatacttgcattttgttcaatagtacttttttctgtactggttactaacttatcggaagttcagaactgtatgaagtttattcatccggaattgcataagatatgaagacagaagtgaaactgttttctgcacttgagacagctgaaaggttggatgcacttgcctgttcgatttcagagagcttggcacacagttcctcaggaatagaccaaccaaacagatccatgttctccttcaacctcgcctcactgacgctcttgggaagcacactctgaccctgctgaagaccccagcgcagagcaacctgagccggagttcttcctagcatctcggctaccgatggcaacaccgaatcaacggcgatgcccttcatcctgcccaatggagcatacgcctgcaagaatcatgtgagcagtgaaccacagcacaatgctactactacatatcaagtgatcgatgagctcagaaacatgcaggacttacagagagatgaacgccactggtgtggcagaacgctctgagcttcgcctgctgccagcccgggtggcactcgacctgatcaacggccggagggacgcgggcgacgcagagcagatcgccaagcttcttggaggagaaattgctcacgccgatcgcgcgagctttgcctgaatcgtacagctgctccatcgctcgccaggtgctgggtatgtcaggcttgacgaagttctctggactgagctccgtgcctttcttgatctgaaacggccaatgaatctgcagagattgcaccgttgggcacctgtcagaagcagagcaaaatggcaaacctttcactgtctacgtttacgctgatcatgatgagcttaccagatacagatcaacgtaatccagctgcagatctttcagtgtactatccattgcgagtgggacatcttcaggtgcgaggtcgctgcacctgcagagtttgggacgtcttcaagaggaagggatagaacataattcgaaatagcagaataaacttgcactactagtagcgttcagaagttgaggtcggtcaatagaaggaacaagacagcagcagtcagcaccatatcttggaggtgatgaagaggtcttcccgcttgacaaccccatcatcgaagagcttcttcagagcaccaccaatctaggagcacacacaaaaatcactctcacaagttaaaccggtgcaatt

SEQ ID NO: 92851 - DNA, 619 bp, Oryza sativa
agcagatttgtgatccactagacctccaagtcattgtatatattttatcaacatctgtacttaaaggcatggaaatcggatactaatcaatgtctgaggtaatttgaaatggaaagagaatggacagagtgaagaaaaggccttaaagaaagataaaataccctccaaatccagccctcatgtccaatacattccggagtttgaactttctccacttaaaaacacgaatataaccttcaacaatgtcatcccaaaatttggtttctgctttgaaaagctccttctttgatgagtgtgcatccatttcaacaccttcaagcctttttggtggctccattaaacgtgcaggccatggaaagggagtcagcccatcaccgttttcaggaagccggctgatacatgctttcagattgacatacctgaaagagaaatagaacataaagaatagcacaaaaaagattcatgccaaataaaacataacagcagtacaacagtccaatcaaacagtagctaaggcctctgaatgatgtagtataatctacataaccagaaaaatgaatagccattatcacagattttgttgataatatgctttgcatttatgaggttttaatggtga

SEQ ID NO: 92852 - DNA, 1571 bp, Oryza sativa
  unsure (1)..(1571): unsure at all n locations
taagcttgtttttgttattgaattcttgtcactaaatattactagtatgataatggttatttattttgcataaactaagcataatacatttcctttttttattatgatatacattgaatgaatgttttttttcttctacagacggtatctgccatgtttatattgacaaatcagctgacatggacatggcaaaacgtattgtattggacgcaaaggttgattatccagcagcgtgtaatgccatggtacttctctaatttacaaatttattagcgtgtgcccatatggtgatacctctctatttattgtacttttttttaaaaaaatgtatattacgaattgtatgtgtgttctacatcgttgctggccactcatgctaacttacaagtattgttgtcgaacttctggctaaaagcaatagttcactgtggaagatgccattctattcaagtctaactttcctatttgtccacttaanttatttcttggaaaattttatcatttgagcacagatatctaaatattttttatattctgtgcaggaaacgttacttgttcataaagatctgaacaggacagaaggccttgacgatttattggtggagcttgaaaaggaaggtaaaatccacacccttgtagttgaagtattgcagccatttgtatcttgacatgtgttctgcaaaaagtgctacttcctccgtttcacaatgtaagtcattctagcatttcccacattcatattgatgttaatgaatctagacatatatatccatctagattcattaatattaatatgaatgaggaaaatactataatgacttacattgtgaaacggagggagtatttcattttattatgagaaatgatgaacagttatgtagctcaacatcaaagatttgatgttcttaattactttcaatgcttctcaagggagcatattacagattttacttattatgttgcagtcaatccaaaattgctttgcaacacgagttcttgtgcaaatcagcaaaaggggatcagaagagcactaatggattttaattgatgtcatgttgcaggggtagttatctatggcgggcctgttgcacatgacactttgaaactaccaaaggtagattcatttcatcatgagtataactcaatggcatgcaccctcgaatttgttgatgatgtgcagtcagcaattgaccatataaatcgctatggaaggtatgcagtttttctccatactatatcctcatcactttttttttttggaagtatgcagtttttctccttactatatccccatcatttcttttttttttttttgaactaaacttgattgtgttaaatatatgttcatttcagtgcacacacagattgattatcactactgatggaaaggcagcagagacttttctacagcaagttgataggtgtttaactaatttcctttgcacaactattatgtttgccgcttttagtacataccttaattaatggagttattcttctataaattgcaacagtgctgcggtattccataatgcaagcacacggttctgtgatggggctcgctttggtct

SEQ ID NO: 92853 - DNA, 673 bp, Oryza sativa
aaagtacctgagcgtggcgacgctggtgctttccatgataaagatctggctggtgtagggcggtctgctgctgaagccggagacatgcacatcgcagaagcctaatcatcagactggagcctcaactgaaccatcccgtatctgatctgtttagataaagacagttatattagaaatcgccaataagtctcggacgaaaattcccagcatttcacaacttaagaagttcagaattctagcagctattcgtaatgcatcccattgcagtattgcataacaaattacagagatgaatatcaatctcccagctcagggcctctaaccatgacagatggtagatactctcgtatcagtgtcaacattaggtggggatattacaatattacatccatgtctggtatccacagtaccatcaccattccaaatgtgtcaggataccgttactactactgatgtgttaaacagggatccatcacaaatgtatcaaaattgtctggcagagattccaattctctccaaacaaacaactcagcaatcttttgaggtacctcctgaaagactgagtcatgatggctagtctaatcaatatgttaggctatacaacaattcctacgtcttcagtggttattctgtataaatcagtaaagctcccaaaaaacattaatagagtccg

SEQ ID NO: 92854 - DNA, 675 bp, Oryza sativa
tcacgtgaaagtaagtatgcaccaaaacttgctactccacagccaacatccagggcaactctagtgtgagagccaaatgcaatatctggtaccatctggatgaacagagagacaggtggtgctactgagagtcagcaacatgataaaattttcatcagataaaagtacaatcagcatacttgagaaatctgatccaggtattgatttgctccatggataaattgagttcctcctccaggaaatctaaatttatccttagctttactaatccaattctgccctcctttgtcatcaaccaaccgcgtgtgaggtacattgctaaaccatacctgcaattcatcaaagtgtgttatagaaactcctttacctgaacccagaggtctttgaaaaattaaaccaaatcagttggttatactccctccatttcataatataaggcacaactacttttttcagatatttcataatatgaggtgtgcatgcatgcatgcaattaaatagcacctcctctctattcaattattatatttaaatcctccacactcaagatctctaattctattgggtgcatgcattgcatttgttacggtgatccaaactaggaggtgatcgtaattgtttcttggtctttgggttaagggtggttatgccttatattttggaattttggaatgg

SEQ ID NO: 92855 - DNA, 510 bp, Oryza sativa
ccattgcctatatccagaatccaattattaaagtcattgatttctttatattctaaagtattagatttggttttttgtaatcgcatattttcaaatagaaatatttttttaacatacccccaaagatatgactttacgattgatgcattaataatttccagttttgatgcattttctataactggtaagatttgtttagggtctcctcctagaacaacaactttacctccaaatggtttatcgatagcattaatatatttttctgataatatatctcttaatgttctatcaagagcctcaaagcattggcgatttgtcattaatgcttcgtcccatattataagagaagtttctattagtaattcagctaattttgttccacgtttaatatcacataatgatagttcatctatatcaactggtattcgaaatcttgaatgggctgttcgaccatttggtagtaataatgatgctactccagacgatgcgactgttagaacaatttctttt

SEQ ID NO: 92856 - DNA, 585 bp, Oryza sativa
ccctacgtcatcttgtacaagtggaataaataacttagatgagcgattccttcactctccttggcatcaggatcgatcatattgtgtgttgcagttctgttacagcagagtactcccttcagctggtccaagccaaaaaataaacacaaccagccctgagctcctgtgacagcatctacctggcttcaagtgctgatgccgcagtctcgacagtcccaagtaagcaggtgtacaccttctgcttcagctgctcaatggtttcaaccaaagcatcttgagatttatcaacctcactatgcaactggtcgagccagttactcgtctccttcagttgcgacaaccgaaccgcgatttgcccgtctccgcccttggagtgccctcttactcgttctctggtgttcttgttttggccctcgaacttgaatccagcttcaagagcatcttccaagaaactgagaaaccatgactgtgattctttctttagaataatccatgatctggagatctccttgaaaccatcctctctggcccagtcaatcttttcacttgtgtaagcatcgtcagagttctttgccgtactacctg

SEQ ID NO: 92857 - DNA, 731 bp, Oryza sativa
agcatcttagttcaaatgtaaattaaacctacgcacttaaacgtacctgaggttttgattcttgtttgaattttgtcggagctgacttctgatttgcagaacatatgctacttcctccattacttttgtcactatctatgctggagtttagattggtaattttgctattgttgctagatatcccaagcatgtaacgtgaagctacaactgccttctgctctttgatgactaccttcctctgagagttctccttttcactttcagacagttcagctgactttgtagccttccgttgatgagccaatgcttctgaaatcccagtgggagttgacatctgcatcaaatcctttggatttccaatgcaagggttccttcctggaacaggtcgaaccccaacaagaactgggacagggatactagattggaccttttcaacatatatgaactgtccaagttgaagtttgtttgataagatgagttcattatcctccttcgataaagaaacatacgttgagtgcgacgagtctgaaacttttataaagaaaccatggtctggccaaagttctgaaccagtgattgcaggaactatgctaataacttggagaagaatggaccgatattctccacatactttcacatcagaatttatattttttagtacttttaacagtacccctggagtaagagatgccatatcttcaagccagcttactcttctgggctgcaggaat

SEQ ID NO: 92858 - DNA, 520 bp, Oryza sativa
gtagcagctgagaggtagaggatgagtagttgagttttagggtgggggatgaagaatgatgtgtgggtgggagggagaagaaggttagggtgtgtatttatagggagaagaggcgagggtttaagcatgtgagctgaggctggctaagcagcttcccctacgtgacacagaaaatgttgggaaatattacgagggaaaaaataaaccatataaattagaggtcatgcatatgccactgacaactggggcccatgcatgcgtttgactttttgcagcatataccattggctgattggctcgtccttgctgcatggccagagctctctcttcaaaccatgtcttttcatgcaagtaaaatcttttttttacgccactagaaatagttactgtgaattcatcttttttttttaaaaaaaaatcatatttattacatcctttgagcacatgtccataagtagctatcaagaaaatcggtcaaatattcccaataacatgaaaagagaaactacctagatccagg

SEQ ID NO: 92859 - DNA, 1983 bp, Oryza sativa
ggcgagccccgcgccgctggcctggagcatgtcgcgggcgaggtccaccgcgatgacgccggcgctgcaccccatgccgccgaggttgtagctgaggatgttcccgcgcatcttgtagtggttgacgatcatggcggacagcgacggcgtcgggttgaagaggctgcagttgacgacgagcacgccgacgtccttgggacggacgcggcacttgtcgaacagctcgtccagcgcggcgaacatggcggcggacgcctcggcgcggccttccttcatggtggcgcagttggtgcccggctcgaacacgcagcgcggcatgtaggactcgtcgccgatgccagacttggccagcagccgcgactggaacgccaggctatcctcgtcgaacttgcccgacttcctcgccagatcgatgaactccgccttcgacacctgcaagcaattgtccatgcaaaatcacatccttgcttacaaatcaccagctagtaccataatgcatcaaactgattacaaactgtaagtaacaagtgaaatcgaagaaatttcatgcatgcgaaccgggtaaacttggttgtttgactcaaatccatcgtgcgtgcaaggatagtgcaggttgtggtttgtgtgctcacgcaaaacatttttcgaaaagaaaatgtgtgctcacgcaaaacatttacggtttaataatacggttcggctcattgaatgtgtgtgccaagtcgcccaaccgtatttgatgacccgaccaagtgaaagcgatcgactgatcgagtcaccggctggcctggccataaccgaaagcatcctaccagctcgtcataacttcgaccctgccctgcccattcacttccaaggactggggcccaaccaaaggtgcctcctaacttgcattcaagactccaacaaaataatggtagccaacaaactgttttccaaaacttagtgatgtgtagcatataagggcctgtttagttcgtgaaaagaaaatttttatatgtcacatcagatattttaccggatgtcgaaagaggttttcagatacgaatgaaaaaactaatttcataacgcggtttcgtgaaaagaaattttttatatgtcatatcagatatttcaccggatgtcgaaggggttttcggatacgaatgaaaaaataatttcataactcgtttggaaaccgcgagacaaatcttttgagcctaattaatctgtcattagcacatgtggattactgtagcacatatggctaattatggactaattaggctcaaaagattcgtctcgtgatttcccccctaactgtgcaattagtttttgtaatttatatttaatgctccatgcatgtgttcaaagattcgatgttatgttttagggaaaaaaaattggagaactaaaccaggcctaagtctgcaaagatataactagagtttcttttggagtatctactaaggaggagcttcttatcaattttggatctaatatatcatgtaaatactttataatattcagttaatattttattaccattcctttagtcaacatagagtaatcagggaaaaaagcagtggtcaaagactttacttgagaatgatggcagtatttatactaaaagtaacatacagtacaagataacagaggcactcgggcacaaggaaaagcatctatctagtgtaaacttattaggtgtagaatcaatatatgataaatgaatttgattcatacaaaatagcactacctccgttcttttttttttgtgcaatttctaagatattgctttgaccattgcacattttacaacgttgtgttaggatataatccctccgtttcatgttataagatgttttgactttggtcaaagtcaaactgcttcaaatttaactaagtttatagacaaatatgaaaaatatggtaatatttaaattagcaaattagttttattaaattaataattaaatatatttttataataaatttatcttcggt

SEQ ID NO: 92860 - DNA, 656 bp, Oryza sativa
agtaaattttgcgaaagtaaacttggccagtgatgaaatactaatgggacatgcaaaatataaagttatgccaccacaaggtttgctctaaattttgcctatgactttgtctttttgaatacttgctgtaattggacctacatgaaaaactcttaaccatagaattgttctacaaattctcatgtatagtgatatccttcttttctatgttgtcattctgcaaatttttcagctttcagcatgtttttggcatgagttgaccatcctgtggctttcagggcttgcagtaccactatggcaagcaaataacaacttggatgttgagcataggttgtaactgttgtagttgtaccgtatactttttatacctaaatacttagttgatttatttggatcttcgtgaaccaaaaatggcctctttttttttttgcacagttgttcaatggaattaatagcaatggctgatagatggggcttaagtaacctgttcttcattgatttggtcatcattcctaacttaattcattagtcctgaatccggcatcgccaacagtacctcccagcattgggtttgctatcttcaaccaaattctaccataaagcgtggcatgagccaggaccatctcagtgccggtgagcacccacatggtgatttc

SEQ ID NO: 92861 - DNA, 883 bp, Oryza sativa
tatagggcatggttctcctggttgttttgggttgtacatgaggcactggatggtatatcagtatgtttagctctgtttgttttaactcttagggcaatggtagaaagcactgccctttttcttttggggactgcgaaaacaccacaaaatttggatcaaatgcaagcataccatattaattaagctctttcatatttgccatcagtttccttatgaaggctcttgctttctagtagtatatatgttgtagcattaggttccacataatttgtctgctagtgataatttggcattgagaccatattttcttattttgtttgttcatgaataccttcattcttcattgatcataaactttgttttcctttttctgtttttcagctgatgcaaggtccttagtctaccaagcaaggaatgaggcagctgaattccgtttcaaatggggctacgagatgcccgtagacgtatagcaaaatggtatcatgtctcatccttaagttctctatttgtgaaaatagggttgtggttgaatatatgatctttgcatttcttataacaaagtgatagctaacttttctggtttatgtttcaggatagcagacaaagcacaagtctacacgcagcatgcctacatgaggccccttggagtaggttcgtatcatcaagtgacctattgttccattggcttctgttctatagttaatgttaaaccaatcagcttggatcttatttgccctccatattcattttcttttggtatattccacagttgctatggtcttgggctatgacgaagagaaaaacgctcaactattcaaatgtgacccgcgaggtcacttctttggacataaggtatacacagtttctgtatgcttcattagag

SEQ ID NO: 92862 - DNA, 1950 bp, Oryza sativa
gggccccacgcgtcagccgcacccgagggcgcgggcggctgacggccgggccccacgcggcagccgctcggtgcgcccgaaggcagccacggcggcgcggccggcgggaggcagcgccctcgccccgatggtcgccgccggcgaccaccggcatggcggagcagcggccgagagaggggagggaaagggggaaacgaaacggcggtccacggctcaccctgagtcgacggcgacgacgaaaacggcagccggagcggaggaaggtggcggcgcggctcgggtcgacggggtcgacggcgttccggcggtcggcgagcgaagcggaggggtggacgaggtcggcgaggatgcggcgaagccgaaggaggcggcgccggggcgggagatggtccggggcgacgacggcggcggaccggagctcggcggcgacggcggagagagagtgcgatggcgcgggctcgattccgacggggaggaagggcggcgagtggcggaaacggtggaggggagcacggggatggtttatatagggttgggagtgagggagggcggccggaggagaaggaaaccggcgcggaagatccggccgccattgatggcgccggcgaggtttgcgggagtgaatccaagcgaatccgagggagagagagagggaaaaacggggggaaagggagagagaatcgcggggaatatttccccccactttaatgcgcgcggggatggcgggaggcggcgggattcgcggcggcggcggcgctagggcacgggcgagcggcgggagtgtcgggaggaaggggatgacgggtgggccccacccgtcagcgagggtggtgggcgggcccgcccgtcagcggcgcgcgcgcggggaggagtccgagtgggccgcggggagaggagagggaggggagggagctgggccgagccggcccaagagggggaggggagggaaagggaactttttagggtttttctttttataaaacctttttaactttgtttatttcttcttaattattatttgtgctctgaaaattccactaaaatttatttacgcattttaggcttttaggaaatatacaaaaatcctccaagccttatttgacttttatctttgcacattttaatttttgaaggctttcacatggattttaattattctaatcataatttagaggatgtattttagagtcgatttgggacgcgacaattattgatcaaataattactgaactgttctttgtatcatttaggaattgagctctgaaaaaatccgagaaaatttcagagagttgacttaatcatggagaatttaataaaaattaaatccatccatgctttagatttaagaaattttatttcccacatttaacttcacttgtaaaattaaagaacacttaatataaattctattattaatttattaaataatttataaatcctgaaacgaaaatcaggatgtgacaaactaccccccttacaaagaatctcgtcccgagattcggaacggctagaaagaaaaagggaataggtaaactgcagtctatcttattccataactccgataatcattctaaagctttaaagaaaactactgctgctttgaaactggtggctgagctgtaacacttgaaaacgcaactcttgaagacgcaactggcactgcattggctcctgtgacaacaatgttgttgacctgaccttgcgactgctcactagtagactgtgataacttaacagtggttgggttcgatcctgtcatgacaggcagcctcagtgaattggtgatttataataagccagatatagacgataataatcattgctgctccgtagcagcacatttgttcgcagcggtgtcaacgtcgaaggcaatacctgttggttcattccaacagcttaagaagcttgaggtggacagcatctcagcggtgtttgttgcccccatttgca

SEQ ID NO: 92863 - DNA, 647 bp, Oryza sativa
  unsure (1)..(647): unsure at all n locations
caaaaataagttatctgcaaaatcatctggtggaacaggacatttgaagcggcatgccgaggcttgtgcaaagaagcaaggaatccaactacgacagcaacaactactactaaatcctgatggtacggtacgtacgtgggagtatgatcctatggtagctcgagaaaatcttgcccgtttaattgctagacaagatttacccttgaactttggtgagagtcctgcatttgaaaattacataaaaaattctcataatcctaggtttcaagctgttagtagacaaaccacaacccgtgatttgaaaaatgtctatgacaaaggttatgaatcactgaaggaattatttagtacatgcaccttttctgtcagtgtcacctcaacatatggagtntagggctaaagagataccttagtgtattgacatttattgagatgattggcaatgcaaaaaagagtcttggctaaggtaattgatgttcacatactgggaaaatatagcagagagaatcgagaaggtattgatgagtttaaccttgcagataaaatttttgctgtaacaatggataatgcatctgcaaattctagggccatggaaattctacaaccattattttgtatttatgctcaatcatttcttctgcatcagc

SEQ ID NO: 92864 - DNA, 1706 bp, Oryza sativa
  unsure (1)..(1706): unsure at all n locations
tcaccaatgccataaaacatattgtgtcagtggttatgaaggaacatgctgaactttctcatggtcttaccaatctaggatcagtatttgacacaactggctcagccttatcctcatttaagagcttcatgcattctccattatttagtctgtggagagttaataacaaaactagttctgtgcttggtgtcaccgaattacttgatgaactcttagaggcaatttctgagctatttgctcagttctctagtttgatgaacaattttgatggagacaatcctagtaaaatgttgccagtgccttttgtcagtttgtcagaggacctacatcctgacaacagaagtagttttgttgatatggatcttgatatgactggctctggtgaagtagatcctgtcacagcaggtggaagtggaagtatgggtatctcaccacggcctttggagtgcaagctagaactagtctgtattatttcaacttttttctctgttgtgccgcttcatacctgggaagtcttgtacaacttagctgacaaagaggtcaatatcaaggtacgaagttgcagtagtatccactaaaatatccctcttgtcctttgcttcaattgtattcttggtttattatttccatttgcaggttggccaggctatcttgcttgaacttgcacanatatctctgcctcatcaagtagtttatcttctgtggtactgtcttgacttccattaaatcgtacttcaatctgtggttgtgctggtggtcttgtgagttttatccactcaggcatttatctgattttatccttttgcttcggtcatgcagctcaatcttgtagttgatatgtgggaaagaagtgcttgtacactacttagctctgcagattgtttagcacatgtccatgccttgctaaggaatttgacagctaattgtgatgttgggcataatactgatggaaggtcacaaggatgtaaagtggcatccaatgaggttgctatttgacatatgatacaatttagcatgtttctgttagccttcgctaaatatttctcttaactttataacttttgttctgtgacaacataccttcagttataggttttcatgagtgaacaccagttttactagttttatacagttggtgtctttttttaataactagctaaatacatgtgctttgctacggatgcatgcactcgtccctgtagattttagagattgactagataaccacaatatatagaaatactatcttgtagtaatatggaagtacataaggagtagttggtaagaaaatataaaatagagttggtggggtggcaaattcactgcctctaccaatctaccattgccttcttttagaagagtatagagtatagctatagatataattaaattactcaaaattaagtactatttgcagacctggcaatcacagtcaatcatgttattggatggactgctagttcttttgcacttaaatacatgctgaacaagaaatacagttagaagaaatatctaaggtgtaatttaaacaaaatcattttctgctgatgttcacttggtcagtatactccatatattatgatttttcatcatgtagtgatgtattaaagcgccatttcagagcatatacacctttcttgaacaacagcatatttatcaatattttttttttgtgtaactggatcctttctccaatatctagtagt

SEQ ID NO: 92865 - DNA, 727 bp, Oryza sativa
ataagattggtatccgcatatctggccatcccagttgagccaacacagatgaatcttgaagaaacagaacttcatgaatacttgaaaaaaaatattaagccaaacgtaaacatgaaaatacggttgccatatcaggattaagtgtgcatgcattaacagtttaaaatccactgcagttgagcataaccgctaaacattttccatagctgtgctgtaggactcacctgggtttcaatcatagagtgtatgatagattgtgggtggatcacaatttcaatgtcatcgtattcagcaccaaataaataatgtgcttcaataacttctaaaccctgtatgaatcaagtgatcattttagtgcaaatactgccaacatgacctcagtaaaattctgaaagtttactgcaaacaccttgttgaataatgtagcagaatctacagtaatcttcttccccatattccagttggggtgctttaaagcatcagcaacttttacttctttcaacttgtcaactgggccagttccttacattcatccatggatataagatggagtccaatgtccagtagaaaaacatatataacatgtatgtcagtagatttacctgaaagcaccccctgatgcagtcaaaataatgcggcgaagtgctccttcgggcaagccttgtatacactatgatagtagagggaaactgcaaatcagcatataatagaacaacagtaaactata

SEQ ID NO: 92866 - DNA, 883 bp, Oryza sativa
ccacaagataggccattgctgaaaaaaatttctccacgcaattcatttcaattgaccttagcagacagtgaccaaaaaatactgacagaactacaatggtagctggttgctatgtttacttcctgttgctaactcatcagtttggtgatagtctaaaaatgtgagataataacactgtaaagcactatgacaagagataaaagtatactgcaggcattattccaaaccatgtctcctttgtcccactaaacagaattgcttacggtaggtaacagatagtgttctacgatatggtcaaatgccagtagcccaactgttttagtcatactttgcactagctgttactagcaattgggtacacactagttgctatgcaaatacatgtactaatcatttccctgaaatacatatgtagtcttgctaatgaagacaaacatctagggcacttatgtggatcacaaattaacacacagatagacatcccatgatgcaagtttaaatgagcagattcatagtacataggctaggagaaaaagataaaataagaaagctagaactttgttggtacttgaaagctctcaaacaatacatggtaaatgcattcttgtaaaactttctcatgcttaaaatgtaggaataagaacatacagcatcttgtcgcaggtcatcatttccagattttgcgagttggcgatatttgttaccatcagagccaatacattcaataaccttcggagcattaattccattcattaccctaccacaatggaagagtcccaacagttaataaagatcaaaaggtaaatcttcagtcacaagtaatgggtaaattgcagaccaacttacataatagaatctgctagcccattaaaatgtggaaagg

SEQ ID NO: 92867 - DNA, 685 bp, Oryza sativa
ttcatctacaagatgtgcaaatgaacataataaagagtacactttaaccataaatgcattttgacttccatctgagatgactgaataagaatatatagatatttgaaaagagtagcaaacctgacgaatcaaagctccatgagaagaagataaatcctttaacagattttcagcagcaagtttcttgtccatgtctacaataaaagaacttctactcctttgcttgtctttgacgcggtcaccatttgctagagccaaaagctgagtaccaaacaacatgcttaaaatggcaaaagagatgactcttaattctagagaatgattaaaatgcactgcagctgccttcaaatacataaagtacacgtaaatgagctaattgcagagtcatgtaagtgaacaaactgagaatgtgtgccattttaagcacatatgtaagtgcactaaaatatatttcattttcaagtttagaacttatgaattatatttttagatcagttgtaatgcaaaggtatttttattgccattaaaaaaacttagaaggaataagggtagagtcaagtatagatgtaataacactaaaaatgtattttattttcaagtttgacacgtttgactctaatcttattccaagtatttttttaataacaataaaaatacctgtgcattatagcagatctaaaaacat

SEQ ID NO: 92868 - DNA, 2144 bp, Oryza sativa
cttcattagagttcacatgaaaaaaatatgaattatttttaatataaaatttttagaccgtcctgtttagggaccgaggtgacataactgaacaagttagatgacctaaacgagtgatctgctaagtttagggaccgggatgacacaatcgaacaagtttgagaacatgaacggtcgatttgcgagtttagagaccgggatgacatagcggtacaagtttagggaccggtgatggactttactctttcaaaaatttcattttcattttctatatttccttgtattacctataagtgtgaaacccttatttttattttttctatttccttatattatcctataagtatgaaagtatccttttcattttttatattttcttctatgtactactcccttagtctcaaaatataaatacttttagcaatgaatctgaacaactgtttgtccgaaatcatagctaaaatgcttatattttaagacgggaggggtatatacaaactatctaaaaagataatattagaactaacatgtaccatagtttatcatcacctcaattgtaccatagtttatcatcatctcaattgtttagctatttttaccatcctctctctttttctcactttaccagtattaatataaatctcttggagcacttgcgcaggacaccatgtgttcacccacgcactagtaagccatgctacgtaatacggttagccatgttagcagagaccaaatctcaaggtaagttttgtggtggcagaaactacttcaacttcagcaaaacatcactgcatgtttttctagttctcaagtgaactaatttgttctcccatacaatacaatggcagtatgtcacctatgtctgccgtactagggaggaggaaccgagcaacactagttacagataattacatcacatgtctataaaaccagctgtagaggcctctggcaatgatacccaaaacatgtatatatttacatattatattacatcttctcttgtgcccacatcagaaagaccaaagttaattttggttatttcttcatctcagcaggcgaacatacaccattccttggattgcagttgcagcggcgctgcagaaagtcgatcacgagttgttcttcttcgacgaagcacaggtagaaagatctcttcatccttcactggccattgacctgacactgaagtagcgaactaacacgacgaattgctactgatatctgtagcttctaccgtgaccatattacggtgtttagcttatccctgaatcgcgcgggcgagctgcccatagcgagctcagcgctcggaagcgctggaagtagtcccccagcgcgaggagccccctcgccgcctgccgcgtcgtcaggatcctgtgcatctcctgcagcgtctgctgccggagatgatctgcctgcacacacaagtcccagatgccatgatgaatgagacaatgaggcgatcggagtttttggcggttggttttggtttggtttggttacctgggtaacgaactggacgagggatctgagctgctccacggcgttggccatgtgcaccatgtaggcctcgggggagtcgaacgggtcggccgccgtcagggagtccgcgatcgtctgcttcagcttgtccatgccctgcgagagggcgtcctcgacctgcatcgaggtttgctgcaggccgcccacttccacgacctgcttgtccgtcagaggctccagctgcggtctcaaattctgatagcagaagcaacaacgagagagagagagagagttgccatcatgtcatgtaaaaaaaatcaactggcactagtggttttgaagctctggagtacatgtgtgcagtgcagatcgattagctaccttgagaacctccgatggccggaacccaccgatccacaggaagaaccgctcggtgggggtcttccacatgcccgacatgatgtagaacacgtcggagttggcggcttcctctttcatctcgaagaggcggttgtagttgtcgagcccagcctcgacgagcaacttgagctccaggtcctggtccgtcgtctgcccctgcagcagcgcattcctcagctcaccagtgttgcgattctgctcgtccacccaatggctgtacttaatctcaaaacctaaggcacctg

SEQ ID NO: 92869 - DNA, 1593 bp, Oryza sativa
tggacttgagagatcctttagaatgtaaaatttgaaatgaattcctatggtgcttcatttaaaacaaatttgtgttgttatggactacacaatatgcagatcaaatggcacaatcggttggtgccaatctatgttttagttcttatgattactctttagcaacacccccaccaatatgtgcatttagcatcatcttgccaaagtcttatgctttcatattatttgatgatgcagtttctgaatactgaataatgacactggcacaacaatctcatcgaactaatcgttgtctgcaggatccatcaagcgctggtgcagttgaacataaatctctggctgagacatatttactacaagaacctgataattctaaagacatggtacgctctcctctttagtcattgttgtggtactaatatcgatgaaatactttctaattacaaggttgatagaaataatttaatggtaccttttcaatgttaatatatctgatgttttctgttatcagggtgctaaggaaagtaaacacgatggtgttattagtacgggaacttctgatgatgggaaaattgtacttgatatcatagaggctattcatgctgctgaaagaaagcaggcagatgcagatgcttacatgtattcagaagagaaaaggaagttgaaggtttgctttcgatttcatattatgactgcttcgttatttactgcattgagtttcaacactagcatgcctttgtgatttacagtattatgttccctcttttcttctgttgaactgatgttttgtggatttgtagcagttccaaatttgacaaatgacgtttataattgattcttttgattttatactattacattttataatggtcagtactctgcttatgttttctcaggagaaatatgaaaaggagctgaaggacaccagggctcgggagctcatgtatgctgaagaggcagcaattctggacaaggtctgtgacattttatattttattatcgctagtctctttgatcatgtttccataaacattgtattctgctggatgcgaacaatgtttctcaccgaaaaaagacctgctcagctatataaatatacacagcttgacgcatacctatatctcaagatttaggtcctttttacttttcatcctctatctttaagactttgaccataggttttttaataataatatcatgaaaaaaattacataaatattcagatgccatgtggctaatatacatatatggagttttaaagttcgaagtgtttgactgcacgaataccatgacaacctacatttggagagggaaggaggagttaaaccttttcattttttctgtggatatgtaatttaaatttacacaaaaagcaaaatttttttgctctatatgccttcgcttcacttcactagacctgtatataatctctctttcctatagaatgcagatcgtgtctcttgtttatattttaatttcagattgattatttttttgtggtggttttaatcttcttttctccttttgttttgttttaggagctgaagaaagagaaattgaagtcagctgctgtgattaaggaactgcaagaaaatg

SEQ ID NO: 92870 - DNA, 2258 bp, Oryza sativa
taaggttcaaacagtatgcaatagatgagtactccctccatcccaaaaataaaaagacaaaccctgatttccgtgtccaacgtttgactatccgtcctatttgaaaaaattaaaaaaataagtcacgcataaagtattaatcatgttttatatctaacaacaatgaaaataataattataaaattttttatggacagtcaaacgttggcacgaaaacccacggtttgcctttttttttggaacggagggagtaatgactaagctaggtttattttatctataactttctttttaggtacccatgcggccatgcaacatttgcattacaggtgcaatcttgaaggtttgtcttaaggagaaatttttagcaaaaaccatgagcagaagcggaaacactaacattccactctaaaaaacgaaagccaagctcgctcacttctctgtaaatatgtactcctactagccagcatcaggatttctgatttcataaactcgacccccgaaaatcatcatcattgtacagaagaaaatttacatccgcagcaaaatcggcaattctatccaaattgtgcctcaactggcgactaaaacatcaagaatgccaagtagcttgtagctacatgccaaaaattattagctctgttaaaaggaggaaagttcagcagccgcctgacaggaatggctctggctcctatatattcaggtatttgcaatatggtcttaagatatttgtgattggactgagtaacgtaagtctgtaactcgcagatcttgttgaatactacattgatgaacaaaatcacgagaatgtgatggaagaagcataagaatggaggagagtaagcgtctgctctgctattgcacgtttccttgcctgcttcacccactcgctagctatttctgctgcttcactcccttgtaaccctctttccaaggcctccgctgctgcactcaagtctccatgtataatcaagttctccactctgtttagaagagactcaattccgtctccagattggtcctctttgatctgaaaaccatttacacaaaatttagaaatccagtttgatgttatatgacagaccactgttagtgtttatcatgcaagagggaatttttgagatcacttgactgccaaacaaattaagaacaagaaaacggaagcttgatagccagctagctgaagaaacttattctattcaatggacggttcagtgtcaggcaacaatgcaatagggaaatctaaaaaaaagtgctcaaatcaaagctggtaaagatccctagggcaaatagggccactacaagtcaaaagtggtaaggaaatacaatgcctggaatagacactactaataggtagttgaccagaaaattcagaaccagcacacaaaatatttcagtcacatcaatataaaaaagctaattgatgatcagtaagaaaacaacgtcaatttattttcaccttaatggatgaagccacatgagcaacagcatgagtcagcataccaccaccacccgctggtataaggctgaaatgcctgactgtttccttcaaggaattaaactgcaacaagaaataatgatatatcatttattctggactaattattgggtagccaagccagtttttctcagcgagcattcatgattaacaacagttaatatttggagcaggtatttaggagcaaaacaagcaagaaggtggaggcatcattagaattctcacacaatgatgaattaataatgtcgagcggtgtggcacactaagtaataaggctatgagctgtaatcatttattgcaacacaaggaacttaccttttgtttcaaatccataggggtatctgatccgtactcgagaacacttctggaattgatgaaagagccaattctaacagtgagtccttatcaataccttcaagagatttgcgcaattgatccacctctgtccggattggtgatccagtggatagagcatcttccaaagcaagagtaccctgcaagaagagttacacgttcagttgacatgaacttaggaagcctgaaagaaaaaagtgagatgataactaagcttgaaatacttggatggcatcaaagtgaggattttaccagagccagcttatgaaccgaatgacttgccgagtttcttcagatcgtgcataaaacgccatgcacaaagcatctatttgaaaaatatgcaaaaagaaaaaaagcgaaattaaaaaaatacaagcaatctgaacttccatgtattgcacaaatt

SEQ ID NO: 92871 - DNA, 1311 bp, Oryza sativa
tttaggaccccagtccatgccacaaggaggttcttcgtctgttgttcgtccgcagcgttagttcttcaacaacaatgctggcaataacatccgcaatcaagctccacgtcctgttgcagcttcgacacagcaacaacctgccaagagggagcaaggcagcaagcctatggtatgcttcaactgtggagacccaggacattatgctgacaagtgtccgaagccccgacgcgtgaaggttgtccctgcccagagcaactctgctgtaccagcatcaaaggcccgtgtcaatcatgttgcagctgcagaagctcaagatgctccagatgtgattttgggtacgttccttgttaactcagttcctgcaacagtacttttcgattctggtgctacacattcatttctatctatgagttttgcgggaaatcatgggatggaagtagaagatcttagacgtcctttgatggttagtaccccaagcaatcaagcactctctttgcaacgtagcccctatgtcagaatagaaattcaaggggtaccatttctggccaatcttatattgttagaatccaaagaccttgatgtcattctagggatggactggttagctagacataaaggtgtgatagactgtgctaacagaaaagtaactctcaccagcaatgatggtcgagttgtaactgttcatgcattgtcttctgagtttttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatagaatggtagccaatgagttggcagaagtcaagaggcaagtagatgatttgcttcagaaaggatacatcagaccgagttcatctccatggggagctccggttattttttgtggaaaagaaagatcatacccagaggatgtgtgtggactatcgtgcattaaatgatgtgactattaagaataagtacccgctacccagaattgatgatttgtttgatcagcttaaaggtgccaccgttttctccaagatagatcttcgatcagggtatcatcagttgagaatcaaagaggaagatatacctaagacagcttttaccactaggtatgggttgttcgaatgtactgttatgtcttttggacttaccaatgctcctgctttcttcatgaacttgatgaatatggtgtttatggaatatctagacaagttcgtggtggtctttattgatg

SEQ ID NO: 92872 - DNA, 1776 bp, Oryza sativa
cctgtcatcggctatgatgcccccaagacttcagctcttcttcaagggcttatcagagaaccagccgatgccggtaagaaaaggaaaaccagatcatcggctgtagatactttagccccagctccaaagaagaagatcaaaaagaaagctaaaccagctgatgatctgcctgccctagatccatctattaaacaagctctggatgaagaagaaatcggagaggatgttgatcaagctgtagccgaaataagcgatactgaaagaacaccatcggcttcacctaagcaggtccctcaaactccttctgctccaactcattttacaagagtaagaaaccttctataaccacttttgtaatcatctcactttatggccgattgctcacatacttggtaactgcagaaaaggaaggctgctgtgaagaagaaatcggctccaatgacatctaaaccagctccactggtacaataaccttaattctttcattagttaatctcagccgattttatataacacttgtctattttcaacctccttcccctcctattcaacaagcatcaagcgatcggaccccatcagctgtagggagtcatcacatagaagaagaagttcaaccaactgctccagctatcccagtaaatttcttataaccaacatatgcagatcggctatgcctatttgatctctaactctctttaaatcatcactgcaggtcttagccgatcttttcttttttgatatcagagattatcttgatgaagagacagaggttgacaacactagcaaggctctagctcctttgtctgatgatgtgaagaaaactcttgaagatatctctcatcggctagagacatcatcactagatagcctagtagtcgactgtggatcaattaggactcggcttcacgaagtttacgctcaaatcctcgatgagttagccgatatccttactacagctgtttatcttgagcaacatcaatttaagctggaaaaggccaagctgagattagccgagcatcaagagcgcaaagacattgaagcaacaatccaggccaatcggcaatttgttcatgaagaaaaagccaagctcgatcaattatctaaaggcccgatcaaatccaatattgaccggcttgaagctcgcaagatggaactcttagcacaacttcaagaatgcaatgctgaactggatctagagcacaagaggttagccgatctcccacagtctatcgaagaacaaaaagcaaggttaaaatcagctatcaagaatgttgctaatatgaccaaatctttgaaggtcattcctggaaccgacgctcaagatgcccaagccatagaagaagtagaacagattaggcaaagagctatatcggctatccagcgatacttatctgaataatctttgtgtaatatgacttggaattttgtaatcggctaagacattcggattaatatgatgtgtaagctttgctcaaaaatctcaaaaattttgcactgtattgtgatatatatatatgcccccctagttttacaatgtcaagagcattgataaaaatacgaaacaactaagggcgatataacaatatcggccattgtatatcagcaaaccacgactgattacaatagaaccactaagggcgatataacaatatcggccattgtacatcggcaaaccacaaccgattacaataaaacaactaagggcgatattacaatatcggccatctcaaggcgatgcaaatacatcggctatcatgtatcggcaatactagccga

SEQ ID NO: 92873 - DNA, 2398 bp, Oryza sativa
gtgctgctaccggtgaaggcagtcacccgaaaggcagcaactacaacaaccatggcagcccacctccacctcctcacccgcctccaccaccaccaccagacaccaactctatcctcacccaaatcctcgcccagcaggccaacatgatggctgctttcctccatcacatccaaaatccgccacagcataatgctccacctccaccaccacccccgcaacattctaaacttgccgagttcctccgcatccgtccgcctaccttctctagctccaataaccccgtggatgctttggattggttgcatgccgtggggaaaaagttagacaccgtgcagtgcaacgatgaggagaaagtcatctttgccgctcaccaactgcaggggcccgcatctctatggtgggaccacttctaggctacgcagccagaaggacagcctattacttgggcccgcttcaccgccgctttccggaggacccatgtgcccgccggagtcatgacccttaagaaaagggaattccgagagttgaagcaaggcaactgctctgtgatggagtatttgcatgagtttaacaacctggcccggtacgccccggaggatgttcgtgaagatgaggagaagcaggagaagttcttggcaggaatggaccctgagctgtccgtgcatatggtctccggggattatccggatttccagcgtttggcggacaagagcatccgcttggaagccaagcacaaggaactggagtcacacaagcgtcgcttggcaaatttccgcaatcaacagggggctaaccaaaggatccgctacaccaatccctatccagggggatcctcctcgtagcagcagcagcagcaaccacgctccgcgctccgacctcaattcgtggtgcgcgtcccacagccgcagcaacagcagagccagcaagggacccgtgcgccccgtcctcctacgccagccgtgcagcctggacaaggccgcagagacgttcatggtcagcagcgtctgtgcttcaactacttcgagcccgggcactttgcggataaatgcccaaagccgaggcgccagcaaggccaagcgcctccccgccccaacaacggtggtaaggatgtcattcggggtcgtgtgaaccacgtgactgccgaggatatgctgacaactccaggcgttatcgtgggtacgttcctcattcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgttcctatagaaatccagggaatcctttttccctcagatttgattcttctggacaccaagaacttggatgtgatccttgggatgaaatggttggctcaattccaaggagtagtggattgcgcaagacgcactgtcactctgtaccgagggccggaacaaccggttgttttctttgcgcccccaacctctgccagtagttcagaacttcatcagataggactgtcagaaatccccatcgtcagagagttcggagacgtgtttccggaagaactactcggtatgccgcccaagcgagagattgagttccggatagatcttgctccaggaaccactcctctgtacaagcgaccctaccgtatggcagcaaatgaactggccgaagtcaagaaatagttggaagagttaaaagaaaaggggtatatacggccgagcacttccccctagagtgctcccgtgatttttgtggagaagaaagacaagacaaagcggatgtgcgttgactacagagctctcaatgaagttactatcaaaaacaagtaccctcttccccggatcgatgatctcttcgatcagcttaaaggtgccactgtcttttctaaaattgatcttcgttccggatatcaccaattgcgtatccgtgaagaagatattccgaagaccgcattcacctcgcgttatggactgtatgaattcacggtgatgtcgttcggtctgaccaatgctcctgccttcttcatgaacttaatggacaaagtgttcatggaaaacttggataagtttgtggtggtctttattgacgacatcctgatgtactcacaatcagaggaagaccatcagcagcatctccgtctggtgttgggaaagttgcgggaacatcaattgtatgccaagcttagcaagtgtgagttctggttgtccgaagtcaaattcttagggcacgtgatatccgctaaaggagtgctgtggaccccgaaacggtgaccgccgtcactaattggaagcaacccaagacagttactcaggttcgcagctttttgagtatggca

SEQ ID NO: 92874 - DNA, 708 bp, Oryza sativa
ccatgatttggagttatccgctgtggttcatgctctaaagatctggcggcactatctcattgtgaatcgctgtgaaatatatattgatcataagagtttgaaatacatcctcactcagtcggatctgaatcttcggtagagaagatggttagaactcatcaaggattatgatgtgggaatccactatcatcctagtaaggccaacgtggtcgccgacgctctaagtcgaaaaagccattgcaacactcttggcgtccgtggcattccaccgaaacttaatcaacagatggaagccctgaacctaagcatagttggtcgtggattcttggctacactggaagccaagcctaccttgctcgatcaaatccacgaggctcagaagaatgatccggatatgcgtggactcctcaagaatatgaaacaaggtaaagccactggtttcacagaggatgaacatggaacccaatggaacggaaatcgggtatgcgttccagacgacagggaacttaaaacagttgatacttcaggaagctcacgaaagtccttattccatccatcctggcagtacgaagatgtacttagacttgaaagaaaaatactggtgggttagtatgaagcgggaaattgcagagttcgtggccctttgtgatgtgtgctagcatgtcaaggcagagcaccaacgaccggccggacttgggctgcaggaat

SEQ ID NO: 92875 - DNA, 660 bp, Oryza sativa
gcaggaaaggctattgcaatgctacggaaggacgacagttgccattggaattatgcaaggaatttgaaagattaaatttgggaattgtcagtagaggtttcgttgcagccttagaagcgaagcccactctaattgatcaagttagagaagcccaaattaatgatcatgatattcaagaaatcaagaagaatatgagaagaggaaaagctattggtttcttggaagatgagcaaggaactgtatggttgggtgagagaatctgcgtccccaacaacaaagatttaaaagatgcaattctgaaagaagctcatgatactttatactccattcaccctggtagtaccaagatgtaccaggatctcaaggaaagattttggtgggcatgtatgaagcgtgaaatcgcagaatatgtagcagtatgtgatgtttgtcagcgagtcaaggcagaacatcagaaacccgccggtttgttgcagcctttgaagattcctgaatggaaatgggaagaaatcggtatggattttatcactggtttacccagaacatcatcgggccatgactctatttgggtgatagtcgacagacttaccaaagtggctcatttcatcctagtaaagacaacatattccgggagtcggttggcggaattgtatatggcaa

SEQ ID NO: 92876 - DNA, 1120 bp, Oryza sativa
tgggaggctcaggtcgaggttcacacacgagttccttcagagtcagactacagcttcctgacatgccaccgtcgtgacttaccgaagaccgcgatgcaggatgcagcccgggaggccttcctccgacttagctctatccaccgagctgagttggcgagtactgagtttgctcaccacccgtttcgagaggagagcaactccgtctgcacggctcaggacacaccttgctgctacaacccgatagtgactcgactgtcacgatgggctgaggcagtagacgacttttacgaggaggctctgttagagatcaacgaccagcagaggcgtgtgggagagttagagaccgaggtgactgacctcacagtgcagcagcttcagctagaggaggagcaccaggcttggggtagtaagatagactcaatgaaggcatagctccaggtccacggcgaccggttccagcagttatctaaccagtacaatgatcgccgcgggatgatggatacacttgaggagcaggtgagagagagtcaggagcacgtcagccagctggaggagcagcttcgagcagccacggtcagcaccacaggagcttctacttccacagcagtagggtatgaccgctactccttcctcaccacaccgtacccaccagcgttccacactcttttgggagaggttggtatgctggctactgagtcagcaccttacttggtggacccgacagtgacacagccacctgccccggagattgtgcacactccactgatccctacaccttctccgcagctaggttcgagtttggagactccgatccaggtcgactccgagacagaggggaccgacaccgagcagagatcgagccagacatcactgatccttcagaggatgagacccctgttccccgcatcaccttcctcggacgccctcacaccctcagcactgcccgcaagagcacacgacccccgggcaagaagcccaagccagatccagaggccactacttctgagccgtggggactcaggtttgcctgtgccagcgaccaccctctacctgccccaggatcctgcggatggttggatgactagactggaggattattgcagcttcgatctcgctttag

SEQ ID NO: 92877 - DNA, 3190 bp, Oryza sativa
aaagtgatcttcgtagtaaaccaactggagggacccgctggtgattggtgggatacttacaaggaagctcgggaagaggatgctggagaacccactgggaagagttcactgcagcatttcatgagaacttcgtgcctgctgcggtaatgcgtatgaagaagaacgagtttagaaggctgcaacaagggaacacaacggtgcaggaatatctaaaccgattcactcagttggcccgctatgcaattggagacctcgcaaatgaagaagaaaagatcgacaagttcatagaagggctgaatgatgagttgcgtggacctatgattgggcaagatcatgagagtttccggagcctaatcaacaaggtcgttaggctggagaacgatcaaaggactgtagggcacaaccgcaagaggaggcttgctatgaattgcccacctcagggagtgcctcagcgacacaagggagccacttcgtctgggtggaagccccctattgtggcaaccaaccgccccgccgcacctagaaatttcaacaggccggttgcgattcagaatcgcacccctacaccaactctggctgcccctggagccaagaagaatgtggactgcttcaattgcggggagtatgggcactacgccaacaactgccctcatccacgcaaaactcctgtccatactggcgctaatgcaatgactgttagtggaactactgcccctgctgccggacgaggactattcaagactccgcaaactaacaggaccgctaccagatttggacgcggacaagtgaaccatgttcgagctgaagaggcctaggaagatcagggcgtactaatgggtatgttctctatcaattctaccccggttaaagtcctctttgattctggtgcatcgcattcattcatatctttgaaggctagtcaaaaacacaacttaaccctagtgggacttagaaagcctatgatagtacactcacctgggggcgagataactgtgagtcatgcttgcatagacgtacctattcatcttagggatgtggtgtttccctccaaccttatggttttgataccccagaccgtgggtgtcatattgggtatggattggttaacaaagaacagaggggtaatcgactgtagacgtagggaagttaccttgaccacaccctggggatcggatatgagagcaaccatggatcaagatcctagactaaccgaacatgccggaggcatatttaccatgctacccctgaaaggaatgcctgtagtgcaacgatttcccgatctgtttctagaagatttacctgggatgccaccagatcgtgacatagagttcattattgatctgatacccggaactgctcccatatccaagagaccttatcggatgccagtcaatgagttggaggaacttaaaaagcaaatcagagaattgcaagaaaagggatttgtacgccccagttcgtcaccttggggagccccagtgctattcgtcaagaagaaagatggtagcatgaggatgtgtgtagactaccgttcactaaacgaagtaactatcaagaacaagtatccactaccatggattgatgatctttttgatcaactcaaaggagctaaggtgttctctaagattgaccttcgatcaggataccaccaattgaaaattaggaccggggatatacccaagaccgcgttttcaacacgctatggattgtatgagttcacagtaatgtcgtttgggttaaccaacgccccggcatactttatgaatcttatgaacaaagtgttcatggattacttggacaaatttgtggtagtattcattgatgatattctaatctactccaaagatgaggacgaacatgcggaacacttgcgattggtactcgagaaacttcggaagcataaattatatgcaaagtttagtaaatgtgagttctggttaaaagaagtcgcttttctaggccacgtaatctcagccggtggagtagcaatggatcctgctaaagttgaggccgttacggaatggaaagcacccaaatttgtgactgaaattcggagttttataggcttagccggatactaccgaaggtttattgaaggattctctaagatagcccgaccaatgacacaactactcaagaaggaaaagaagtttgtgtggttagaacagtgtcaggaaagctttgagcagctcaaagaaaagctgacctcgtcgcctattttagttcttccggacatctggaaagactttgttatatattgtgatgcatcaaggcagggactaggaggagtactgatgcaggacggaaaggttgtggcctatgcatcacgacaattgcgaccacatgaggaaaactaccctacccatgacctagaactcgcagctgtggttcatgcgctaaatatttggagacactatttgattggaaaccattgcgatatctacactgaccacaagagtctgaagtatattttcacccagtcagatctcaacttgaggcaaaggcgatggctggaattaatcaaggactatgatctagaggttcactatcaccccggcaaggccaacgttgtggccgacgctttgagtcggaagagccattgcaatcatctgaggacggaagggatggctcctgagcttaaggaggaaatagcccaactaaacctacatatggtacctcatggacagataaacaacctggacattcaacctcttttgagaacccaaatagaagaggcccagaaggacaacgaggaaatccgagaggtgaaggaacgtctagttgcaggatttgcaaaggaattttcaaccgacgagaaggatgtcctatggtataaaaagaggatttatgtacctgaacagggtggactgagaggattaattctaaaggaagctcacaaatcagcatattcattacaccccggaagtacgaagatgtaccaggatctgaaggaaggatactggtggcccaacatgaagagagatgtggcagaatacgtagcactctgtgacgtgtgccaaaaggtgaaggctgagcatcagcgaccggcaggtttgctgcaaccccttatgattcccgagtggaaatgggatgagataggtatggattttattgttggattgcccaagaccgcaacagggtacgattccatctgggtgattgtggatcgactcaccgagacggcaagatt

SEQ ID NO: 92878 - DNA, 1780 bp, Oryza sativa
ttcccaagaaaattgtatctgatcagggaagccagttcacctgtcatttctggaagaaactccaagaagagttgggtcccgattaaatttcagcaccgcgtatcacccgcagacagatggacagaccgagcgtctgaaccagatcctcgaagatatgcttcacgcatgtgtcctagattttgggaagacctggggtaagagtctcccttatgccgagttctcctacaataacagctaccaagccagcatacaaatggcaccctatgaagcgcgttgtatggccgcaaatgccggacaccgctattgtgggaccaagttggggaaagccaagtgttcgggaccgatatactgagagaagctgaagctaaagtcagaaccattcgggataatctaaaggtggcacagtctcggcagaagagttatgcagacaaccgacgtcgtaacctggaattcgcagtggatgattttgtgtaccttcgggtcacgccattgcgaggcgtacacaggtttcagataaaagggaagctcgcaactcggttcgtgggtcctttccgtatcattgctcgacgcggagaagtcgcttaccagttggagctgcccgcatccttgggcaacgtgcaagatgtgttccatgtgtcgcaactcaagaaatgccttcgagtgccatccgagcaggccgattcagagtaaattgaagttcgcgaagacttgacctacgtggagaggctagtgaaaatcctggacaccatggagcgcaggaccaggaaccgggtaatccgtttttgcaaggtccaatggagcaaccacgctgaggaagaagctacttgggagcgtgaagacgagctgaaggcagtccatcccgatctcttcgccggttcttctgaatctcggggttgagattccgtttaaggggggtaggtttgtcatgtcccaaaacgaccctaaaatatatcctttaaattatgcctagaataattaaaatccatgtgaaagcctccaaaaattaaaatgtgcaaagtaaaagtcaaacaaggcttagaggatttttgtatatttcctaaaagcctaaaatgcgtaaataaattttagtggaattttcagagcacaaataataattattaagaaataaacaaagttgaaaaagttttataaaaagaaaaaccccaaaagtaccccttccctcacttgggccggcccggcccatctctttcccccctctctctctcctctcccccgcgggccattcggcctcccaccccgcgcgccgccgccgccgccaaatccgccgaatcccgccatccccgcgtgcaataaagtggggggaaatactccccgtgatcccctctccctttccccccatttttccctctctctctcgtgttcaaacgggtggatttgcccccgcaaatctcgctggcgccattgacggcggccgacctcccacgccggtttccttcctccctggccgctctctcccccttccaaccctatttaaaccctccccgcacctcctccgtccggttccacctctcgccgcccttcctcctcgccggattcgagctcgcgacgtcgctctctctccgccgtcgccgccgagctccggtccaccaccgtcgtcgccccggaccgcctcccacctcggcgccgcctccttcggcttcaccgcatcctcgccgacctcgttcacctctctgtttcggtcgccgatagccggagcgccgccgtccccgtcgaccccaggcgcgccaccgcctacctccgctccggccgcctcctccgt

SEQ ID NO: 92879 - DNA, 870 bp, Oryza sativa
ttggtggagtacattctcatcttattgcaagaatacagagagacaagaatcgtgcaggcttttctatttctcagagtgaaattatgactaccgtgtttccgctatttcagcaatacatagaaccacatcttatcgatgctcatgttggtacaagaaacatgaatttgacctatttgatatatatttatcatttatggctttccattatcatgtatttagtaacttgtttggactcacgcaatgttccttctccacgtgctttgcagcttaagattcaaaatgactttgaccctgtgctctctcctgaaagctcacttttcgtactaaaaagtaaaaaacaggtaagtttgagctttatattgttcatcttattattacgttggtgattatttatctatttttgtttcatgaataggtatcttatcaagacatattgaaagtactcgatgctagtaaagcctgcagctgtgtccagaattttactgatgtgtatctaagacttcctggcataccgttgagtggacagctgacagaaggcgagtgtattagggtccgaatatgtgaaggaagatttgcactgttaatacgagaggttagtttaccttttgcataccatttatctttgtgttttcatgagacagtcaatgacaggctacgtttttcctttgttcatttaatggtagcctataagggaaggaaattttattatccagccaaaggttgattttgacattagtgccagcactgtcgcaggacttcttaagcttgggtaagtgatatgctttatgatgttaattattaatttagctgattttctagaggtctttttattgagattgtatgttttatcaaaatgtgtaagtcattcta

SEQ ID NO: 92880 - DNA, 3075 bp, Oryza sativa
aaatattgtggaactcacatgtcagtgagtcggttaccctctctctttgccatcttctctcccttcctcttctctcgcatcgtcggcgtcgtctgtggcgacaatggatgcacctgtcccgtcgaggcgagtgagagaggtggcaccaggagctgagctcgtgggcgcacacggtggcgtacttgaaccatggtgctaggtcggtgtacaacatgagcaggtgccacctcgctgcatccagggtggctccgccacgaccacccgctcctcctccccaatcccgcacctgtgtcaccgtagcgcacctggacgatgtggccatcgctcatggttagggatggcaacggggctgcgcccgtcgggtgcgaccaccccgtacccacccccgcagcagaaaaaatcgaacgccaccctccccatccccgcacacgagtgtagatttcccccgtccccgtccccgtccccgcaacgggtacggggcacccaccgggtctccacacacaacagcaacaaccacgacagcaagccgagcagcgcagaacaagaggaagcggcgtggtcgagcacgcagtgcgcctggggccgccggtcgtcgatctattggctggcatcgaggcgcaggtgcagcacggatggcggacaaaatggggtcgcggcaggcaggcaggcggcgcagtgcagaggcggcggcggcatgtccgcgtgtggactacagcgagatgagagaggaaagaggagaaacgaggaagggaggcggctggtcaggacttaggaatgagattagggttgcgttgatttttactggagagctcttctccgcatgggccttgggccaaacaatgcatgtgaaacgaaattctgatgggccacctattaaacaagaactgcatatcagccccatgggttaacgggtacgggggcaagataacggacctgcacccgctccacccgacgggtgacacttttgcccgctaagagacccatggggacaaaaactgaaccacaaacagcccctaatagagtaattacccgtcgggttccgggtttcggggcccattgtcatctctaatttaccccaactaacggcagcaaatatattcaataaaaccagtgaaatacacagagagagagagagagagcacattatacaatttgttaacagctttgtcattgatctttgatcgaagtctctacaagtaacaacaatatatattactccctccgtccaggtatataaggtattattgcctaaaatagcataaattaagaaagagtaagcagtacaactatgaagtttgaaaaagcatctttggcacaataaacaaagtagtactggtaagtagtactttcaagtacattctttgtaattttttaagtttttggcatggatggtactccctccgtcaaaaaaaaaaaagaaatttactggatgtgacatattctagtaaaacgaatctgaacaaatgtatgtagcactaggatgtgtcacatccagtactaagttggtttttttggacggaggaagaatgaagtagtagtagtaatatcagaccttttcagcaattgattgatgggtggctggcagtcctgattgctttgggaggagacaaatccactatgggtgtgtttagttccacgccaaaattaaaagtttgactaaaattgaaagtttgaagaaaaaagttgaaagtttatgtatgtaggaaagttttgatgtaatgaaaaagttggaagtttgaaaaagttaggaactaaaccaggcctatatttgtgggcatagctagggggcaaaatcccctatacttttagacagagggagtaaattttagttagttacatgcttcaaggccaaaaggctttaactcataaaactcataaaagttatatgtagatcataatattacgccgactgatgaacccctaaaattaattatgcaggttagattttgacttagtctaagctagatgtggatatatataaaagtttgggttatccgaagtgacacaaaggtaaaaattaccttagtacaaagtagacatatctatctatctatctattatatactaaaagtccattaaacttcctacaaacgctctcaagacgccacatgggattcctacaaacgctcctaaatcgtcacgtggcaatctaataaattggtggacccattatttcttactatttaatttatcaaatctatcttaacaaaaaaaacataacccacctccctatctttcctgcccggcccacacctacaaacgctcctagatcgtcacgtggcaatctaataaattggtggacccattatttcttactatttaatttatcaaatctatcttaacaaaaaaaacataacccacctccctatctttcctgcccggcccacaccttccaatgtgtaccgtacgacgtacgtaaggtacttacatgcctcctccctcccctcctgctctcccccttcttctttttctttagttattaaaatattaaaaaattaataaatttaaaataaccataatttataaaaaatgtggttaatttttaattacacataaaactttttattcttccgtattattctatccattgtggtccattaacgattcaaaaggcaatataatctgtaatttaacttgtaagaaatatttagtttttatcatatccatgctattaaaattattatataaaatagaaaaacatgataatgtatcatttcacaaaacatgcataaataaattagatctactatacgaaaaaataaaaaacttatccatcacatggtattctaataaattagagaaaaattctgaaaaaaaatatataaccatcagttttcatttaaaatggtggacccgataatattaaccattagataaaaaataaatctccttcacccttccctcctagccggtactaaaagtccattaaatttcctacaaacactcttaagccattatgtggctttctacgaacgctcatacatcgtcatgtgatgcgataaaaaattagagaattctaagaaaaaggtaaaacatctaatacttaaactctggattcgttattttggaccatta

SEQ ID NO: 92881 - DNA, 2724 bp, Oryza sativa
attcctgcagcccatgcctccatttgctacatttatactcagtcagaatcaggcttttcatcatcagagttattactacttggctgaaggtcggtattgcggaattgatctacaacgtcacttgcaatcttgtcagccgcgttttgagcattgctgataagatcaagagcagcttcttcgcttgtcccgtctgcaaagccatcaatggcgtcaatttcaatccttgggtacaaggatttggtcatcgccaatgccatgctagctcccatacttccagctttcttgatattcttgaaatatacatccggagcaactctcagcttgtcgaagatttcggttgcgtcgagtgcactcggaccactgttattgaggaacatagcttggacgagtggtgtagcgacattagcgacttcatctcttgctccttcaagcctcttgatcttaccaaccaggacgtcaaattgagcttgagatttgattttgcggtctacaaaacacatttatgatcaaaatctactgcattaaaaagagagaagttcagattgttagctggcagtaccttcaacctccttcaaggccgagtccctttgcgcagccagtcctaccttgtctctttccagggctttaatttgtttctccatttgagccattctggcggcttgcgctgtttgaaatccaaatggttgaggatacagttacgacagcgtaaattaatggggcagatctagagattaccttttgatgaaccactcagctcgaagtttgaatcctggagctgagcaattcggtcccttaattccttctctgtctttttggcgagctccttggcctcatgtagctgatccctaactgcttcaagagttcccaaatgaggaaccagcttttctaaagttacggtcttggcctcattgcgaagatggattctctgcatgatgattcatggtttagttttgctgaagagaaaacaaagtcatcaaaggcagtcacccggaagatttacattcacaatgcgagtggcttctccaagtgccttcttcagctggcacacttcctcatcttctttttgacgatttatgacgatgccggcagcttgtgagttctcgtcccaccatttgagcaagataggaggacgagagtcatcagtcacctttatgcgaggaatttcttcttcgtcatcgcctggtggtcctgatgtatttccaagacattagacaaataagctgaagttatttaaatcggcatcacttgagaagatgagttacttgaggatgttcctagctgagcgtggggagatccttgttctttatctggagacccgatcatcgagtcgttaccagcctccggttcttgagaagttgtcgtctgcgcttcaacttcgggagtttcttgatctagacctacatccgactggtttccagtcgggggctcttgggttgttgtagtttcagttgctgccgactggtttccagtcggaggctggtcactcggattggcattatcacctgaagtatgggcgccagtcggctggctttcggcagtcggctcagaatccttggatgaacttggttctgtcacagtcggatcaggatcttttccagttggatctatgtcggatggtttcctgcaaagtgttctttcaatattcagtattatttccatgagagaagcatgtcgaagtgaaatggtaccaagaggtttatacctggaagatgttctaatctttggccttggacgactagccagttttttcctgggagtggtatgctttgggagtttattgggcgagcctttgtccccagatttgttgccgtcatcaccttcgtcgtcattaagcaccagctttctcttgcgagaacttatctgcccagtcggattggaggtttgaggttgcggatctgatctgattgtcggccctccacctccctgaacggtgtgctggcgaggagaccggcgctgagtgattggggggtcagacttcatcaatacatattcctgaatgagatgcctccacggttagttaactcaatatgaagacaagattatgttttggtcatgagttgaagatttcggatacgtacctgcggaggcagattgaatgcgttatatggcacaactggcagctgatgtgagtagctgacgacgatagcgtttgagaagattttatacattctctccttcatgattttaaaatccagagaatctggttcttcacgattaggatcatgattgccatcaaactcgaatgctgcacgggatctttctttaattggtgccagtcggcatttgatgaagtgccgagtaatctgctctccttgtaagccttgttctttgagttttagcatgcgatccatcagctccaaggcttgggctgcttcatccccaatcggaagcgagttccaggtatcttggtacaccggaggaagacaagagtactcgggaagagcaggctcaggattctgaatataaaaccagtttgcatgccaccctttgtttgaggtcttgaagggcatagagaaatacttctggctcagagtccccctcagctgaaatccggcccctccgactacacatggcttactcttgtttggttggggcttgagaaagaagattcggcgaaacagagcgaagtggggcttaattcccaagaaggcttcacaaacatggacgaaattggcgatgtggactatggaatttgggtttaggtgatgcaagctgattccatag

SEQ ID NO: 92882 - DNA, 742 bp, Oryza sativa
ttcccccatttgtatccatccatcaactctattctccaacaacaaccactagcccaccctatcaatggtagtagtacaatggaacagagcattcaagcccaccatttgtcacgccattctgacctagtgacctgccattaaagcaagcaccctgcacgtatccaatccccacccctccaaaaaaaatccccaaaatcgaaggaacgtgcgggcacggacctggaggttacgagcgagggcgtcgaagtcgatggcgtcaacgtcgctgccgtcgtcggccccggccaccgtgcggtagtcctccatggagacgatcacgacgcaccccagcaccgacgccaccttctccgccaggctgcgcccggcacaaagtgcacaacaccaccaccaccaatcagcaacagcaaccagcgcgcggcgggaaggaggggagcggcccgtacctggtcttgccggagccggttggcccgccgatgccgacggtgacgacgaggccgtccttgcgctcacgcagctcctggatcgccttgacgaggaggtagaagccgcggtcgaaggactggggatggaatccaagccaagccagcacagcggattagaacagcaaaatggaggaaggatcgagaaggttggggagggggagttaccacgtggagggggagggactggaggatggaggaggcggcggcggcggaggcggaggcggaggtgggggagggaggggaggaggggtggtggagga

SEQ ID NO: 92883 - DNA, 2035 bp, Oryza sativa
caacagctccagcaacgacaaggctgatgggtggtacctggacaccggcgccacccatcacatgactggccggcgggagttcttcaccgagcttgactctagcgtccgaggctccatcaagtttggggatgcctccggcatggagatcaagggcgtcggctccgtcaccttcaccgcaaagtccggtgagcacaggctgctcaccggagtctactacatccccgtgttgaggaactctatcatcagcgtgggacagctggatgagaacggctcacgcgtgttggtcgagcacggagtcatgacgatttgggatcgccgccgtcgccttcttgccaaggtaaccagaggcactaatcgactctacatcctcagcgcgcaggtcgcacaaccagtttgcctcgccgctcgtcgggacgacgaggcgtggcagtggcacgagcgtttcgggcacctccactttgaggccctaaagtggctcagcgccaaggagatggtgcgaggcctgccgtgccttgaccacgtggagcagctctgcgacgtctgcgtcctaacgaagcagaggcggctcccctttccccagcagacgagtttccgagccaaggagcagctcgagctcgtgcacggggacttgtgtggcccagtgacaccggccacaccaggaggacgacgttacttcctgctgctcgtcgacgacctctcccgctacatgtgggtgatggtcctcggcagcaaggcagaggctgcggacgccatccggcgcgcgcaggctgctgcagaggtggagtgcggccgcaagctgcgcgtgctgcgcaccgacaacggcggcgaattcacggcggctgaatttgcgtcgtactgcgctgatgagggcattcagcgccagtacaccgcgccgtacagcccgcaacagaacggtgtcaagcggcgcaaccagacggttgtagggatggctcgggctctcctcaagcagagggggatgccggccatattctggggagaggtggtggtgacggccgtctacatcctcaaccgctcgcctacgaaggccctcgatggcaggacaccgtacgaggcttggcatgagcgcaagccgggggtctcccacctgcgggtcttcggctgccttgcgttcgtcaaggagcttggccacatcggcaagctcgacgacaggagcaccccaggggtgttcatcggctacgcggagggctcgaaggcctatcgcatcctcaactcggagacacagcgtgtgcgcacagcgcgcgatgtagtgttcgacgaagggcgagggtgggtatgggacaaggcggtggacgatggttcgactccgaagtacgacgacttcaccgtcgagtacgtccacttcgagggagctgggggagtaggcaactcttcttcaccgagcgtgtctaccccagtccccgagcctccaccgactccgacaccaacacactctcgggccacgacttcgactacgacgagctcctcgcctacaccaccacagccggtgaccccacgcgctccagcaccaacagccactcctccgagcacgtctactccgacgccagctagtgttgagcgcaacccggtggagttcgctactccgctctcccacgacggggagcgcatcgacgcgtaccacgacggcgagcagctacggtaccgtacgatggaggatcttctcggcgaccagccggtgccgggactggtgcctcccgacctggaggcgcagttgcaccttgcgtgcgacgacggtgagcctcggtctttcgcagaggccgagaaacacgtggcatggcgtgccgcgatgcagtcggagatggacgcagttcaggagaaccgcacctgggagcttgctgaccttcctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactc

SEQ ID NO: 92884 - DNA, 8651 bp, Oryza sativa
gagcccatctccgtccccgaggccagctcaggcccctcgcagctgcctcacaccgtctattgggtgatgcagttcgacggctccctgtctcttcagggcgccggtgcgggggtcacgttgacctcgccaagcggagatgtcctcaaatacctggtccgcctcgactttcgggcaaccaacaatacggcagagtacgagggactccttgcgggactcagagtggcggctggactggggatccgccgcctcctggtgttaggcgactctcagttggttgttaaccaggtctccaaggagtaccagtgctctgacccgcaaatggatgcttacgtgcgccaggtgcggcgtatggagcgccattttgacggaatagagcttcggcacgtgcccaggcgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcgaagtccaggcctcgggacccgaggggagcgctcccagctcccttagattgattgcttggatcgctgagatccaggcgtacctcgtagataagactctacccgaggaccgcgaagggagtgaacgcgtccagcgcatctccaagcgctacgtgctggtggaagggaccctctatcggcgcgcggctaacggagtcctcctgaagtgcattcctcgggaacaaggcgtcgagcttcttgccgatatccatgaaggcgagtgcggagcccactctgcctcacgcaccttggttggcaaggcctttcgccagggtttctattggccgatggctctcaacgatgcggtcgacctggtccggcggtgcagggcgtgccagttccacgccaagcaaacccatcagccggcccaggccctgcagaccatacctctttcatggccgtttgctgtctgggggctcgatatcctgggtccgtttagacgggccccgggcgggttcgagtatctgtatgtcgctatcgacaagttcactaagtggcccgaggcttatccggtcatcaagatcgataagcactccgcacttaaattcatcaggggcatcactgctcggtttggggtgcctaaccgtatcattacggataacggcacccagttcactagtgaactcttcggtgactactgcgaagacatgggcatcaagctctgcttcgcctcccccgcccactccagaagtaatggccaagtggagcgcgccaacgcggaaatcctcaagggcctcaaaaccaagaccttcaacatcctcaagaagcacggcgactcgtggatcgaggagttgccagcggtgctctgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgtgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccttagtaggggtcgggtgtcaggtctcgggctcgggccaaccccgcaccccctcgggcgtgcagggttggccgggggctaccacatgcatatacttatcttttttctcttccgtatttcaataaaagtattttcgatttcctaaggactgtgtctgtgccattgtttcctttcgaagaatcttggcttgaattagcacgctcgtgcccgatcctgccctcggtggcccgggccggctaaaatcgccaaacggggcccagaaccgagccgtgccccggggcgtggtgaactccgggggggaatcggcaaaggcccacaatcgggtcatccataaccctcggtcaccacgttcccggcctggccagtctcgacacgtggatctccccagacactagccccgacccgcgccatttgaggctgggacctgggcacgagccctcgttcaagccaagacatagaaggaccgcggcacagaccatcctcgtctcatacacacaacgaacagagctgacacaaaaatttcttctttatttgattgcagattaaattagtttgtacaagaaggaggcccgaaggcctcggaagaagaaaggaaaaactatctaagattggcgggggcctgggggctcactttgaggctcccgggtcgccggcctcgtcgtcactgtcgtccacaccaccgtcgccgccctcctcgtcggagtcgagggcgaacgcgagtcgaggggccgtaccctcgaagctgtggacgatgtggacggtggcgtcccggacctgcgcgcacgcgtcgtcctcggttccgggagggaactcgtccagcgctgcccacggggagaagtccgggtccctggcctggtagcttgccagtacaagctccactgccccccgggcgaggtctctcgaggatgacttgatcgtctcctcgagctcctcggggagccgctggagagtcctggccatctctgagaggcgctgggcgaggcccccctggttggcggcatatttcgcgatccgcccgccccagaggcccgcctgccgcccggcgcggtctagacgggagatggcgtcccgaagcatgccgggccctacctcgcctgccaagcggagggcctcgacctccccggcggacgagtctagcgcgccctgcagctcggcgatggtgtgttcagcagctgcgaggcaggcggctagatcaccgtcgcccgcggccgccccgccgctgcgcgccctcgcgtccagctccttcgcccgcgcctcgagctcagcggcccgctgatccagtgcggccctctcggcgcgggcgccttccagatcacggcacgcctgctcctcccgcgctgcctcgcggagggacaggctgtccgccagccgctgcgccacgacctcggcctcctcgagagcttgctcccgctcggtgagcgcgtcctcacggaggcggagtgcggactcctcttcggcgcaggcggcctcgtgcgctgccagcgttgcctcccggatggcgacggcggcctcgcgacccgccagttccctctccttcgtgtccagggcacgggcgcgctcctccagcaccgtggcgcgagcctcaagggcctcttcgcgctgccgggacgcgtcgagcttcttctctagctccgccccccggctcccgtattggaggcagaggtcgtcccgcgccgcgttaaacacggcggtggcaatgagggcagtctctcgctcctcctccacctccctggcgatctccgccaggtccctacgacgggcctcgagctccgaggtgtgccagcggtgtgccttgcggcccgcctccaccatggcctccaccgagcgtcgcccctcttcgacacgcgcccacaccgcgtcgagctccgcccgctctacctgtaggacctccatctgggcacttaacccgtccaacaccgtggtgttcgcagtggccaaggcctgcagaaggggctctgcgctcggtggggcagcggaaggcatggggaagagccgcctcgtaaaggatgccgcacggctcggcccgccgatcgacgtgccgaactcagggacgtcccccgaagctggctcgtcctgagcatcgcccgatgggtcgggcccgagcggtgcgcccgcggcctcgtcgtgggtggcttcggaagtcgtcgtcgcctcgggcggagtcgggtcgggggcttggcagtccgcccgcgtgcacgcgccgcctccgtctcccggatggactcctcggcccggtggagtctggcctcctcccaagcggcttcctcagcctggcgagcccggatagcctcctgggcagcttcctcggcttcccggaggcggtttgcggcttctcgccggtcggcttcccgcctccgggcctccgcggtcgccgtctcctcggcctcagaccggccggacttggaatggcgagaagggcgcgacgggatctcgctgatgcagaagaaaaaccagaagacgaaaaacgggtgagtgaaaacttgccttgagagatgggagaatgaatatgaccgcagtaggcgcagggacgaacctgcgaggaggtcgactaaacgaccaccttgggggggagatgaggtttccccggcttggttcggtcccccctattttgcggagccgcttcttttttcgctccccctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagaagcacgaccccctcctggggtagattgttcccccctgcggctcccgcccgcgccatcgtggcctcggggggcccgctcccccgacgccccgacctcctgcatgatggtcaggatgttggcgcgctctggatcgcagcagaggggaaggaccccttgagggatgagggatgcctccacggagctgagattcagcacccgttggaccactatcctgaagtcctcagggtcccagtcccatttgcgcccctggtgggtcctcatggtgtcctcgggcccggtgtactcccaggcgccccgggcgtgccgctggagcggcgcgattcggcgacgaaggtagtcgccgaacaccatggcccccgtgagcccctgggatcgcaaaccggccaggcgatcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcatcccacttcttgcgaaggacgcagggaatgtagcggttcagcaccggcccccgcggttggaagtagcagccaccgactaccgacggtggcgacaccggctgtacggtgaagaaccaccggaacaaccggagagatgggcgcaccccgatgaacatctcgcacaggtgcgcgaagatggccaacgtcattactgcgttgggggtgaggtgcgccatctggagatcataaagctccagaacatccatgaagaaagaagagaatggcggaaccagccctgccattgcgaagggaaggaagaatacggaccaccccgggtagtgtggcgccgggcgtccctcacccagcgcaaccacctcccggccggtggcagattccggcatgaatcggcgcagcagcccgacctgcctctcgctcacgatacgagaaggcggcagcacgctaccgtcgagcggtgcggagccccgtaccataacgccggcggaggaggggtttgagagcgagtgagtgtggcgagggtagggcacaggaaacgagaagttagagcgcaagcggcgaaggcaaggggaataatggcgagaggaaggaagcgaatctcttcctcagcgtctttatacccttgccaaacgctgtgcccggctcctcgcttcccgcgcccactatctcgccccctcgtttctcgcgcccactcctccactaatcccgctcgcccgtttgcggcgcacgaggcggatgtgcggccgtggcagtcgagatgggacatatcgtgcgcgcgttaactacgctcgccgaccgatgcaccatcatcacatctccaggcgaaacaaaccggctcgtcccaattcgtgcgctactcaagtaatgtagcggtcttgaagaaagccgctcattattgtcggtcggtttttcccttgccgatgcgcgcgatttgcgaccactggattcctgtccacctgtagagaccggccccacctgtcaccaggcctgaggagtggcgtcacgcccgagcgttttcctcgaggagggcgatcgccctggcataacgccgggggctactgtcggtgacatgggaccggggatatcttgactagaggtttggggcagccgcggtcacccacgtggcctgaccccctcggggggtcgggcccgagggtgaagaggccgccccttcctctatctccccgaggggtcgggccgctcccgtttcgtccccgagggctggggcgccccgaccccctgagggtttggcgccacgtgaatgggttaggtgagcacagcggcgctcacctaaccgcgtttattgcgggttggacgagcgcatcacgccgcatttaatgcagtatagcgcaggcttatccggtccgtgacaggtcgcagtgtgtgaccggtcacagaccggtcagatcgcgggttaaggggcaacaggcggcctgacacacgccgtccaggcactcgtccctagtcggagccggcgtggggactcctggagttggcacgtcagccccagccagatacattccaggcttcatcgcaatcattgcaaggaagctattgtatgaagaagggcagacgtgtagcatgctaaactgacacgtggtggacaagaatgaccggtctgtgactggtcatacgccggtcgcgtcattggcaaacaaccgtgcttccacgttgcacctgcttcagacggagtggaggttggtatgacccatcccatcggagggtcattcaaacagcagccattgcaaatctccgcccattaatgagggaggacagggctatcccggtgtcagacaaaagtacgagccaaatcttgatcaaagtaggatgggtccccacccaaaagaagggtaggtagaaatggtatatgtggtatccccttgagatataaaaggaggaccatgcctaccaagaaaaatgggagggagaagatctgagctcgtagaagggacggaaaaaaaaagagtagggagagggtctctagagttcaaacgctctttctctccagttctttgtaactccttcatacacagatccaccagaacacaggattagggtattacgcttctcagcggcccgaacctgtctacatcgcccgcgtcttgtgaatttgctctctcgcgaaccattccacagatcaagggcttagaacctcacttagcgcccccggccgaaccggcaaaggggggcccacgcggtctcccggtgaggagccccacgctccgtcatcaccgttccaactggcggcgccaggcaacgcaatggcagtccactcacccgagggcgacacggcggggctgaagtccgcaacaccaagcggcgtcaggcggcacgtgcggctggtggacagctcgatggagttcacagcgacccagctgctgcgcggttccacagcggggatggcggtggagacatagacaaggtgggagccgtcgggtgtgagcgatagccggtcctagagcgcgatgggttcccagggagcagcggcgagagagccgccgcctcgagcgcctcgtggcaggaggagggtacgggagagaggtagaggttgagggagccgttgcgctcggagatgaagaggatggagtcggagtgggaggtgggggcgaagttgccattgtagttgacggagacgccatcggtgaggtagagctcggtggcagggttatgcggggagggcgagagggggagagagaagatattaaactcatagcggctgcggccaagggtggtgaacacgatggtgccgccgctggccgacacggcctgcgaggcgagcagcgcgccacgaggagcggcgagcaaaggagtggctatggtcgtcagactgaagcgagctaagtgagatagtgttgagagacccgcttcaggttgttggatttggggatttgttttgcctatttttcgcggcttccattggtgatggtgtgactacagagctctagatatgcacaaacaactcttttttttctttttttttgttaatggctttcaacatgataaaagtccacataaaaatcgaaccatttctagctaatcatgtaaaaaactttaggtgaattttaatcccattgtttgccgcgtgattttttttgtttgttttttgcattggctccttgacggttggagattggggaggcgagcttcgtcatccggtgtggtactgtggtgtcctactcagcttttgctactaaggaagaaagacctgatagcaagcagccaagcacactcaccctatctctacttagatgcacactcgactatgactctgaccatctccatagacatacaccgtttgctacttaaaaaaatataatcgtaaatataaacacatgtgttaattcttatgaattatagagaaattcattctattatagcatagaatgatatagtatgatataacctttgttataggattgtaagtcgttttacttttctggtaaagcgactctatggctggtgaagttttgatggtgattttacccgggtaagaacacat

SEQ ID NO: 92885 - DNA, 2842 bp, Oryza sativa
tcgtgttgcccgccggtgtcgattcgtttccttcgaatcggtaccgatccagatcgggtgatttttctaaaaaaaataataaaaaaaagagcctcttgctgcctttcctgtgcagttgcaccagcgtttgggtgtttctccgaggctgttaaaaaaaagaaaagaaaagaaaaacaaaagaaaagagagagagagagaggttcctgttctttcgcttgttgccgctttcatttgcgctctcgccgtcgcccgttgctccgtgccaatgtcatctctatcaggcacagtttcagttcctcgttgcccagttatttttgatggcatcaactataatcattgggctcagcatatgcgtctacatatgtgtggtcaacgcctttgggacgttctttttggtgagctagcttgcccccctttccccttggctcaagctatgcctactttttcagctcagactactgatgaagacagagcaaaggcacaagaggagtatgatgatgctttggaaacttatcagggtcagtatgttatgtacaagacttggttggatgaggatgcttgtgcttctgctattcttgtagctagtatggaggtccatcttactggtgatgtggttacccttgcttcagctcatttcacgtggacacaccttcgtgaccgttatgcacctactggtgatgctctatatcttgctatggtgcgtcagaagcagtctttacagcagggagatgctacaggggatgagttctatacacagttatcctctgtctagcgccagcttgatcctttgggacctgatatttgtcgtacttgtcagtgttgtcagcgccagtggtctcacatggatcttcgccgcatctatgacttcctcacacgtcttcgctctgagtatgagtcgatccgtgcacagttgcttgctcggcacccccgtgttactttgatggaggctctaactgagattcattctgaggagattcgtcttcgtgaagcgggtattatatcgcatccttcttcagtactcgttcgtaccacagcttcagtgtcttcatcatcagcagctccttcctttactttaccagcacatacttcttctcaagtggtatcatcttccagtggtcatcttcattgcacttactgtgatcgagatggacatgtggagtcattttgctttaggaagaagaaggatttatggcgcagtcgttcttcatcggttgctgggagttcttctcagaagagtactcgctcttcttctcagaagagtactggcagttctgcagttctgatacacaggagatccttatgttactgcgttgcctcactgcttctgcttcgacaggtttagctagtttagttgctttgccctctgcacaatctgatttggttgttcttggttctcacttttcggtggattcttgattctggtgcttctttccatatgccccttgataagtctgtcctttcatctatatgtcatcctttagtccctattactgttcaaactgccgatggtacccctctttctgttgttggtcatgggactctttcatcttcttgtagtgttccttttgtttcctatgttccaaatttgaccatacagctcatgtctgctggacagcttgttgatcatgattgtcgtgttattcttgattctgactcttgttgtgttcaggatcgacgcatgggtctcctggttggtactggccctcgccgccatgattctcagcatctttgggagcttgactggcttcgtcttccttccgctgcgcttaccagtcttcttgcttctgctacctcccctaaaccctcttactcaagtctatagtcgtcgccctcgtgttatggagccttctgttgatgcttctcctgttgctcctccgagatacaatcttcgggatcgtaatttagttacgattcgtccagaggatcgctatggttatgttgcgactgttctcgctgagcctagttcttatcgtgatgctgttattcatcaagaatggcaacatgcaatggcagaggagcttgttgcacttgagcgtactggtacttgggatcttgttccattgccatctcatgttcgtcctatcacgtgtaaagggatctttaaggtcaagactcgctctgatggaactcttgaacactataaagctcgccttttagcgtgtggttttcaacaagagcatggtcgtgattatcatgagacttttgctcctgtggctcacatgaccattgtttgaactcttgcagtagcctctactcgtcattggaatatctcctagcttgatgttaaaaatgcttttctcaatgggggattgcacgaggaggtttacatgcgaccacccctaggatattcggttcctgagggtatggtttgtcgtcttcgcggctctctttatgggctcaagcaggctcctcgtgcttggtttcaacggtttgcttctgtagtcactgctgctggtttttcggctagtgctcatgatcctgcactttttgtccatacttcgcctcgtgggcgtatcattcttcttctctatgttgatgatatgattatcactggcgatgatgctgattttattgcatgtctcaatgctcaatttctgatgtctgatcttggttctcttcgctattttctagggattgaggtttcctctacccacgagggtttttatctttcctagaccaagtatattcaggatcttctggatagggcttctctcactgaccaacgcacgattgacactcctatggaacttaatcttcatctttctgccactattggtgtgccattagctgatcccacttgctatcgccatctcgtaggagtcttgtttatcttgctgtcact

SEQ ID NO: 92886 - DNA, 761 bp, Oryza sativa
aagactgattggaaaaaaacaacccatgctcaagcaagccaagcatgtccataaagcatttagcttagggtttcctattgatcaaattcgttaagaccctattgtatttgaaatttcctgtggagaaaacagtctcaagttgtgaattccttctggaatatttttaatagggtgtgttatgctgggttacctggaatatgtactgaatgctggaaagaggtatccaaaagaatgaaagagaattagtgcctgcttacgttagcagtcatgattactgcttaatgatatttcctacttagttgcttcttttatcatcacataagactagttagaaactgtcttatctatttgaactttgcctgcataagagatattatagcattaaaatgatttaatgggagcacttatggaacttgattaattgccctttcaggtatgtcccatctgtgctacaagggttggagtggacttgataggtcacttgacaatgcagcatggaagttactttaagatatccttttttcttctctataatgctggcaatgaacatatgcaattttacatttttacatcatattcagttgaagatacatggcattattggtacttgggaaaacaactgcacatggctttccttaatgaataatacatgcaacgcaggcgaagagtccgaaaaatatcttcagggtccattctttgttgtctttgttgagaaaggacttaagagatggcagtctgcagtcctttcttggtggatcatc

SEQ ID NO: 92887 - DNA, 3226 bp, Oryza sativa
ctagtagattggtcagaggtctgacgattgtagaatagtcctcgatgaaccttctataaaagctggcatgtcccaagaagctgcggattcctttgatgttcacgggaggaggaagctgatctataacatcaattttagcacgatcaacttcgattcctcgttcggacactcgatgaccaagaactattccttcacggaccatgaaatggcacttttcccaattaagcaccaggtccttttcttggcatcgttgtaagactttgtctaaattctgcagataatgaccgaaagtctttccatagaccaagaagtcatccatgaagacttccatgatgtattcgatcatgtccgagaaaatagacatcatacatctttggaaagatgcaggagcgttgcacagtccgaaagacatcctacggtatgcataggtgccatatggacatgtgaacgtagtcttactttggtcctctggatggataggaatttgatgatacccggaatacccatcaaggaaacagaaaaaggaatgatttgccagccgttccaacatttcatcaatgaagggtagcgggaaatgatccttttttgtagccttgttaagtttcctgtaatcgatgcacatcctccattcggttacggttcgttgtggaattagttcattttgagcatttgcaacgaccattatccctcccttctttggcacaacctggactgggctaacccactcactgtatggtacgggatagataatcccggcatgcaggagtttcaagacttctttctttacaacttctcgcattgcattattgagccgtcgttgaggttccctagagggagtactctcggggtcaataggaatacgatggatgcagagcacgggattaatccccttaagatcttgaagcgagtagccaagaacagaacaatgcttttccaacacggcgagaagacgttgagtctcgtcttcaaagagcttgtcactgattatgacaggggcctctctgtcatggtgtaagaaagcataatgtaggcttgggggtagaggtttaagctcaagcggaggccaaggtggtggttccatgatcggcaggtcgagagtctcaccgggatccgcttcctctttgatgaaatcagggacctcatcttccagaagggcctcgggagactcgtgagggggaactgcaataacctcttccgttgactcaatttctggcagagggtctgtcaagacgatccttgcccgtgagaatggaattgaaaattcagtctctcccagtgttattttgaggctatctaatcggggtgtgttgatgagaagttgctcaattggcagcccgattaggatgtcaaaatcttggatttcaaagacgtggaaatccaagatcgcctccttgtcttcaaagcagacaggcacatcttgcataatcccaaatcttttgatgatatttccgcttggatgtttgaagaatttgtttgtcggggtcactgccttatcgcttaaataagcaaatgcaaaagacccggaaacgaggttggccccgacagttggactgtagagaatactgacgtcgttcccttccagatggcaaggaatgattcggggagcggtatttatccgaattacttcggatgaaagctctgcctcccttaaccattcatcgctcattatggttgttaactcccggatagtttctcgtaggaacctgagttccataggatcgggaggtggcaaaggaacgagtggtttcctcttgctaaaatagttcaaggtattgccatagtcttcatcaaaaccgtccttgaacaggattgtggcacaatccggagtctgaatttcttcattctcgacggacggctgctcaggaaccttctcatcaatcgagctagcgaaagtggatggttcagcaaggggctcgatcgttagaggttcctctatcttggacacggatgcctccggctggggttcattgggttgcgtcatgaaggaagtattttctagaatgcggtccaaaattttctttccttctgacggtgttttgtgcatgaacgattgacggagcgtggggctcctcaccgggagaccgcgcaggcccccctttgccggttcggccgggggcgctaagtgaggttcttcgccctcgatcaatctggagaatgttcgcgagagagcaagtgcacgagacacgggcgatgtagacaggttcgggccgctgagaagcgtaataccctactcttgtgttctggtggatctgtgtgtgaaggagttatagagagccggagagctagagagttcaggctccagaacccctctagcctcctttttttctttctcccccctttttggtgggcaaggtcctccttttatatggtgggccggaaccttgggggccaacggacgttccgaaggctcgccacaaaggctcgacagccggcaccgccaaccggggacacggggggctggcccccgtgcccggaccgaagtggcgctccggacgaggaagcgccctccgatgcgtgggcagcacggcgatcattgcgccggccctcgatattgaagcgggcatctggccccctacgcacatcttcttgggttggaggcgttgacgagggaatggcggacgaacggcgggtaacggccgccgctcgccgcgccctccgcctcgacgacacggagccagcagtagcaacgccagtggccttggtggcggaggaccgccagccggcgcctaggcgctgctgcgccgtcatgaccaaattggccacgtcatctagccaacgttgggttggagtctctggatcagggatgacgggcgggtgacgcaggagcgcgcccgcagcctggagcgcgccctggggcgtgctgccatcaccgtagatgaggagacgacgctccccgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccgtcgtcaccgctagcgctcggagagagattgtgcgccattgcccgttcggccatggggctgagcgggagaagcttggcacacacgaaagagaacgagggcttagaaagacacacgcgccccctacctggcgcgccagatgacggagcgtggggttcctcaccgggagaccgcgcaggcccccctttgccagtt

SEQ ID NO: 92888 - DNA, 1758 bp, Oryza sativa
cgggcagagggccagctccggtcgtcgggggcctcgggccaccgttcggctcgggggcctctcctccctgctctctcccgggtcgagtcgacatagggtggggatgcgcggagcgagggtcgtcctcgtcgcgctccacgaccaacgccgcgctgaccacctgcggagttgccgccaggtagagtagcaacggctcatctggctccggggcgaccaggactgggggagaactgaggtacgccttcaactgagtgagggcccgttcagcctcctccgtccagataaacggcccgtagcgtttgaggagcttaaataggggtagcgccttctctcccagcctcgatatgaaccgacttagggcggccatacagccagtgacgcattgcacatccctaagcttgctggggggcgcatccgctctatagctcgtatcttctcggggttggcctcaatgcctcgggcagagatcaagaacccgagaagcttgcccacaggcacgccgaacacgcacttgtcggggttcagctttatgcgggcggtgcggagactttcgaaagtttccgctagatccgagagtaaggtctcctggttgcgtgttttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgtgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcactttctgccggaccggccttgcgcccggccgtacggcgagacggtgctcaatcacctccctggggaccccgggcatgtccgccagtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcacacgtgatcatccgctgcctcggggcggctgggacggaggtgctgagcctctcgtcgccacccgcgggcttggatgccgcggcgaggtggtccgcgcgctgctccatgcaagcaagcgcgactttgaggtcaccatggacggtgatggggccaccggggcccgacatcttcatctggagataggcgtagtggaccgccaccatgtacttcaccaacgcaggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgatcggctgggacggccggagcaccatccccggggccttgatggcgtcaaaggcagcggaggaaaggatgttgagggctgcacccccgtcaatgaggacacgccc

SEQ ID NO: 92889 - DNA, 10363 bp, Oryza sativa
tcccccatcaacggtggcgacggtggcctcagctcctggaaccctaggtcatcgtcgccatcgttgatgtcctcggcgggggccttctgcttggcctcacctcgccggttgccggcgggagccgccggggtattgccctcacggcgctcctgcctcctctcctcctcccacttcctcgtccgctcagccaaacttttgaccgcgcggcagtccacgaggtcgtggagggaggtgttgtgcacggtgcaccacttgccggtcgggcgctccctactgggagcgccggcctccttttttttgtcgctcgcaggcctcccctttcgggtggcccgcgaagcgccctcgacggcgaggacgtgaccctcgtcgtcggaatgggccgacctcttcttcctcctcctgtcccgccgccctgaccgagcagtgggcccgggggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgcccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacctgggcgcggatatgtgccctggaagttcatggtgaactgctggcacaaatcctcccaagagtggaccgacgcgggtggcaagttcattagccaaccccgcgcctatcctttcagggccatggggaagaaattcgccgtagacgaggagacgacgctccctgtctcgccgtccttctccatcgcccgcgtgcggcgaagtcgcggatctttcgacctcctcgagcgcctcctcccgcccaagacttcggcgagagggggacagtggagtacgagctcgacggcgcgggttctgctccccatcgtcaccgctagcgctcggagagagattgtgcgccattgcctgttcggccatggggctgagcgggagaagcttggcgcacacgaaagaggacgagggcttagaaagacacacgcgccccctacctggcgcgccagatgacggagcgtggggctcctcaccgggagaccgcgcaggcccccctttgccagttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggagttacagagagccggagagccagagagttcaggctccagaacccctctagcctcctttttttctttctcccccctttttggtgggcaaggtcctccttttatatctcaaggggataccacatgcaccacttctacctacttttcttctgagtggggacctaccctatcttgaccaaaacttggcttgcaccttcgcctggaagctaaatcacaacttgtccttgagtgaggctcagcgccgtcactcgcctgacaccggggatctccctgttactccctcattaatgggcgaagatttgccatggctgctttccaaatgaccatccgatgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccactcacgtggcgccaaacccacagggggtcggggcgccccagccctcggggccgaaacgggagcggcccgacccctcggggagacagagggaggggcggccacatcaccctcgggcccgacccccccccccccgagggggtcaggccacgtgggtgactgcagctgccccaaacctctagtcaagatacccccggtcccatgtcaccgacaacgatcctccagcgattatgtccagatagaatgcagactccttatccaaacccgtatggaaatgttgaagaagcacatacccgggtaaggacagggttggtccagactgcactaaattagtgaatctggaccaggctgcaccaattgattcattttcgatctgcttaaaactgagaatttctactcgtagggcagtaatacgagtaactgggaagaaggtaagacagaatttgtctcacaacttttcccaactaccgtttacacatccaacggtagaggtgtaccattgctttgctctctcttaaagagagaacgggaacaatttccaccgcacagtttcttgtctcatgccacgaatcttaaggcacgagcagacttgttcaaagtctcgcagatgatggtagggattttctagatcaaacccagaaaaaggatttttccctaaccatactgattagttcgggatgaatttcatagccagttgtataaatgggctctgatgaaggaggtggctcatagaattcaccccgaggagcagacagctcaaaaagcggttgctccatggtcgagaagagtttgacaggaatacttctttaggatagcaggggtagatgtagaattaaaaaaacaaaaaggatacgaggatgaataaggtacggaaatgatcagcaaccatttccccggaaacggcgccagaaatgcttgttggtatttcttatggtcacagataaaatttgcaagcgcacagatataccgatgtagcacttcccctacggagtattccaagggtatcgaatccaatggaacgtgtgtgatcagatcttcctccggttcatccaaggacaccaagcaaatgataggccaggatagagaggatttactagtgagaaacagtgtctagggaaagcttaactttaatcctaacgcaatacttcaggcactggcaacccgctgttcccagatgtcgctctactacgtacccggacagggaggacttaagtgatctcgagggctgtcaccacctctacacccacctcaaacgtactgtgggatacgcagtaattactggataacaattacttaaacatcacgtctaagcaattactgtctactttagtgtttataactcaccaaagcaatcactatatttagttgattatagtgaacaataattccgtatgctatttaggaactaaccaagagataattctcacaaaataaatctaaattactcaagaagaatattatattgaattcagagtaaaaaatagaataaaagaaataggagaagattaccgacaactccggaattcttccgactcctactctactctcttccgattgtaatatacaatatagtacaatagagcctcttataatttagctcaagcttggaagtgtgtgtgtgaagtgagagagtgaagcctttatatagaggtaggtatgacggttgtgagaagctgaaatgtccgaactgccccgcaaccgccattaggagatgatcaagaccgtccacgccaaaccccagcctggatggctgagattaggagatgatcaagaccgtccacgccaaaccccagcctggatggctgagattgtggtccggccgaacctgggctgggcccatctggcttggctcttggcccatgttctcccctgatcctcctctattcattcttcggtattttggctgattcactgatgttttgatgaagttcacaacccatccttgcagggatacacatttctcctcactttagtctgattttcctcccaacatcggggtttatcgtctgcatacaaatatataccaacacttgtggaatatgtgagattaagcacatatcactatgttggatgttttattatccgaactttatgcagatgttggcggtacagaatcggtatttaataaccaccaacagacaccaatgtgcctacggggcctatatacctgagggaccgtggggaaacggtgaaggagcagtgaacggttgagagacaccaatgtgtgaaaggggaaattgttgattagtcccacattggttgaccgtgggtgcctgcgggggccatatacctgagggaccgtgggatctctggcccgagggacatagtatgtgaaggcttgatggaccgtgggtgcctgcggagcctatatacttgagggaccgtggggaaacggtgaaggggcaatgaatggctgagggacaccagtgtgtgaagggggagattgttgaatagtcccacattggttatgtaaggacaagggacctaacatataagtggggtcccctcaccttaatagctagcttttagggtgggaaagaccctttacgatcttacaagtgagcccatccacaaggcatgacaacggcggagggggctccagtggtccacagctaaggaggagaagaggaggcatgtgagggagccaataagcaagatgacgcgctcatattcctctacgatgcatgtggtacgcttcttggcagacttggcctcgcgctccaagcggagccgctcctcctcatgagagcgtgcaagctcaacctcgatgtgcgacgacttgcgggcagccatcttgcacgacgcgaaggtagaagtggcttggccttcgcatggtagcggttctcaaccatgcaggaggcgacacacggcgcgagacttggggcccttggccttgcgctagtactcctcctccttggcgcactccatgcctccatgcggtcccaacggttagccgccgtgatcgcaagccacctttgccttggagttgacacccatcttctttggcatcgcggctgttcatggcggcagtggctggtggcacggtatggggcttgagcgaagtcggattggcatggtagatgctgaaacgatgacgacgaggtatatatatcccaacctacccatctcccttatctctgtcctctcctcctttgcagccatagatagccacggtcccatcctctccccacggcgagctcgagctcgccaactccctcgcctccctcctctctccactgtcacgggccaccagagcctcctcatcatcgacctcccactgctattgccacctcctgcaaacgagctcaccggccactacccctctccccctcgatgagctctggtggaagagaggggagaggtggagagatgggggaagagagaggataggtggtcggtgagctcttgtggaagtgaggggagatgtggagagatgggggaagagagaggataggtgggaagaggtaaaaatccacttacatgtactccctccgtaccaaaaaaagacaaactctgggtttccgtgttcaatgtttgaccatccgtcttattcgaaaaaattatgaaaaaaattaaaaagacaaatcacgcataaagtattaatcatgttttatcatctaacaacaatgaaaatactaattataaaaaaatttcatataagacagacaatcaaacgttggacacgaaaacccagagtttgtcttttttttgggacggagagagtagaactcacatgtttttaaatatttctttttattgactaggatgccacgtcaagacaaaacaaccattcataatgtcatgagacttgattggacggttttgctaagatgagtaaagatttctggtatcacgatttagcgatgttaattaaactctgaccgaaagatttaggagacaataagtggacttattcctttgagtaatgcaaattttataaggctagtattgggccttagggaccagaattcaactaagcccagagaaaacaaatagcatactgtttacgtgctttataaaattttcattctcaaaaaaaaatctaagtagggcaatggtacaccgtacaccacacctctcaacggaaccatatatggcgagtaacgcagtgctgggtgtgtttgtccgaggcgaaacaaacccttagaagagcagcttgattcagagttgatacatagtagtaatagcatagagccatagaccattccaacatgtacattgtacaaagcggagtctttgtcgaacgaaacaatacccaggagatgctgcaccacaaaaaatcgaagcaaaaagggcaaaaaaaaaaagaaggaaaaaaactgagaagttgatctttcgttggaggaggttagctatgtacaggttcagcatattcacacttgaccattgcaaatatatagtactcctatataacaaaactgccagtctgctccaaggcatatttgagttcagtatcacaaaacgaatcataaaagaggaataaaatgaatggagcaattattgtatccacataatagtatctttttttttttcatcatcatcatcatcggacaacataccccaccaaaatcaccatgtccccacagccctaaacccatatacctcctcattgcatgctatcaaaagtaataatacacacagaaatgctaattactgtcctacactatgatttgtgctttcagtggtagctacctgttgcattatcaaaatctcttttaggagagccttctaacaaaggtaaacggtgtccatggatggttttactgggtttctactcaacagtgacaacatggataggggcacaaggattgtacaatcaatgcttcagcggttggggttgctgttcaggtaaaggagggaatacatcaagaaggaacctgtgaatcatctcaaagctggtaaatgttattactgcggcaggagttgtccgcaacagattagttgcacatccacggtagaaaccggtcaaaccctctatatgatagacctttctgatgcagtccattacacctgtatatctcgccttggagtgtgctccctgctcctgtaaccttgagcgaacaacctgtaacgaatcatttcagatatatagccaccagttggccagaacaaagttcagtacacttattacaagactggcatgcatcgtaatttcaaagaaaagactctacctcatgaggatatgtcaaggttgacgcagcaacttttgccagggatgaagcaacagcaacatcaccaaaacttaatgcctccactgtagtattatctgttaaagcatgacgctgttatatgtgtggaacaaaacacaatctggagtgtacaaatgtagtaaacatgtgcaagccagataagctttgatcttctcatgtgcaggaaactgaatagcaacatgactgataccagccaaggacagaagttgagagagtacctcgctcagccagataagctttgatcttctcatatgcaggaaactgaatagcaacatgactgataccagccaaggcagggacaagtccactttataaaaaagaaaaagaaaaatatcagccagcgcacaaaacatattatcatcaaacggtgtaaaatcttgcatctgtggacttccatggaaagctacctgtacagtccacgaatgccttcttcatgtgctattctcttcaaagcagcaagtgtacctttgtacgggatcaccccagctcgtatcccttgggtctacaaaagggaaaaggatacagatgatgatatgactcaaaataaaatctttgaatcaatttgtctgagtatagcatgtagatgttgactgcttagtatggacaggtaaaagatctaaaagaaattcagcatatttataagtgattataattaatgatagctccattccaaatgggcattcagcctgtgtaaagaccatcagtcaacattaggaaagaaatgggaattgcttacaggttttaaacacttgcctaatataggccagacaaaatatttggtatgcagcattttgaaattgcaattatgctatcaggcgtcttggatcgactactggtccagacaagttgtggtccaaggatacctgaaatcttgtcttcacaacccaaagtggatttgttgcaatagtagttgcacctccagcacatgatgcagcaataacatttgcccctaaggacaggtgatgacttctatctgcaaaatgaatgtacgataccacataagaactgacaaatgatatgctgtcaagtaagtcatatgcagggtaaaacactaaccattggaagaaagcaagcttttaagctgctcatacacagtaaaatagacctggaaatccacaaggatactattagctccacaatagatcatagacacttgattcatctatagtgtagtgtactactctactcggtgccatacatgggtttgcatgcagatcaacttatagcattatcattagcatcgttgctttttacatagaatttaaaaacatctcatcaatggagtaagtggagctataatgtaagggtaaagactaaccgcccagttaggcaagagtgccagaatagttggagataaaccacgatacattccccgaaaaccttccctctgagcaatctgttgtaagcttccaattattacactacctagtaatgatagaacaaagaactgatgtaataaaccttagcttctgaagaatcttggtatagtagaaaacaatttagtccagacataagcatttcagaaaatatgctactcatcaaacttctattgacaaagatgcaaattcaacagtaaaaagtacgaagtaagtgcattatcaatgcaccaatgctgttggccacgtacataggatgacctgctggcattcttcagagcataacgggccacacatatgccagcatccatgaatgcagctaaaacattttttgaattcaaagcatgtacgtcagctgatgttccaggcaatttaggttcagcaaatgtgtaccaataacatcagaaatccaggcttggaagtattacccacactatactacacccatggacatcacaaagtctgttggcttttttcacatgttcatgtatgctaatgcttttatcatacatcaacgaattcatgcaacagcaaatagcacgctgcatgctttccttccattctcaatgtgcacgatctcataagttcccaacaattccgctcaacacatgtgaagctcccagccccactttgattggaggtactgatagattcaaggtgcgcaaaacaacaacgagagaccaatcaaaagcctcagataacagaaccgtccaaacaagcaatccgaaaccgttacgacatctaaaagcagagagcagatctttcgttgccgacaagtattttctcaactccctgaatcctggaagtgtccgagtaaagctacacaaagagaaaggcacaaaatctgcaccggtttaccatcattcccctgcatgcatgatgcatccactgtatattctgaccactatatgcactgactttaagtgctcaaactcctatgtgctcaccatgcttcatcaagcataggatagaaattgcagtctataatagatttatgtgcagctctagctctgcagcagcaaactgtagcaagcaaagattcgcaagaattcctctgaagagacacgcacctccaattgtgccggtggcgagcttgggccagccgtgcacctgaaacctcgtcttgatcacatcgagcgggcacacgaaggtcgccgcaaccacacctgcggacaagccccaaaaattcaacgcttgctccacatgggcatccccgaaacacacaaattgacccaaaaaaatggataagatagctcgagcggtcatgtgttaccagcggaggcgccggcggcggcgtggcagagcaggccgcgggcggaggtggcgtggtggctctgctgcgaagacgcggacggcggcgccggcgccggcgaggtcgccacgtcccccggcatcactcccccacacacacaccgatctgctcctcccctccctcagggcacggaaccgcgcgccgccgcgtctagggctacagccaccgctaccctcccctacccctaggagaaggtgaagcccgggggcgctacgcgagggcgcccgatcgcatccgccttcggggggtcgcccgcgacgtccgtggcgcgctcgtcgcggcagcaggaggcg

SEQ ID NO: 92890 - DNA, 2336 bp, Oryza sativa
ggggcgtgcgtgcccttcgctattcgccggctggctcccgccgacgtcgaccgtacgttggcgtctggtatcgaggtaccacagtacgagatcggtacgaaataaaacgggatcgcctttactgtttcaccaggtgaccgaaaattgagaggtcacctagcccaggtcgttgtatctcacaagtccaaaatggctaagataagtaatagtgtgttcagcctctgaacgggggaaggcaccaactaagtcggcgacctccgaactctagcaggtttcacggattaggttttcatggttagaactttgtaggagggatagggtgactattatagggatggtgggcggcgagatgtcaaagcagtggacaagatcggtggcgagggcaagagaagcctcgtgggcggaaaacggcatctacgtaggcaaatctatcggcgtgttcgaccgaatacgggggaggagatgcgacatggaggagtcactggacttggagacaacagatctaggaaggaggagttgggaggtgtcgagaagggcgtgtgactagctagcgccacctctacattagtatcggcgagatggaggtctgaatcctagtgggttggggtgggatgagacagagtaaatgaagataatagatagtgctaggcttataaaagactgcactaatttaaaagcaatcgtgaaattcttgaccgttaaaaggttaataagaaaaataaaaccagttgaaaaaaaacagccacctaagatcgtatggaatgcattcaatcggagaaacttgcttagtttattatacacttatatagctgaactgtacttgcgtgacattcttggttagtgctttcaaaactaagcgttgagagacttgaattagtctcgctttcaattatcgatattaatatatttttaattatttaaataaataatctactccaaatttctaattttgagaggtcaaaagtataattgttgtagttaaaacaataataaaaaaaccccgatcatagttataggacggaatgagattattgtatacagaagagagaattttatttattttgctttcaaaatattcatattaggggcctatggccaggtcatacacctccacaagttaataaccacacccattttctaccgacaaatttctttaatcactataaaatcattcaatggaatgttggatgttgacatgacccaaaacatttcctccccctatcacccactagccgatctcttcataaaatagaaacaaaacaaaataataaaatcagggcaaaatctccttttgatagtgtgatatgcgctccactacaaaacatcccttgggtccacggctcaggcagagtaagagtagtggccgtgcagtgcagtgaagcccgcgccgcgccgtttcacgggtccacgacgccgcctggtggaaccggtccaccgttcacggccaccgccaccgcgggcgcagacgccgaggcgcgcgcggcctcgccggagaagaggaggaggatggcggagaaggcggtggggcacgggcccaggacgaggatccgcggcggcggcctcgccgccgcccccaccgcgccctccgccgccgcgaggttttgtctcgcctcccactcctcgatctgcatttttctactagcggggtttcgatttgaatttgattttggaagctttgttttgagatgcaggaggctgtctgcggtgtcgtacacggcggcgccgaatctgaccaagaaggtgggtttttcgttatttttttttattttttttgaaaaatctttgattcttttttggggcttttggaatcgcttctttgtctggtcagtgaaatggtgggttcttgtgttcaaagcgtgaatctttactttactttgttaccgatgagcagtagtacaatatgtgtgaaaaatctgatgccactgcacaaaatggatagtgtctactgttctaactgaaagtatgtatgcttgttggtgttgtctcaagtgattgatctctcctaaccatcttcgtgttcaggttcctgacccgaaggttgtgaagccagccaggaaaacgacgccggtcaagaagcggccgcaggtagatcaggcgcagaagcagagagaagagcttgccgctttgcaggagcagctgagtggcctgcaaaagaagttgcttgagaaagatgaggccctgaggtcggctgagcacttgattagccgaatcagcgcggcgaatgcagcggtcgatgaactgagagggcagcttactgagaaggaatcgcagattgaatccaccggatcagattgcatggtgcaaaggtgaattaagatctgattttataccattgg

SEQ ID NO: 92891 - DNA, 1641 bp, Oryza sativa
ccttattagctaaaagatgactgatactattctgacttcggtggacccttaaccaacttatctccctactaacatgtatgaggtccttgatttccttaactagaaaagcttgatccgacatcgctttctcagtagactttagaagctgtattgcttctaggcagtcagactcaacaatgatcggcctgagggaccaatgcagggccaatagtaatccttctctgtaggcaagaagctctgattctaaggcactgatgcagctcgccaggggtttacaggctgaagcaattacctctcctgtactgtccctgaggaccatgctgattcctcccttatcttgactagcatcaaaggacccatcaatattcagtttcacccagcccaaaggaggtctcacccacctgtgcttgacattgttctacatctgggaactcctgatggcgcccgtcgctacataatccacaacatgttttcctttcattaaatttgcttggggtttgttgtttgatctcaagcagagaacacatatagctttccaagaatcttctggaagactcagttgtcggtgcaggtttcccatgcgtaatatcattgcgaacaaaccagttgcgccacaataccatgagaaacatagcccgctcgggttcgagaagatgctccaatctatcaaagatccaacctgatacaaacgggccatcatccataatacaggatatattctgggactccttcatgaccatccaaagagacttggcatgtggacatcgatacaatgcatgggcaatgtcttcttcctcagtaccgcaaattgcacaaacatctgtggcctccaatttccttctcttcttgttcaccatggtagcaaggcaatctaatgccaccttccaagcgaaaatttttaccttctgaggcacattacatttccaaagcatgttccatgctttactacggtcgactgcagatgaggctgaacaagcattctcagaagcaagcgaaactgccaggctataagcacttcggactgaaaacctccctaatctgtctgggtgccaagccacaaagtcgcttacatcctgagagggaacacgaattttcagtataacttcagcatcaatgggccagaatatctgtcgaacccgatcgacatcccattcgcctgcatctgttaggaggtcagctacccatttggttctgcagttactcttcttggtgatcggtcgtcttgagtgatcacgcggaatccatggatcacgccatatacggactgagcgaccgttcccaattctccatattatccccttcttcagcaattccaaaccaaactcaattgctctctagcccggcgaagcattcccgccaaaacttgtgtcaatgagatttccatttaggaaatatttcgctttcagaactattgcacaaagactgtcaggagaatcaattagcctccaggcctgcctggctaacagagcttggttgaacaatctaaaatccctgaaacccaagccaccacaattcttgggtttagtcagcgtatcccaagccttccagtgtgttttccgcacccccttttcaccaccccaccaaaaacctcttgtgattcttgtaagttcatcacacacagattctgggagtttaaaaatt

SEQ ID NO: 92892 - DNA, 3028 bp, Oryza sativa
ggacaatttataatgacaattcaaattatcgatcattcttaatgatcacctgactcgactgaaattggtgtaacaagagcgcagagagggatggcctttacaagtgtcaagccgaacttctctgacatatctatcccattcctttcaatgtcaacaggtagattccatttgaactggtttaacaatgatcccagaactaaatgcaccatcctatttgccaatggcattctagggcatatccggcgacctgcaccaaatggaatgagctcaaaatgcactcccctaaaatcaatatttctttcgaaaaatctctcaggcataaatttttccggttgagaccatgtatccttgtgtctgcctatagcccacacatttacgaaaactcgtgcgccttttggtattgtgtaacctgctatgtttgttgtcgtttcagcttggcgtggcaacaataatggtactggaggatgcagccgaaacgtttctttcaccacagcttgaaggtaaggcaattggccaatatctgattcttcaatatttgtacctgaaccaataacttgtgaaagctcatcacaacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatagagctgaccttttttttttttgcatgcccctgttgctgcatggtttatatatatatatatatataaaccatgcatatatatgtttcaatacatatatatgcatacatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcaacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagagatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttgctatgtaggaagacagtaaaattaaactaactctgtgttgtatggcaacagtatgaacgtcttgtaatgctgccccttcaagagatggaccagattgtcctctgtttcttgcggatattggtcgagcattgccacttttactttccgagggtcgatgaatccattatcgaaaaccctccgccgtcgggccctttaaatctccattctacaacgataaaaaggagtatattattttctatggtctacttatatacaaagacctaattaattaaaagagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctacctgtggcgctcatctccatgtacagctgatggaacttgtacatttgtgtgggtagggactgcagcagctcaggcttgacaagcgttttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactaaggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttatgtgggcaagcggtggagctgggggggccttgactttgaaggtgccggaagaggagcttgcgggggagtaggtgtgggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacaagacgccgcttgtcgcccagggaggatgatgtaccgcctg

SEQ ID NO: 92893 - DNA, 1980 bp, Oryza sativa
gtgtctatcttttcggacatgatcgaatacattatggaggttttcatggatgacttctctgtctatggaaaaactttcggtcattgtctccaaaatttagacaaagtcttgcaacgatgcgaatagaaagacctagtgcttaaccgggaaaattgccatttcatggtccatgaagagattgtccttagacatcgtgtgcctgagagaggtatagaggtggatcaagctaagatagaggtgatagatcaacttccacctccggtgagtatcaagggaatccgtagcttcctcggtcatgctggtttctatagaaggttcattaaggacttttctacaattggcagacctctgaccaacctgttagttaaggatgtgccctttgagtttaacgacgagtgccttaattcctttgaaatcctcaaaaaggcacccgtttctgccccaatcatccaacctcctgatgggacactcccattcgagattatgtgtgatgcccgtgattttcctgttggtgcggttttaggccaaaccaaagagaagaaacataatgcaatctgttatgctaacaaaatcttgacaggagcttatggctgttatttttgctatagatatgtttaggtcttgctaggtgttaaggtaattctctatactgatcatgctaccttaaaatatttgctcaccaagacagatgctaaaccccgtcttttaagatggatccttctgctccaggaatttgacttagaaataacgacaaaaagggagtagaaaattccgtagcagatcatttgtcgaggttgcaaatcactaatgtgcaggaaccactaataaatgatttcgtactagatgacaagctgatgattgtgaacaactccaacccgtgttacgcgaatattgtgaactacatggtatcaagatatgtaccactgagagagaacagaaggaaattaaagtatgaaagtcgtcaccacatatgggacgagccatatttatatagagtctgcttagatggactactaaggaggtatgtgccaaccgaggaaggacttaatatcgtagagagatgacgatcagcaccttatagtgggcactacggtgcattccacacacaagccaagatttggcagagcggattctttttgccaccaatgtatgaggcctctaaagagtttgttagatgcttccagagttgccaaaggcaaggaggcatcactttagatttgcaaaatcacttctcgccctctcctcctcctcctcccttttcctctcgttctcctccatagttctcaacagaagatcttgcttccattcatgcgccatggtttttatgggtgttttaagttgtgacgtaagagacaaaatcgaccactccctctccaaactcacttaaccagaagaagacaagttgcccttttcgtggaatattgatccaaaaaacagtttccaatccttctctggaattttacaacccaacccatgaaaatttttggggcggaaggctcttataccagattgtcagctactcgctagtcaaattggagaaaagaggaagaacaggacaattacacacacacaaacacacacacacacatgatttaggcaactatttagtacatatattgctccaatccattaggtttgagctgccgccgccatcgccaccgagttgccaagcccaagttcttcgagcagagtactctgttcttgtattacaaatctcaccaactctccttctctctcacgcaagttcaagctaatgcaagactgtattggatctattacaaggcccatttcggcccacaatacttgatgttcgtcgcggtagcgccagtgccatctctgagtcttcctgtacatcatccggcaggttatgctcttcagtctccagcccttcttcttcagtagttctttggcactccttgctcaccagccgccctgacaaaatgttgctgtcgatgttcaagtttattgccatatcacaac

SEQ ID NO: 92894 - DNA, 629 bp, Oryza sativa
  unsure (1)..(629): unsure at all n locations
accaaaaattattattttaatagaatgcgatgtccaccagcaaatatttaatttttgccagtgtttttccccaaaagttgcttcatgcggtgtcntacagctanaacngcaaagtcacgatgtcctgtagcaaaatttgcttttatataaactatgaagagttgaagactattgttctactagagtcaattcttcagggcttcatgggtttgactccattgtagcaggacagtttagtttaatgcaaaaataaacattttagaaatttagcaatgccaaatttttggtaagtcaacagcgttaccaagttttgataggatgtgttaaatgtgatattgccaaaattttctaagctaaatatttggtaataaactaaatgtatatgcatgtttattaattttgtgaaacaatgattggtttaaaatgccaccaatcgaaacatgccaggctgcgttccatctacacttgtgcaggtagatttttttagtgtacataaaacgagaaagcttattagcacatgattaattaagtattaataattataattttttaaaacagatttgtttgaattttttaaacaacttctatatagactttttttttttaaaaaaaatacatcatgtaacagt

SEQ ID NO: 92895 - DNA, 6668 bp, Oryza sativa
  unsure (1)..(6668): unsure at all n locations
aagcaaacacaaggcataaacaacgattggagcattttttttcttttttcacattggttttatgtggttatttaaggattggcaatagtaagggaaaacattttttttctttcacataggttttatatggttgaggtaaactttaatgcctcaactcttttatagacatgaaaaagcctctattaaaatgccacaagacatattgatactttataaattatgtcgacatttgatgttgcgattcaagtatttgcatagtatggtgatcgttggtactaggatatatgcaagattgtaataaaagagatggggacgaggatttttatataggttcggggccctgaattgtcaggtaaaaaccctactcctattggccgaagccagtcattgctcttattcaccataatcacacctgtacaatatttggggtagcctatctaactgttgtcgacttggcggtctaaagtgctgactcgtagtcgacaacagggtagccttcctcctcgaatccgtatccggtgagatcaaagacagcgctatgtctctcctgacagtatccgtaaacactgtagggggctagccatgcttatctcttaagtcgatatccggcgtcttatcttggcgtatgttagcttgtatattgatcttgtgtcttgatctattgttccttgtcccctctcctcctagggggccttctatttatacccataggtgtccccttgtccaagtagaactagggaaaccaatatcgatacaatctgagtagtccttgtcatttccatgtagaaccctatttatctttccttatgcggaactcctcctatatccaaaggttgtttccgtataagacatggtatgtggtgggtcctgccgagatttagtcaactactattaggtatgtggtatccataaccctgacagtagcccccgacttcaatgcaaatgaacgagttcatattctcaatccgaagacctcggaatgactgttgtcgagctcacgtgaccgttcttggtgagttcagagataacattagactttctttagcagcctcatgtgggcaccgtatatggtttgtttgagtcaatctccgacgtcaaccaagaaggtacagagcatatgactaaatctcccgtcttgctgcaatcgagaatttggattgaagtcaaaaaattttatctcggcgggtacaccatcttttcattccgtattccttgtcgagatcctccaaccgttctcaaatggtcgagaaggtgcagagtctgcgacgaagccttgtcaacatttgtcgtactcgccttagtcgatcttggtgttgaaccatagagacatggagttttcgacaatgtcgaatagaattttcctgaaatcaatactcagaaaagaatattagatagaaataacccccgagcgaatgctcaaatggtgacatgttataatatccatggaaaactaaaaatgaattaaatttacagaccaatgtttcatgtacgagcatcctcttttttaccgacttcgatcagtcagtttgttaagtcatacactctcccaagcccccgtcttgtcatcggagataagttctcggaggagaaggctcttggacccttgacctgccttggttgaaaaaacgcttaccctagcccccagccgtgaagttggaaaacccaatttccgattacacggcttggttaatacgtacggtgagaactcttacatgaccagatcttacatggtcgtgaggaaacgaagtttagcagtgtgcctatggatagagaccggagatgtaattcatttgcattattaaaaaaagtagaggaaacggagaagaacataggtttgacgtggggaggaggaggacttgatttggggataaatgttttgagtttgtatattacattcattgcgttgcaatgctggcctttgccaatttatagacgcacaccaactccctcttacgccaccctatcaggcacaatgcagcgaacattgggccgcgactccctgatgggcctctttcctttagtcgttggttgctgccgatcctaaggcataaccggataacattctcccctccatcacagatggcttgtcccgcagtcgaaaaaccgagagcacagcagctatatggttgatttcttttcctaactttccaactagcattcctcttttttcctgcgcctgtttttccaactgctaaacagtgtatttttttttcaaaattttctataggaaagttccttaaaaaattcatattaatcaatttttcaaaacaaaaagctaatacttaactaatcttgccttaatacttaactaatcctgtgttaataagttactctctgttttacatgagggagggattagttccgccagatctagcnagctatcctctgcaaccggccgcccttgccggcgaaccttcacttgcttgattgccgctgcaccacgactaatcagttcgttgttcaccacctgccttggaatcggttatggttcatctttaacaggagggagagctgcagtgataagattagcaggtctcaacgcaattgtgtgacatggaccacgcggtgaatggtgcacaatcgaaaattccagacgatacgccacctgccccactattaataagagtaaattgcactggcggtacttaaacttataagacgaacttgcaaagcatcactggtggagaaaccgtttgtagtactggttcgtaacccgcctttagtcccggttgtccaaccgggactacgaatccccgggtgaaataaccgggactaaagatcgatctttagtcccggttcatgttaccaaccgggattaaagaacggtcagccacgtggccggccgaaccatctttagtcccggtttgtgttaccaaccgggactaaagatcggtgtaccattttttttattttgcatggccctatttgctgcaaggttgaatatatatataaatatatatatatatatatatttatatgtatattatgcatatatatatatgtgtgtatgtataaaaacatatattacacacatatgtataatttaaagcacttaacattttatatgcatatatattaccaaaatatatattaacactaaagtaaatgtgtacatatataaatatatatatacatgcatatatagtacaattcatttgctcgctagctatagctacgactttgacgccggcattatgtcagaagaggaaggaccgacgttatgaattgtcgatccatcgtagtagaatacaccatcaggatttaggacttcttcgttgatgaatcccatcagttgttcttgaacagccgtgataaaatccttgtatgggagattatccttcatatcaatatgctatcattcgaaaaataatgacatatcaatatatgaaattaataaacaacttaacaaattgatacgcaatgaaattttgaatggtttatgtatacgtacatcgagctctcgtgtggtgtatatttggtttgataggcagtgggcatactcgcatacgtagtagccgcataagttagttctctggtcctgctttgcacactacatgagaaacgatgagagatttaatataatctttatatttaactgtaattagagatttaattaaatacaattttggatcatgcatatactcaccggaaaatgaaacctccgtccaagtttttctttccaagtcatgcggaccaattgacggaaccgatcccaagccctacatgtgcagttgcaagctacgattaattaattattacccgagatcaacataatagcaatagaatccccgcgactttggaatagatggaattatattacctgtctatcagttggaagaccttgtcaaaaatcttctcctctttattcattgagtcgtacacagtgactctgcatgcgtccaagtcgaagaataacaggacccagtggaatctggaatatgcgtgagatgagatatatatgaaaatgtacatgctatatgtatgggaacgaaatttgttcgaatgacaataaaaactcactctgtgttgtacggcagtagtatgaacgtcttgaaatgttgctgcgttaggagatggacgagattgtcctccgtgtctttctcgtacttgtcgatcatttcggtgttgattttccgagggtcgatgaacccagtatcgtaaaccccccgccgtcgggccctttgaatctccattctacaatgataaaatgaaattattattgtttacatatatgacaggagctagttattgaacgaaacaaatcgaactcaaagatacttacaaaatccatgcgctcaaaagagagacgtcgagggcgtccagatggtacagatcgaagacatccttgaaatggagccagagaacatcttctccttgcaagaagtcggggtttctgatcctcactccgaacatctctctacccttggcgctcatttccatgtaccattcatggaatttgtacatctgtgtcggtagggactgcagctactcaggcgagacaagcggtttaccgagttcaaacttgtatgccactttcgccttcgggattggtgcggctccaatcagctgatccatagttagaccggtatctgaaatgaaatccgttattccaaaattttctccggtcaccaacggctcgacctcttggtttgtttgttctccaagctgaaggactggtttggacttcttgtgataggctttctgaagtgttcggtcatagtctgatatcttaaaggcctccttgtttgctatggacattcccttgaagaagttcttcacgctcgggtcaataggtatcttcttttcaggactccgaggcttgagttgtctcttcacttctcctaccatataagcatcaagctcctcttgactgcaatcgtacggcggctccttgtttgtggtggcgtcaactttcgccttcttcgttgcccttgtgcgggcaggcggtagagcttggcgagaccttgtcttgggaagtgcaggcggacacggtggaggtggaggaggcggaggagccgaggagccggaggagatggtgcaggaggaggtggcggaggagacggaggagatggtgcagggggacgtggcggaggaaccggaagatatgatgcaggaggagatggcggagccggaggagatggtgcacgagatgtcgcttgtcgcctagggaggatgttgtaccgcttgcgccatagtataatggcgtggtttgtgtctcgtagatgcgtctcaccgtctcctcctgggtagtccaactcgaggtcctcgtacgtggcctccaccagctcaacttcgaccctcgagtatcctgctggaatcggcctgcagtggtaagtccctgaaatgtccgttgggatggccattccggatgtcaccttcacgtgatgagagcttatctattagtaatcaacctaagcagcaacttgtggaatgtacaagtcaaaaaatcataaaactacgagaatgccacctcctcttgcatgctgagctcgtagctcgataccctgtactcaagatctacaatcttctcctcggtatctctcttgctcctctgccgactcctgtacgtgtggatgtcctccttgaatccaatcttccagggaatcacgcctttccctcatgttcgtcctagatgctcgggagactgtagggcgagtgacagctcgtccttctcttgtctggtcggaatgtgccctgagaagaggcttccactgcgtccgttagtcgactggcagcctcgcgtatcttatcgctaaagacaagggagccatcaattgggttaagcgttccaccgtgagcatagtaccagaacttcgatcgatccggccatttagcggtggccggatcgatacccctctcaatcaatcttgcctccatctcctcccacttcggcattgcgacgctatatccgcctgaccccaagtggtgatggtacttcttcttggcggcattttctttgtttctggccatcatcgcttgcccttgatgccctgtcttgtaagcaacgaactcgtcccaatgatctcttagttttgggaatacgtcgaagttcggtgttagtcccttccaaaatgtatttcttgtaaagatctcccttgaagctctggaactgttctaccattttcttcagagtccactatttcactatgttttccggaaccgcgggtagcgtgaacgtttcgagcattgttgtccacaacatctctttctctgattctgggacaaagttgtcattatccccatgtgcccttgttctgcgccagtacaccgtgctggcaggcacgttgtccctcacaacgcaactgctgtggcgtacaaaattcttggctgcttctgccggggcaataggtcgtccgtcttcgtccacctcagttatgatgtgccgaccgtctatcttcttcgcggaacctcgttgtccacgtgccctcttctgtccagcggaaggatgacttccactagcctcctcctcgttcccctcctcattcccctcggcatccctctccacgttcccctccttgttcaagtactggtttggatcctcgttcccctcttcttcgttccagtactggcagcttccctctgcgattgtatcgtacagtatctgttcctcatcgcgatcagccatctgtgcatacaaaaaatatttgttaggtctataggtcatattc

SEQ ID NO: 92896 - DNA, 5178 bp, Oryza sativa
gaaggagcggacgagaacggcggcgacttggcgatcacgacggtggccttcccgagcgatgacgacgaccgagacggcggcggcgcacggctggagcgacggcggcgacggcggcactatgttgcacggtgctagaactcttccggcgacgagaggcgaaggcgagagaggcggcgggtagaggagacaccggggaaccttttaaaggggctcggaggcgacggcgaaggcccacggcggctggcgacgagaaggaaggtttagggttcggaggaaagagacgaatccgattcgaactcgaatccaatgatttccaaaaagaattagccgatgattccaaaagagaaaaggtagaggagatcccggagattgtttcccctctatcaattcggccggagaaggaaaggatcgaccaaatttggaaaggaacggcggcggcgcgaaactagggtttcgggcggcggcggccggaggtagacgacgaccctgacaggtgggccccacctgtcagcgtcggacgcgcgcgcgctcggcggcggactgggccgacttgggccgaggagagagagagagcggttttgggccgactttcggcccaaagccaaaagaagacttttaaaacctttttcaatttaaattatttcttaaatgcaattccatttattaaaaatacttccttagctcaaataaatcccagaaaaatctaggaattatagaattaagcaaggtatttaatgaaattttatctggccccattttatattggaatttattaattaaaattagatcttctcttcaagacttttaaaataaattctaaagattccatttaaacaacaatttatatattttgaattttcagggtgtgacaaacctacccccttaaacagaatctcgtcctcgagattcggaagaactggcgaacagatgcggatgagctgacttcaattcatcttctcgttcccaagttgactcttctgcgagtgattactccattggactttgcaaaaacggataacccgattcctggttcttctctcatctatttccaagatacggattggtttctcaacataggtcagatcctcttggacttctatccgttcaagattagcttcttcggtaggtacccttaaacactttttcaattgcgaaacatggaacacattatggattcctgccaaagattgaggtaattccaattgataagcaacctctcctcttctactgacgatcttataaggtcccacaaaacgcggtgccaattttcctttggtatgaaaacgatgaactcctcgaaaaggcgtgacatgaagatacacataatctccttcttcaaaactcaaatctctgcggcgattgtcggcataactcttatgacgagactaggccacacgcaatctttcttggatgattttcaccttttcttctgcttctcttaggatatccgtcccgaaaacttgacgttctcccgtttgatcccacaaaagcggagtgcggcacttctgaccatatagtgcttcgtaaggagccatctgtagactagcttgataactgttgttgtacgaaaattccgcatagggtagattcttatcccaacttccaccgaagtctaaagcacaagctctcaacatgtcttccaaaatctgattcaccctttcggtttgtccgtctgtctacggatgataagcagtactaaagttcagcttagaacccatctcttcctgaagtttcttccaaaaatttgaagtaaactgactgcctcgatcatacactattttcttagggacgccatgcaaacacacaatccttgccatatacaattccgctaagcgacttccggaataggttgtctttactggaatgaaatgagccactttggtaagtctgtcgactatcacccaaatagagtcatggcctgatgacgttctgggtaaaccagtgataaaatccataccgatttcttcccacttccattcaggaatcttcaaaggctgcagcaaaccggcaggtttctgatgttctgccttgactcgctgacaaacatcacatactgctacgtattctgcgatttcacgcctcatacttgcccaccaaaatctttccttgagatcctggtacatcttagtactaccagggtgaatggagtataaagtatcatgagcttctttcagaattgcatcttttaaatctttgttgtcggggacacagattctctcacccaaccatacagttccgtgctcatcctccaagaaaccgatagcttttcctcttctcctattcttcttgatatcttgaatatcaggatcattaatttgggcttctctaacttgatcaattagagtgggcttcgcttctaaggctgcaacaaaacctatactgacaattcccaaatttaatctttcaaattccttgcataattccaatggcaaatgtcgtccttccgtagcattgcaatagcctttcctgctaagagcgtctgctacaacattagcctttcccgggtgataatgaattcccatgtcataatccttaattaattccaaccatctcctttgtctcatgttcagatccggctgagtaaagatatactttaaactcttgtgatcggtatatacctctgtacgagtaccgaaaagataatgacgccaaattttcaacgcatgaactactgcggccaactcaatatcatgagtagggtagttcttctcatgcggacccaactgacgagatgcataggcaaccaccttcccatcttgcatcagtacacaacctaacccaagtttggatgcatcacaatacacctggaaacccttctttggatcaggtaaaatcaaaataggagctgatattaagctacttttcaactcttgaaaactctgctcacattcttccgaccacttgtacttcacatctttctgaagcagtcgtgtcaagggcttagcaatcttggaaaaattctctataaacctccggtaatatcctgcgaggcctaagaaactgcggatctctgaaactgtcttcggttgtttccagttggttacggattccacattactaggatcaacggcaactcctccggctgagatgacgtgaccaaggaacttcacttcagacaaccaaaattcacacttgctaaacttagcatacagttgatgttctcgtagcttctctagtgcaaggcgaagatgttcttcatgctcttctttggttcgagagtagataagaatatcatcaataaagaccaccacgaacttgtctaggtattccataaacacctgattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatctatcttggagaaaacagtagcacctttaagctgatcaaacaaatcatcaattctaggtagtggatacttattcttgatagtcacatcatttagtgcacgatagtctacacacatcctctgggtatgatctttcttttccacaaaaataaccggagctccccatggagatgaacttggtctgatgtatccttactgaagcaaatcatctacttgcctcttgacttctgccaactcattggctgccattctataaggtctcttatggatcggagttgttcctggtaccaaatctattctgaactctatatcccttttaggcggcataccaggcaaatcatctgggaacacatcgggatactcccggactataggaatctcttccaaagttatctggttcagtcttgaccttaaagattcagaagacaatgcatgaacagttaccactcgaccatcattgctggtgagagttacttttctgttagcacagtctatcacacctttatgtctggctaaccagtccatccctaagatgacatctaggtctttggattctaacaggataagattggccagaaatggtactcctttaatttctattctgacagaggggctaccttgcaaagagagtgcttgattacttggggtactaaccatcaaaggacgtctaagatcttctactttcatcccatgatttcccgcaaaactcatagataagaatgaatgtgtagcaccagaatcgaaaagcactgttgcaggaactaagttaacaaggaacgtacccaaaatcacatctggagcatcttgagcttctgccgcagcgacatgattgacacgagcctttgatgctggtgcggtagagttgctctggacagggacaaccttcatgcgtcggggcttcggacacttgtcagcgtaatgtcctgggtctccacagttgaaacacaccacgggcttgctgccatgctccctcttggcaggctgttgctgtgttggagctgcaacagggcgtagagcttgattgcggatgttgttgccagcattgttgttgaagaactgacgctgcggacgaacaacagacgaagaacctccatgtggcatggactggggtcctaaagtaagacgcggcctctgattattcccctgttgtgtcttgaattgagcaatccggcgtttcttctgctccatgcggttgtatttgtcctcttgacgaatagccttatccaccaacttctggaaatcagaataatccccagtcatgagtgggtaagaaagctcatcattaagtccttctaagaacttctcctggcgctcttcatcattgcgcacatcctccggagcataacgagccagacgattgaactcgtgcaaatactccgtaacagagcgagatccctgggtgagcgacctgaattccttcttcttgagggacaccactcccgatggtatatgcgtcttccggaaagcagcggtgaattcaagccaagtgataggttcagcagtagtcctgttcagacggaagtgatcccaccattcagaggcagggccatgcaactgatgtgatgcaaatgaggccttctcctgatcagtgcactgaagcaaatccaacttcttctctatggcatgcaaccaatcaccagcttcaacaggattagtggtactagagaaaataggcggcctcacacgaagaaattctgctaacttgttatggggaggtgcatggttatttccttggttctgctggttctgaagt

SEQ ID NO: 92897 - DNA, 836 bp, Oryza sativa
ttgcgcttggattcttcttcttcatcatcacttatgatgatgaccggaggatctgctagggttggggcaacttctttctccaccacacgaacctttggcgccaattgatagcgagggacaaatagagctctcttccttgcggtaagacgaatcctggccttctgcggtggtgcttctcccttcaacgcggctaattccttctccaaacgatccaccttgtcttctaacttgcaaatcttaccacgattccggtcttcacgatcttgagccgctaacacagtctccgcacgactttcatccatagcccacagcatctcgaccaaatgccttgtggtagcatcattctcaattccttcagtctcaaggtaactgccacggtcacttccctggggttgacgaggatggtagcgatactcagtgtcggccaactgatcactataacgatcgcggagctctcctatggcgatccttgccacctcctgacatgcatggatgtagtttcttcctccagcttcgaacatcactgaggggatatcttcactattactgttcaaggtgactttgactcggcacttctcttcatgacgatcatgaggaatctgggcataaaaaggggcagtcccaaatccaatgacaaaggatatcgtacgcaactcttggacaaaaccctcaacaccaaacaagtactcaggcttgtagcgcggcatctaaagacaagtgaaaggagggagttaagacatttatccaattaatagcacaagtttttggattaatttgaataaagtttagaaatcaaagtaaaaaggtaagtaaataaagtaaaccaagcttgcatg

SEQ ID NO: 92898 - DNA, 679 bp, Oryza sativa
gccgatccgaatcgaactcgaatccacgaatttccaaacgattttaaccgacgattccaaaagagaaaaggtggaggagatcctggagattgtttcccctctattgatttcaccggagaaggaaagacgcggccgaatttggaaggagacggcggcggctcgcgctagggtttcgggcggcggcggcgcaacgaagacgacgaccctgacaggtggggcccacctgtcagcgggagagagagaggagagcggcggctcggactgggccgacttgggccgggggagagagagagaaggagagaggttttgggccgactttcggcccaaggccaaaagagacttttaaaaacctttttcaatttaaattatttatgaaatgcaattccatttaaaaatacttccttagctcaaataaatcccagaaaaatctaggaattatagaattaagcaaagtatttaacaaaattttatctagcccaattttatattgagatttaacaaattaaaattagatcttctcttttaagcttttaaaatcatttctaataattccttttaaacaacaatttataatttaaggagtttaaacaagaaaagcacttaacaattataattagatcattaatgatcaaataattactgaactgttctttgtatcatttaggaattgagctccgaa

SEQ ID NO: 92899 - DNA, 1611 bp, Oryza sativa
ggaggaagcctaccgatagctggcagcaataacagggcgatacgacattgatagttctacctcgaccacgtgtggttgagtaggtggatagtgtactggaattagaagaggggatacttgtcggagtgtaggagggggtgacgatgattgatccaatgaaaacccttcaaacaaaggttaggagatatgggtcggaaagtgggtagttgagaagtaggagtatgaagatggctagccagtgggagagcacactagtggggcccaatgagtagatgggtggcggtactcagggtcaggtcgggaagggtgacggtggtgcacatatgtgtgtgtggctgcacatcgtttggatctgtttggagacaggggaggagggtgtatatacgaagttcgaagtgatcgtaatttacaaataaataaggtgcgattgacaaataaccaacccttatttatctttttcaattcctaaaacatcttaaatgttgtgatgtaaaagcaggattagttttcattatctgaaggattatgttttgttattaactgtcaccaccgtttcatagtatatctattatgtaggacttgtttgctgctgggagtgacacaagctctagcacaatagaatgggcaatggtggaattgcttaaaaacacattatcaatgggtaaagcctgtgatgagcttgcccaggttgttggatcaagaagaagaattgaagagtctgaaattggtcaattgccatatttgcaagctgtcataaaagagacattgagattacatccaccggttccactgttaccacatcgagctaagatggcgatgcaaataatgggttatacaatacctaatggtacaaaaatattgataaatgtgtgggccataggtagagataaaaacatttggacagaacctgagaagttcatgccagagagattccttgatagaacaattgacttcagaggtggagatttagagctcatcccatttggtgcaggccgtcgaatctgccctggaatgccattagctatttggatggtgcatgtggttcttgcatcactattaattcatttcaaatggagactaccggttgaggtggaaagaaatggaattgatatgacagagaagtttggattgactctagtaaaagctattccgctatgtgctttggccacaccaacttaagtcaacgagccactgtttgagttagaataatggactgctctttgtcaactcaagcattgtatcatgcacggtattattgatgtgaaaataaaaatacatcatcaatgaaatttgtgggtatttactacttcccaatgtttatcaatagtcctgagaaaattacacagcatatatttgtattagaataaaccctcgtggggaaaaatgtagaaatgttagatgtcaaagtatacatgaagtgaagtgatatgtatgtccttcctcattatcttgagatttggggaaaactgtagaaatgttaggtgttaaagtatacgtgaagtgaagtgaactgtatgccattccccaacgcgagatttgggttgaatttgctagtgtgcataattaaatatggcaatgcatacacaaaggtctcaagtttgaacctcttgg

SEQ ID NO: 92900 - DNA, 603 bp, Oryza sativa
caaatatgtcaggaatagatcgagacccaaaggcagcatcgtcgagggttatgcaacagaggaggtggtcgaattctgtatagattacatggatctacaacctatcggtgttcctgtgtcccgtcacgagggcaggatgcttggaaagggaacattaggtcacaggagaatttttgcccccaatccacaaaccataagacaagcccattttgcagtgttaccacagtcagctttggtggctccgtacgtggacatgcacttggatgtactccttagagacaatcccaggaaaggagcagcatggctcgcgaagatgcataaacatcaatttgggaaatggttgatggagtacctgacaactgcagacatcgatggtgccccttttttctttatctcgggggccatccaacacaatccacatgtaccacggctatgatatgaacgggtataccttttacaccaaggcccaggacaacaagagtacaaatcaaaacagtggcgtgccgcatcacacctacgatgacggtggcaacaagcagactcattacggtttaccaacgcaatctgggagttagattatggagcccctcaaagtccctctat

SEQ ID NO: 92901 - DNA, 3612 bp, Oryza sativa
aattttgataggggtgattgataaggcaagtccaaattacatctaaaatttttggagtgggcctagaatagggtgagctaaatttctatttatttttcaactaaaaatactagtaatatgcccgtgctaaacactacggtacaattatatttgtttttaataatttttagaatttcatattagcaaaaaaatatttttatatggtctgtgctgtgcatgtgagctttaaatcaattaatgccgaacatcaaatatatttcatgtaaatctatttccttgcacggtattcatgttgttttctattcctcaactgtcaatcttcatcattagttttacctgtgaattttttttgcaaaatgaaacggagaagagcgattcatatctcacttatatatgtaccaaggggtaaacactaatatatacgatgatcttttcatttcactgcacctgtttggctgtttggttattggttatatctccaaatgcaattatcggtccaccaccaaactgattttcatccatacttacctaatcgacaacatataagattagtaatccaactcatatttacaatacttccagatgcaccgtttaggtacaaatatggatcaaaataaatgaactatacagcacaccggcaaccatgtaacagattcttaataaaatacccataaataaccccacctcacaattgcttatcaacatgtgctctatattaaacaccaaccgtaatatctgacaccatatagtttatttacagattcgagtgcagaaaacactaaatatgcatccatggtgctaaaaaatattggttatacaaacaaattggaaatatgagctctcagtcttgtatgttcagaagctaggaaggaatcaaattggaagtacttgaatgttaaatgacactgaaaaatgtaccatcaacaaaagaaatggcaagtacagggcatgctctttataagtggtcatgacatcaaaatagcaaaattcttaatgacagtgcctatctcactaatttatctctcgatacaactggagagaaggtgacacagcttcagctccccaatcaccctatcccttgtatatgagaaacaactgaacgaatcagtatagaaaatcacaagcatcttccataacagtaaatccacatgcagagatgcgtaaattacagtgaaattccagattaattcccatatcccgttaagctgcattgccagtggcaatgtaatataggatgtgtggcaatgtaatacagcccacctcataggatctgtggccatgtaatataggccatgacctggattactaacagatcaaagaccccttgacggctgggatattaccttgtgacacaaaagagagatcatgctattttgtctaaatagcaaatatagggtaaataagtgaataaatttcagaagtgaaataaccctaccaaaggtaggtaaacaacagaagaaatttctcttatacagagtctagttagcaataacaacagcaagtaacatgaacattgatggaggaaaatcaagatgtttattgttcataaagtgatcacctgtacataaatagaatcgaaaaccaccacgaacctcattagatggtacctgccaagtcacaaaaggagtggagcaagcagtgaagcatgggaataggactaaacctgggctgagaaaatattatctaattgtttgctcatgaaatctcagccccttttgattatgtcaagacatatcttctcattgattatgtcaaaaataataaagctaaagagaatgttagtaaggtaaatctctactaattaatcaatagcaaagttttttttaaaaaaaataatcaataggtcagttggcatttttaattacagaagcactacaaaaatctgctcagttttcagcttggggatacacctattataagcccctcatattgtcgaactcagccattgcccatgaatcctacactaagtttccccttcaaacaatatatgattaattacatacagaaaatgtaaatttagttgctactgactatatgcagatttcatttcgttcttgagtaagttatgtcatgaaaaggacctgcaattagcatgagatgtattccgtttattagttgactatgaatacttgtacctacagccagccaagtcaggcactgaactgcaactgtcccctccagttgccaattctggattagtcaacatgccatgcaagttaagcgaacagttaccaaaatgaccaaatacatatttagtttctttcacatagaaacataattgttatgtaaatcaaaatgtatcttaagagcatatgagatggtatacaacagaaaaatatcttttcattaccaaagggacataaaaatcatttagttgagccagcctgatgcaaaaactcactgttttccctttttctcacttactgtcatgttaagtcctaagggctgagtgcacgctaccaaaccctatacagattaaagaatcaaatatccccaacctagctcgacaactcgagcattgaagtttcctggaatgatggaggtataccaaaatgaactatcatttagatagagaaaccaacagacacatgaatcatgcacgcagattacctcgtagtgtggaagcctgtgtactcctcactcctaccggccatgagcaacggatccggccaagacccccctcgacactgtcgcattagctggtttcataaaaagcatgagatattcttctgtagttgtttgtctacaagcagtcgaagacgatatggaaaatgtaaagttttgatggtaaaagagccatagtttaagaatgttcaatgaatccaaattccatccaaccaaatctaaaactgcatggataagccttcaacttctggaatttttagcatctaaaactactaaaatgtattgaaagatttttctaactctcaagaacagtggagataaattataagggttttctcataatcaaatattccaattaagatggtgtcaggtttgaaagcactcatattaatgaggtaatatacattttacataaaaaagaagtgaacattcatgtccatatgttacatatttcagtagcatcaaatatcagcttaacataccatacattagcatcattaaacaatacttatctcggtgaacagggttgaggaacgtggtactctactttcgagaggattttacaaacatgtttgagatgtttgcttgtcaggtacagtaaaccactaaggacttcagattttggagtagagttttgcatcacaaatatccatgcacaatgaacaatgtttaataatgaacaatggggatttagtcaacaaaggagataaaggcattatgcatctctatggatgaaacataccatgccccgtatgcctcctcgtacaggaacgggatcgagaagcactcttatcttgttcgcaggcaggatcgatggcttgcagggttgagcgagccctgggatcagtggcagcacgagggactcgaagccggttcaacttcgaggtcgggatggcgatggagcgacgcagcgatggcgccgatggggctgcgggctgcggtggcgtggagcgtcgattgagggcaggcctgacctcgcctcctcca

SEQ ID NO: 92902 - DNA, 658 bp, Oryza sativa
tactggtgtgattatggtgaataagagcaacgatcggccttcggccaacaggatgtaaggttattacctgacaattcaggggcccgaacctgtataaaaatccctgtctatctcttttacctcaatctcgcgtatatcctagtaccaacgatccccatactatgcaaataccggaatcgcgacatcaaacgttgacacatatcataccatctcaagaagaattgaagcgtcgagcttattgtaaatgtcatgattctcattctcattctactaatgattgcaatgtgtttcgacgacaggttcaatcggccatagatgaaggacaattgaagttcactgatggttccaagatgaagcttgatcatgatcctttttcggtgaatacaattaatttcaatgataagaaggtgttgattcggccggagcaagccgaatctactaaaggaaagggagtgatcattggtgaacctaggccaaagatgatagtgccaaagaaactggaggttggtgtatggaaggagaataggagtgaggcttcaacttctaaagcacctaggaagactaaagtgactttggacatgcttttggagaagtatgagaagcaaggtggtgagagaactcgcaacaaaggaaaaagaccaagatcacctcctaggga

SEQ ID NO: 92903 - DNA, 743 bp, Oryza sativa
acggaggcggcggcgagcatgtcgcggatactcctccacatgatcgaggacggctgcaccggcgacggcggcgccgggatcactctccccaacgtcgccggcagcgccctcgccaaggtcatcgagtactgcaccaagcacgccatcgccgccgccgaaggtagcagcagcagccgcaaggcgaaggaggagctgaagaagttcgacgtggagttcatggaggtgggcatcgacatgctgtacgacctgatcatggcggccaacttcatgggcgtggagggccttctcagcctggcggcgcagcgcacggcggagctgatcaagggcaagtcgccggagcagatcagggagatgttcgggatcaagaacgaccacacgccggaggaggaggagcagatccgcaaggagtatgaatgggccttctaggctatcagggtttaaaattgtggaacgaaattccagttttatcggaggggaccccctccgatatgatattatttcggccgaaattttaattttttttctttctctttatgtactaaaaaagatgtccgtgcgttacaacaggtgaatgatattttaatcttattattgttatggtttggctagcgtgaaattcactgtggaaattcccttggatattttttttagaaaatcatgagctgtaattaggagtctgacattaatcattacgagtctgaccttaatctcaagttagtatgtaaatttttttaaaaaatatt

SEQ ID NO: 92904 - DNA, 711 bp, Oryza sativa
gcaaatagatcagcaattgtaaactttgtcaatgcaataagtagagcaattcctgcaatcattccaatcgcaaggaggccctgtagaaaccgaacaaaagttggcaaggcggttgacttcttcggagttgcagtaaaaagctgcagcacgatacagcaaaagattagcttagatgatgttgcccatataaattaaaatcacagaacaggtagagatattaagacttcaacgtaacaaaccttaaataggagcaccaaaacgagaagtacaatccatgagaagccataaacctatccaaaaaatgcattagatataatagaagatcagaaggatagatttgctagattgtagaagctataggaatccataccatgcagtcttttgtggtttataacactattgttcacataggaattttaaatcaggtgctccagacaaatgccaaaactaacaaaaaattctttttcagctaacatgaggcctcacagtaccaagtgtttcacattaacgaaaacacatgaatgttttttaggccaggaaagaagagctacagcatttaatactgcattcgacatgaatggaagaatgcaagatggaaaaagaatcaggcagacacgtgcttaactgcattttaacaaaggttttgatgtgacgaaatggtttgctaacatagcaattaaaaatttgcagtgcaaaacggggtgcaggaat

SEQ ID NO: 92905 - DNA, 628 bp, Oryza sativa
aaaagattcgggatttcaaagcgccgacatgcaagaaggaagtccaaaagttgctaggtaaggtgaattatttaagaagatttatttctaacttagcgggtaaaatcgatgcttttgttcctatactccgcttgaaaaaagaagccgattttacttggggggcaaaacaacaagaggcatttgaagggttgaagaagtatttatctactccacccgttgtgcgggcgcctaaagccggaaagcctttttggttgtatattgcttccgaggataaagtcattggtgctgttttgccgcaagaggaagatggcaaggagtatatcattacatatttcagctgccatcttttggatgccgaaacgaggtatgtctttatagagagactttgtctatacttatactatgcttgtaccaaattgaggcattacttgttatctagtacatgcatagttgcttgtcaagccgacattattaaacacatgttgcaatggccaattctaagtggaagaattggcaagtgggcatatgctttgattgagtatgatttggattatgaaccgttgaaatctatgacaggccaaattgtatgtgattttatagtagaccatcatgtagatattgcttatga

SEQ ID NO: 92906 - DNA, 846 bp, Oryza sativa
cgaaggcaagtcggcggtgaagtcgtagacacccaacaacagcggcataataggccagctgtgcaggcggagacaccagtcggcggcggacgaggcggccgctcggtgaagacgtagacgcccaacaacggcggcatagtaggccagccgtgcaggcggaagcaccagtcgacggtggcgaagacaagctaacggtgaagatgtagacgcccaacaacggtggcataataggccggccgtgcaggcggaagcaccagtcggcggtggcgaaggcaagccggcggtgaagtcgtagacgcccaacaacaacggaataataggccagccgtgcaggcggagacaccagtcggcgacggacgaggcggccggtcggtgaagacgtagacgcccaacaacagcggcataataggccagccgtgcaggcggtaacaccagtcggcggagacgaagacaagccggtggtgaagatgtagacacccaacaacggtggcataataggccggccgtgcaggcggaagcaccagtcggcagtggcgaaggcaagccggcggtgaagtcgtagacgcccaacaacaacggaataataggccagccgtgcaggcggagacaccagtcggcgacggacgaggcggccggtcggtgaagacgtagacgcccaacaacagcggcataataggccagccgtgcaggcggtgacaccagtcgggggagacgaaggccaaccggtggtgaaaatgtaaaccccccaccacggtggcataataggccggccgggcagcggaaacccccgttggcaattgttacaagccaaccggccggtaaattgttaaacgcccaacaacaggg

SEQ ID NO: 92907 - DNA, 910 bp, Oryza sativa
ttcagaagaaaataaaacggagctatgtcttttgcaaattaaacagcgagttctcaccacatacctaaggttcggggccagaaactcatgggtaacaacctcataaagctcacggagagctttggtaacaccacctgcacgatcagcagtttcatcgcgtatctaaaagatattcaatttaccacataagatttcttcatggtaaatttaccaaacagaaaaaataggaaataattaaacaagaaccaaggcacgatatctctctatttgcattttactccaaaataaagtgcaatagtctttaccagaagtcctgtcaaaccagtaagcctcgactggactaattgcagcttcttgagatttatggtcactaaaagtgaaccttgtgctatactttcattcagatcccgaaaaagcctttcaaccctgtacatgtatcaatagtatgcattggcattaagtaaagaaaacttgggggaaatacaacacaatattggtgtcagtatcagatatttcatctttcagtaggaaagcataccaacgctgcccttcaccatcaactaaagagtgaagaattctctctgcactgaaatagcattccttgacggcgtaggccatgtattcatctcttgatattctgtcccataactcatactgtgagtctttacaatctgaagcatagtcattcgccaacataatctacaaaagaaaaaaccaacagattcatagcaaccaataaaagaatatatatgcaaaaaagggatctatctagctaatttcaattaggataccttgctagtcagaagaaacaatggccactgtacaagtcttagattgccacagttacttggcatcataagcaaatccatttccctgaaagagaactttgcatgatactgaagcaaatggg

SEQ ID NO: 92908 - DNA, 939 bp, Oryza sativa
gtacactcaatgaagttcagtatgaaaaatgctggtccagcactaactaatattttaatggtaccaatgtctatcttcccatgatgaaaagctataatagttaggcactgcatcagaaaagagcacttttagcatcataaactgtattcagaaatgatacttggatttaagctatacatgtgtacaagtacgatatcaaaccactgacctggaacattaatattagaaaaatccaaaggcgatgaaaactacggtacaagtgcagaaaagtgcgatgctcaacaaagtttgtctttccagtctgtaaatataaaattaaaagcaaagttaagtgcacataaataaccataatgcaaacaagatatgtacaaattttcagtaaaataaatgtgtccatttccttctagtcattgccccagccttagtcatcggtaagacccaatattttacataactaagtttaatgcccgtaagtttgctatgggttaaaaatcctacttccatagcacagcaagcccttgtcacaaatcccaacacatgccacaccatatgttcttctatggtgactgaacgagctccgctttgacctctgttatgcctctacggccttgcactacctacatcttgccctcttttacaccgcgcacaacccactttggatccactgttagtggacagtgggagtgtagagcacaccatgttaccatcacaatcaccaagtgcatcttttaagtaataggcataaggataggttaggatgaagattgaacactgcatgtttacttaacagaatacatattcttttaatactctccttttcagtcaatagatacatacaactcctttttaatactgaggcttattgttctcactctacatattcattacatgattgcagtagggtacgtaagtgcccattttgtagcaacgactcctgtt

SEQ ID NO: 92909 - DNA, 1457 bp, Oryza sativa
gtgttggtctgtgagggcagtctatgacctatgaaagctatcagatataagcgggcccgggctgggggaaggggggacgttacaaaatggtatcagagcccgactctcgcggtttcacgggcgcgtgtgtcgcagttgcgcaggcatggtgcgcatggctggtgtagacccggagtggttacacagcatggcacatgcgctggcactggacacatggacgtggccaagagaggacgttcctggcctagggttgatcgacgggggcgtcgatctctcttaagggggtgagggtgtaacatcccggcctagggcttaataggattaatagaatactcatatcaacaagttgcaacttcttttccggaagccaatctccaaagaactccagggttaagcgtgctgggcctggagcaatttgggatgggtgaccgaccgggaacccgggtgcacatgagtgaggacaaagtgtgcagaaaagatatgtgttggtctgtgagggcagtctatgacctatgaaagctatcagatataagcgggcccggcctgggggaaggcgggacgttatatgacctatgaaagctatcagatataagcgggcccggcctgggggaaggcgggacgttacactgcctttgccgccgccgaccggtgtttccgcctgcacggctggtcttttatgccgccgttggtgggcatcttcgctttcaccgtcgaccgcctcgttcgccgctgactggtgtcctcgtctgcacggcttatgaagccgttgttgggcgcctacgtcttcaccgccggccgcctcgtctaccgctgactggtgtcctcgcttgcacggctggcctattatgccgccgttgttgggcgtctacgtcttcaccgtcggcctgcctttgccgccgccgaccggtgtttccgcctgcacggctggcctattacgccgccgttggtgggcatcttcgctttcaccgtcgacaacctcgttcgccgctgactggtgtcctcgcctgcacagctagcctattatgccgccgttgttgggcgtctacgtcttcacctccggcctgcctccgtctgctgccgactggtgtcctcgcctgcacggctggcctattatgccgccgttgttgggcgtctacgtcatcacggccggcctgcctttgccgccgccgaccggtgtttccgcctgcaccgctggcctattatgccgctgttgttaggtgtctacgtctttcaccgccggcctgcctttgccgccgtcgaccggtgtttccccctgcacggctggcctattatgccaccgttggtgggcatcttcgctttcaccgtcgaccgcctcattcgccgctgactggtgtcctcgcctgcacggctggcctattatgaagccgttgttgggcgcctacgtcttcaccgaccggctgcctcgtccaccgccgactggtgtctccgcctgcacg

SEQ ID NO: 92910 - DNA, 1284 bp, Oryza sativa
accgctgactggggcttccgcctgcacggccagcctattatgccgccattgttgggggtctacgacttcaccgccggcttgccttggtccgccgccgactggtgtctccgcctgcacgggtggcctattatgccgccgtcgttagacatctacatcttcaccgaccgaccacctcgtatgacgccaactggtgctatcgtcttcacggctggccacgtcgccgccaccgctaataggcgtcgttatcttcaacacaagttgtctgcgtctgctgccgactggtttcttcacttccatggctgcatgattatgatactattgattggccttatagtcttcaccgccagtcgtcttgtctactgattgactggtgtcctcgcctctacggctggtttataccgctaccactactgatggacgtcatcgtcttcattgctggctgccttgtctgacgccgactggtttgttgcctccacagctacatgtcttcgtcaacattgactggtgtcatcgtcatcaccagtttgcctttgccgccgcccatggcgtcttcactttcatggctggcctattttgccgcggttaaagaacgtctttgttttcatcatcactctacttcttcgagcaacttcatctttattatcttcggcaccggcaaactctattgcctttacttcgcaagctttggtatttcgccgaccacgacgtctacaagagcctcaacatctcggcatgcgtcaacaagtataatgccgtgttattttactataacaagtggtgttccaatattcaagatttttactcggacatcttctatgcgtatcttcactcaagcaatgactactcgacgacaagaagctacaattctcgactctatgttcagttgtttctcaactaaccaaagagtcgggggctacacaaatacaagactctcaaaattcgacaagctttatgtcaagatgaagcaatcaatcaatcagccaacgagttctatggaatctacttcgggagtcatcagtttggtcttcacttcagagcagacgttctacttcagcaactcttattattacaccggcaattttggcttcttcacgccgccacaatctgctccaaatttttccaagtatcaaagtttgagattctatctacatgtccgggagtttagagttatcaaccaatcagtcagttttgatgagttggataacagtatttacttttcttcaagtgaagcatttgcaacagctacaactccaagttttactaccatctttacaaatcaagggg

SEQ ID NO: 92911 - DNA, 622 bp, Oryza sativa
attcctgcacccccacaccgctcattgtcagtgatgctggctttaaagtgccatggtataaatccgttgagaagctgggttgtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttgcaggctaacacagtcagaaatcgaaac

SEQ ID NO: 92912 - DNA, 1342 bp, Oryza sativa
catacaaaataccaaccagcatatatatcttcacttatattaatcaccccggatgctttgcttatgccacctctggttatatgaaatatgcgatcaaaaacatcaggatgtccataatgcattcgaaccctgtaataagaacaataaaacacaattaagttccttggttaaaaccattgtcacaggtttgttgcgggggaaaaaagagaatgtggtaagaatgagatattattccctgcaactagctaaatttgactcacttgaggtaagcaagaacacgttgccccaaagtaacaaaacttgtttcctggttagacataaatgatgcaagcgaagaaacactgcagcaggaataaaatataataggttaatacaaaaataaaagcaaaaccaaaagctagtgaataactgagagtagtcatagtaaggataccttcccgtgaacacatgttccctaacaccaagaattgttggagggcggattccatgcttaccacgaaactcttcaagtaaattcctcattttcattgcttcctctaagtagttatcctacaggagaaattttatcagccaaggatccaagatggtttctggtgcacagacaccttttcgaaaaagaggggagtgccaagtatatttcatctacgtagagcaagtataaactaatgtattgcatggaccaatggacaagataaggtagatgggtcagaatatgaccccatgttatttctccatatgagcctgggtcaatgatcctcacatctcttttgaatctaatctgcatgtcacatgttagcacctaaagatgtcctctacctcactcaatgaggtattgagtgtaaattccccgtggcccctggtttgtacacaatggatacctttctccagtgattttgttaatacttccatcacaaagaaaaaaacaagaactcatcttcatgtttagttgtttacaccaatttaccaagcatgaagaggacctatcaccgtcagaatcatggttaataacagcatgaattgtgaataatccaaatggcaagcagcgtactacatgagcatatttttagaatctatctcatagaattacacataagaatctagacaagctcgacatttcatgaggaatatatcaacaaaaaggataatgctactgtttttttgccgggtcggccaaaagatttggtcgacctaatttcattaaggaaaaggggagtggacaaggctactgttaatgataatgataagaagaaaacctgattcatgtcaattgtctgtattgcatctcctcgagtgaatataatagcagggtgctgattttcaggttttccctcgccgagcttgg

SEQ ID NO: 92913 - DNA, 3347 bp, Oryza sativa
tggtggaggggatgattcgggtgaggaatatctttcctggaggtcatcttcaagatatttgttttcagaagcagtaccattggccgatgattcaggcttctgattgcttgtgcctgtacaaattttgggccacaagaactcttcaatagtgtgcaacaaggaagagatctccaaattaacaacattatcatagctcgacaagttggtttgatcttcatccttcttaaatcgaactcggatacatggagtaatcgttgagtgcctagtagggatatctgaaatattgttcctcggcttgaaattatggctcattatcactgggaagttgtcaagagaagtaagagcattctgcagtttccttactaacagtgtcaagagcatatcaccccagccctgctccattcttgaaaaagatatctgagtaaatgactgaaacctttttagcacggcaagaaaatgttcagtattgtaatcatttgggattctctccaattggaggtacttgccattggagagatagttagacaaggatttgatcaatccactctcaagaaattcaaaggtagtcattgtttctcccccatgaagctccatcatcacctcacttaaaatgtcagtcaagtgctcttcattttgtatattgtctcggtttaatgacttatcagcagaatcgttcagaactgcgcagcaagttttgagcttttgcaaaatctctgtcaaacccatctcagagttcactgcttcggtagtgaaataggttgtcttcacatgccttgcgaaagtaaaaaggttgccctttccaatcatgcaagtccttgtttcagcagcatcagatctgggataatcaaatgcatagcagaaacatgtaggcttatttcttatgataggctgattctctgattgttgtgcttcatctgagagattagtagactttgaacaatcttcttgcataagaagagcctcaactgcatagacaacaccttccttgataaaggatccaaggtaagcatcaggaagcttttgcatgagaatttcgataagctttagtgatgagaatagcacatgatgatccttccgagacaataaaccagccaagaaactgccacagagatcacaaaaataaatctatccgtctaaaatcggcaattttagcacaacaaaaatgcaattgatcttgcttatggctatcatgtaaaaaatagaatcttgccttggtatgttcgcatccttgagcaactcttgaagcatttcaggtttactgaaataacagatgttttttacaattgaagcacatccatagcaaatgtatgaatttgcaccagagttgactgcctgcacgaaacaacatactcatttccatatttcagataacaatcattattatgacttcttgtgattgctatcaacggaccttgatcaagacaggaagaatctccatagagaactgacacaaaaaccttggttcatctacaattattttttcttttgcaagtaccatctgggtatcttcaacatctcttgctgcagaaggaataagttggtttgctaatttcaaagcttcattgacctgagatcagcacaattaagtttatctcaaatcatgtacattttacgaatggccctcgtatataatcaaatgaagtaaattagggtggtgcatacatggagtgacttgttatgcacaccaatgcaacttattagattcaagttctaatgtaacaaggtaaattagagtggtgcatacatgacaagtaacttgttatgcacattagtgtgtagcagggacaaacatgtgtcagaggtcagatatcagcaacctaaggtagaatggcgctaagcacaaagtgatacagtgcactaattgggtgatgaataggtcacatcagagcttataaggaattaaaaagactaatcaatccatcttgtcatggtgtagtgatgcccataaaagccgttacatcttgaacaaaccaaatataatatatactaattaagtctacagataagggtataatcaactgataataaaaaattgcactaaattgcaaccaaactcaattgatatcctactgctgctgccaccttctagtcttaaatgtctggaagtaagaaaaccaacctggttgctttggttttccaaaggcaggtaaggcatgccatgtgagagatctgaagtaaccagaattctgcttatggtgttaccaacattcagctcaaagagagacttcacagccacaagtgaattgcaggctagcttggcgagaagcccaatcaagttctgcaatcaaaacaaacaacaatcaatttcctcaacacactcgggtacatgcatagaagtttaactgcaagcatacactgcatgttgatgggctaagagaagttagcccgccagtattgatcagaggcaggactttctctatcacaccctggtgacagaacatgtcgagaagctccactgaactactaaatgaatccacgatgtttatcaagcaacttgcaaccttctccactacctgcaatgttacatcactttaaacataagcacaagttgcatacatacccctaaacaagctcagtttgaagaatgaacaatggtaccatcttgtcctcagactgcagtagattacacaacactggcacagaatccatcacaaattgggagcaatctttggggaccttcttacaggcattcgcagcagctgagaccgcaaccctctgaacaatacaagtaagaatccaattggtggatgtagtaattcgtcagcaaaatatggaaatcgcttgcgatgctaacctggatacttgcagagaagaagtcaatgtacgtgagcacagcagtgatcatgccagcctgcaagcacggcgtcggctgcctctgcgatatcttctcgaatgcttgcaagcactgcgcgtgacacgatcgcatacaacacgtcaggccaatgtgatcgttcgatcgggtcgtcagagccgctcggttacctgctcagcgacatcaaggtactcgatggcgaggagacgggagcagagcagggggagcaggccgtggcggacgacggcgtcggcggcgcgcggcatcgcgtcgcagaggtacgtgatggcgcgcacggagagcagcatcacgtcggggctcgccgccgccgccggcgcgccatcggcgccgcccccgaccagccgcaccagcgcccgcgccgcggcgtccgtcgggaagtatcccccgacgtcctccccgcaaaggagagcgcctcgcagagctccgtcagcgccgccaccaccgccccctcctccgcgccgtccgccgccaccgccgccaccatccgctggaacctccctcccccgccgcacct

SEQ ID NO: 92914 - DNA, 1837 bp, Oryza sativa
ttttatactatagacgtgctctctttgagaaatttgaacatataaaacaaggtgacaaaactgttagggagtactttcatgattttaaaatttgtatcacttatagtggtttacaagaatctaatgagaacacaatgactagatttttcagagggcttaattccaatattcagttgggcttgttaatgtgacatataatcatataggccaattgttcatgcttgcttgcaatattgagcgcaaaattttggagaacccaatggagcaacaagctatgcttgtgcctcctatcactgatgttttgcaggaagttcagaaaagtctccaaaatgagaagaacgatatgtttgagatgtcacttccatcactcgcgaatgaggagaaggctgatgaagctacattatttgaagaaagttcgcaaggtaaattaaatggtgctgagagaaatgaaggtgagtattctcaaggtgagctacacttgtccacttttcatgctatagtagagcaaccattagtggaatcaattactgagttgcctttgtcacaagttgatttacttgctgttccttgtgataaagaagagttgtgtgataatgtttcacttatatccatgccacaactagtgaatgaacatgttagttctactatttctttgtgtgctgattctaagcatgttgttcacattgctaatgaagtagaggaacgcaaattgctatcttctttaaatactttgggctatgttcagtttgatgatttttgtgagctcgataatttgaaggagaaattatttgctaaatctgatttgccatgtccaactaatgctatttttcatatctttggcgaatataatgatagaggaatatttttggtgcatagagtttacatttgttcagatttagaacatcttgtagttccggataaaatatgcaagctagagagacatgttactgctaatcatattgtctcgagtttgtcttgttttgattgcaagaaacaggttgttttcagtggactgcgcgaagagcaccatatggaaaaaccgaggacggttttctgtgaagaaggggaggatgatgtgaccatggctactatggatacgaccattgctcacatcatgaatcaacaagaagacatcaagatcaagtcctccatgtgctgcaatctgattcggccacgtgttacattgctgacttcaaacggccgccaaatctacatacgtgctccgttttgggcccgtgagtacttgatggaaagctctcgaagtcctccttccaacggatccagcctcatctcggaaatctatctcgtttggccgcaatcacaaaagcaaggtgctgcgtctcctgtattgggccaatgggcttgtaactttgtttgggaccctggcccatgtggggcccatgtggggtgcgccccaatctggtggagcacgacccttggaccctcttggtcgtcctcccacctctataaatagttaggtaccccttcagggtttcttgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaataggttgatctgcaccggcaagatcagcacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtg

SEQ ID NO: 92915 - DNA, 710 bp, Oryza sativa
  unsure (1)..(710): unsure at all n locations
ctatcctttctcaagtgcaaccaaattaaatcacccggttcaagcttaacctcttgcctacctttactaccaacaattctatacttttcagtcatcttttcaatgttgagcttggttgactcatgcattttcagaataaattcagcgcatgccttacatcattatgaaccctctcactagtaggtaaaggcaaaatatcaattggagcacgagtgttgaaaccatacactacctgaaaaggacttaccttggtagtagaatgtgttgcccgattgtatgcaaactccacatgaggcaaacattcttcccacatcttcaaatttttcttcaaaatagccctcaacatggtacccaaagtgcggttgactacttccgtttgtccatctgtttgtgggtgacatgttgtaaaaaacaatagcattgtacccaacttgttccatagcgtgcgcccaaaataacttaagaatnttgcatcacgatctgaaacaatagtagaaggcatacctgtaacgtcccgcctcccccaggccgggcccgcttacatctgatagctntcataggtcatagactgccatcacagaccaacacatatcttttctgcacacttggtcctcactcgtgtgcacccgggaagaatttcccagtcggtcacccatccaaattgctccaggccaagcacacacatatcttttctgcacactttgtcctca

SEQ ID NO: 92916 - DNA, 1840 bp, Oryza sativa
aaaagggaattaatatatggggggtcccctttcatttgatagattgaatcaccactaggatgccctaactattataggtttaaatgcaattagagtatgctagagttctttgaaacaaatttctatcattatgttgacataccaacatcccaaactgtaagatcaatatgactctattaacactagtaaatgataggaagttggaggtttgtcccatcacctcatgtctatttttccctttttattcaaagaacttattggatttgtgccttatggcaaaagctggagatgcaaatcatatccattatcttaaaaaataaacttaagaatttacaaaggaacgtttgttactttgatttagtattggatatggtccaagtgagtggttagcaaaaatatcatagaggggcaacccatggatcggatgtccacctaatatttcatgtatcttagcgaagaactactattgcctattgaaactagcatgtgtgttgttcgtggttccttctccagtagtttggttgatgtacatattattgctaatatttataaaagatatccatgtattaattgtctaccttctttcagggttataattcaagttatcagaaggtgcttgcaaatgctgacatggacagagatagcaatagctcgacaatgcaaacacaagtccctactaatactagggagggaccaactttcacacaactactactcggagacgaagattttgacctaccaccatatgttcccgaagccgaagagaacaatcaattctatcaacaaacaatgaatgagaacctaaacatgaaccaattgggcaacaatgggatagaaactgctgagttggaacctcaggagcatataatgacgtttgcatcaagttttggtgtaggttcacagcttttaggttctcaagcaatagaagtagttgatgttgtaggaggtttaacttcacagtggggaacacaactgcatgggggtcatcttgcacgtgtaatttcatatatccgtgcatttcatgacccagagcagcagatcctttccaacctcgtcacgcatcaatctattgagacaatgttgaaccactatgcccaaactgcagagatgtcatattccatgagatatccagaaaatgcagttactcgtggacctcaaaatgtttctgggtttcctcaaaccaatggacagatcaacacactgaacaacatgaattctgagttccatttcttgcttgaacaagcaaagaatccagagaacaattccatgcgactcatcaacatcaggggccatctatgtgctttcaggtgcacacataactcatgcaacttttagtgttttatttatagtgtggttgtttaaattagcttctcggtaagaatatgaattttgtggtgccatgtgttgtttgaatcatatcttgcttagatgagattcgttggcgttactacgaagaaactattatgatattgaacctcatgccatatcgagcatcttatcccatcttaaagttggtttatttggtagcagcatttcctaatttcactttttgtattttgtatatgcagcattgatccgtttggaagccgtttcatacaacataagcttgagagagcaacaccggcagagttagctatggtgtatgaagaaattgttcctcatgcccacatgttggctattgatgtttttgccaactacgcggtccagaagattttcccaaatggaaattgacatttattttcaaacaaaaatatttgttattgattattacatcatgaatatacattttaaactttttacaaaaaataatgaaaatgtggaacttatctgagcttttttt

SEQ ID NO: 92917 - DNA, 3060 bp, Oryza sativa
actagctttccgttttatttcttggtatatataatacatttaaaggtgtttcatggattcttctttaattaattaatatgtgtaatgtataattttgacgtgaggctttaaattaatgtttaattaaactatactttatatattttcttcatagaaaattgatccagtgtgtgctttaattaatcaggctttcgaagtaagtgatatggatcagaggatagagatggccaacgaggttggcagaaatttgatgcagtgtgtatatgatcaaaacggcaatcacgttgtgcagaaatgtttgcagtgtgtaccacctaaatatataaaactaatccatgcaagcttctactggaaggccatggttttatccacgcatccctacggatgtcgtgtcatccaggttgatagatatatatgcttttcgtttaagtagaatttaaacaatgctaaaataagtcatatcgcaccatttctacgccatgaaatagaatgtagaatttaatatatttaaaagatgaggatgtcgcccatattaaagaatttaactttgtccctgttacatataaatttccttattgtcacttcaactcattatcaatgtttaacatttgagtacctattaatagatgaaactgcatatgtaccaacaaaataagcctaatacatcattaatacactaaaatatccaatagacctaattgtttgtgtctcacttattttcaaatccatatatataaatattctaaaagtaccacttgtaccaattaataggatagcatcgttaaagtatacataaatgcccctttaaagggtgaagccaattatagtggcaagacatactttctctgttgccttgaaacatgcggtctcgtatcgatatatgagtgcccacctagactagcctggagcacaattttaatgtctaattcactatcacaccctcgtgaagtattgatcggtaagtagtaaattgagcactattggtgatggtggcctccaatgaagtcacctcaactcagtcatatgtatgcagcatagcaaactctattgtctatgcttggttctctttaggtcgagaaggaaaaagagaagatgaaggtgatcaaaatagtgttttttctaaggttttgagtagatttgcggtatagagtagacaccatttgtttatagtgttaatcattgctactcaactatttatggtatagatgagcaaggttaatcatttggcagtacttaaaaaatatagctcaagagacataccatcaaggtgatctccatagcaccaattattatttatattttgaaaaatatgtatagtttagtgctcggttttgttttcaacacttgttgataatcacatgagacacctttactaatttgaagtatgtatttactttttaaaactttttttatagtaactaatttgtgggagtatacttatagtcacgtcgatggggtgtatcacatacatccatcaattatatctgacatgttggaattccttaataaataaaataaaacatgagtagtttaatgcacattttgattgtttatttgttgccaaaactatttggcaaagaaaaaacatacatatatgataataaatctcatgatggataaagggtgcaaggttatttgctgaaaatattttgatgattttttttacatctatgtaccatgtatgctacttattagtagttttgagaaattctaaaaaccactttcaaaatataaatattaaataaatcaaaattaagtcatatctagttaaaaaaacacaactaaattttattgttcttctttatagatatatatttaaattagcgttgtatatttttaaggggattttttacaccctaaaatatgatgtgaaatttttcggaaattatcttaacattaattattatttgtcaacccatgtgtcgtgatgtatttatgaacactatataatttttataatacatcaatacttcatttaattaaaggaatacaacaaatatcataaattggatatatattataaaaatattttaaaatgtgaatgtttatagaccgttgatttgatattttatatttatattatagatatatcttaactacatatgtctgtggaataatatattttatctttgtatggtgaaaaaaaattctattttacatcaatttttttcaatggtattacgtacgtatgttttttgctctatcgtttatgctagaaaattttatttgactttttagatgatactacgtatgtattttttgcttttatatttttttacatgtggctttatcttttcaaccgtatgtatgtgggtatgtttttttctttcggcgagccatacctttttgttccaaatcatacactctatgtgcttatgttcttttttgttttttttaaaccaaccgttcatattttctcatgtatagatgaggaaagtattacaaatatacctaggtctaaaattatgggtacgccaatttaaatgaaaattaccgtaaggttagacggtgacatgtggtggtttagttatgtttgtaggaatgccatgttatgacttagaggcgtttgtaggaagtttaatttacttttggtatataataggtgttggttcccttctatagatattaagaatatattaaatttaaccgtttgtagtcccggttggtaaccccctttagccccggttgtccaaccgggactacaaatccgggactaaaaatagctatctttagtcccgggtgaaataaccgggactaaagatcaatctttagtcccggttcatgttaccaaccaggactaaagatcgatcagccacgtggccggccaaaccatctttagtcccagtttgtgttaccaaccgggaataaagatcggtgcaccattatatatatatatatatatatatacatatgttacaatacatatatatgcataatatataggcatatatatatgtgtgtgtatgtataaatcatatattacacacacatatgtataatttaaagcacttaacattttatgtgcatatatatatgttaccaaaatatatattaacacaa

SEQ ID NO: 92918 - DNA, 2883 bp, Oryza sativa
ccggtcgttggccgtggagagagtgatatcgagatcgagagatagagagagaggcagcggcggctctcacccaagagatgcggcggcggcgtctgcggcgaaggcggcgaggaccaccaagcaacggcgagagacgacggtggtgtcgacgccgggttgccctaggcacggtggcggcgaaggagatcgagccgagatcgaaaaacgtctaagtgttggtggagaagacgagcgcgcaccggcaatatatatacccccggatctttactcccggttcgtgacaacaaccgggactaaagaaaagatctttactcccggttgttcgtacgaaccgggagtaaaaatatcacgtaaaaatatgatatttttactcccggttgttctcaccaactgggactaaagatcttttcctgctatttccaaattctttttaaacccagttagggttaggaaccaggactaaagataatagcagctgtgtcttgaatttcattgcatatgtgtttctaaaatagtaaataatgcattacaattatttaaagtcgaacaattaatgataaaaccttcgaaaaattattgttgtatgtactagaatacgtggataatatataataagcacatgaatgatttaaaatttttaaaaattctaaaaatcatatataattagcatatgcacgatattaaattgttaaaaattctaattaacatatgtaaatagcacatgcatgatttaaaattaatacaaaatctaataatcatatataactagcatatcatgatattaaattgttgaaaattataattaacatatgtaaataccacgtgcatgatttaaaacctttaaacattctaataatcatatataactagcatatggatgatttcaatttgattaaaattctaataatcatacatatttaacatgtgccatacaacaattgatttgtatggatattcagtacatccaacatagtttacatcgtgtacagaacaattacggcaatacatcggcggttacggttgaccgcacgtactttctcctcactattgttccttccttgtgatcactacgtgagtaaggggtgtcttcatttgatagaaggatgctagggtcaatcgtcaccgtgaaagagggttgcccatcaaactgatcgtaatcctcgtcagtcttgtcctctactccgacgatttttctttttcctgggagaaccacgtggcgcttcggctcgtcaagccctttggccttttttcctttgctagacatgtccttgacgtaaaaaacttgggttacatcattggcaaggacaaaaggttcgtccgagtatccaaccttgttaaggtcaaccgttgtcatcccactgtcatcaatcgttacgcctccactagtcaacctaacccattggcaccggaacagagggaccttgagaggtccatagtcaagttctcatatgtcctcgatggcaccgtaatacgtgccatttgtaccatcgtgtcccatggcatcgatacgaacagcactgttctggttcgtgctcttcatgtcttgggccctcgtgtagaatgtgtacccattgatttcatatccctggaatgtcacgactgagccagatggtcccctcgccaggaaggccagttgttggttaatcgtctcgttacccatgagatgttgtcgcagccacttggagaaaatatcaatgtgatgccttgtaatccatgcatcggacttaccgatgattctagcgcgaactagagccaagtgctcctcgatgtagggagccaccaatgaagattgttgcagaaccgtgaaatgggctttacggaataaattattgtctaccatcattattgctttccttccgagagtcccctttccccgtagtctccctttatggcgtgattcaggtatcccgattgggcgatgcttgcctctggacgagcgcggttacgaacatacttcttcagaacgcccatgtacttcttgaaaggaaacatgttgtgtaggtacacaggaccgagaataccgatctctttgacaaggtgacaaagcagatgcgtcattatattgaaaaatgaagatggaaatatcaactcaaagctgacaagacattgcaccacatcattctgcagggcttctaatctatcaggatcgatgaccttctgcgaaattgcgttcatgaaagcacatagctttgttattgttgcccagacattgtctgggaggataccccttattacaactggtagcagctgtgtcatcagcacgtgacagtcatgagactttagatttgtgaacttcttctccttcgtgcttattattcgctttatattcgtgaagcatccagacggtaccttgatgctctccaagtattcaaacatactttccttctctgccttgctaagagtgtagctggctggactcaagtaatggcttcctttctcctttggttccgggtgaaggtcaccgcgttgttccatatgcttcagatcattacgtgcttccagtgtatctttcgacttttcatatacacctaggaagccaagaaaggtttacgcaaagattcttagtgaggtgcatcacgtcgattgcgtggcggacgtccaagaattcccaatagggtaactcccaaaatatagagttctttttccacatcgccgcgtgaccatcttcgctctctataaactggctgctaagcccatttccaaacactactttaagatctttaaccataggaaacacttgtttcccgccgcgatgtttaagcttcgtacggtgatccgccttatgttcaaagtgcttgcctttcttccgaacctggtggtttgttgcaaggaatcgacgatgacccatgtacacaaccttcctgcagtgcttaagatacatac

SEQ ID NO: 92919 - DNA, 1189 bp, Oryza sativa
ggttttgggcggcggcggccggaggtagacgaagactgacaggttggccccaactgtcagcggcggaacgcgcgcgcgcgagcggcggctgctgctggactgggccgactgggccggggagagagagagattttgggccgactttcggcccaaagccaaaagagacttttaaaaaacctttttcaatttaaattattcatgaaatgcaattccatttattaaaaatacttccttagctcaaataaatcccagaataatctaggaattatagaattaagcaaagtatttaatgaaattttatctggccccattttatattggaatttattaattaaaattagatcttctcttctaggcttttaaaataaattctaataattccaattaaacaacaatttatatattttggatttttagggtgtgacactcttgcatatggatttctttggcctaccaacctataagagcattggtggtaatagtcattgtcttgtgattgttgatgattattctcgctatacttgggtgttctttttgcatgacaagtctattgttgccgagcttttcaaaaagtttacaaaaagggcccaaaatgaatttaattgcactcttgtgaaaattagaagtaacaatagttccgagtttaagaataccaatatcgaggactattgtgatgatcttggtattaaacacgaactttccgctacctactcacctcaacaaaatagtgtactggagagaaaaaatcgtacattgattgagatggcaaggactatgcttgatgaatatggtgtttccgattccttttaggcggaagacataaacaccgcttgccatgcaaccaataggctttatttgcattatctcttgaaaaggacttcctatgagctaattgttgggaggaagcctaatgtcgtctattttcaagtttttggttgcaagtgttatatttaccgaaagggtgttagactaaccaaatttgaaagtcggtgcgatgaagggtttcttctaggttatgcctcaaatagcaaggcataccgggtctacaacaagaacaaaagtattgtggaagaaaccgacgatgttcaatttgatgagactaatggctcccaagaggggcacgagaatttggatgatgtaggtgatgaaggcttgatgagagctatgaagaacatgtctattggagatg

SEQ ID NO: 92920 - DNA, 3621 bp, Oryza sativa
tgatagtaatatgtttttgtatggatgcactaatatagagttttttttccagttaaatcatgacaaatttgaattttgataaactatttatatacaaatcaataattataaatatataatattcagaaatagtatcgattcttcaaagttcataaaacattttgtgaaatgtcatgcacgcaatatgattcaaatcatataacctgggcaaaggcatggggaaataaagtttggggggggggggggtaaaaagggaaattaatgagattaaactatataaagcaattgataaatagtgaggacatgacgtcacaaacttataactaaattggcaatttttgtagtgattttcattgttccatagttttacatacttttttaaaaattcataacttttttattattaatccgattttgctcaaacttttttttgattggtttgtctgatttttctgcttctattgaaagtaagttattttcggagtggacttgtactttaaccccactcccctttcctcactctctctcacccctctctctgtccctctctctctcccaccatccctgtctgtctctccatctctatctatctttagctaggttcacccaagtctgtaaaataagttaagcttgaagttttaaatttcgaggttatcttggtttcacaaactatttattcgaagttttaaagcacgaacgatcttatagtttaagcagagatgccaaccagtacgtttttatagtatttagtacaataaaataagtgaaacacgataatatgataatgcctcttgaaaatacggttttataattttgaacaacaaaattagattaaaacaaaataaaaccagtaaaacatttttctgtgattttactggcccggggccaacaggccagtggcagtgtcgatttttcgtgaaaatgagattttttaggatattcagtctgtttgttgtgtcaagaggttggcatctctgtttaagtgaaaactatgagcgataggcctacgcaattaacgtcgatgtttcgccaacctgttgtcacaaactactgcccactggacctgtagtttaaaacttcgaacactcgttgcttcggtcctgtgtgaacccgcgttgttgttagtggtcgttgtttaaaacttgaagagtcgcaaactgtagtttaaaacttacatctttctctgtgcatgatcattttgtaggtctatcattaatgatgtcttcttgttttcttcacccctcccccttatgtactttaaattctcatatctagttaattggtacttgaatcataagaggacggctttcgtcacaggttggggtcatatcagcttcaacggagaggactcgcctgctctcagggaaatcatgataccactggttaaagatggaacatgtacaagtgcgatgagcggacggaaaggtgagactgtacgtgtagacacgactactgaattttgtgcgggatcagagaacgggatcatacgtgatgcatgccaaggcgattcaggtggccccttggtcgtgcaacggaatgagaaatacaggcagatcgggatcgtgagctacggcatcaaatgtggtgtaacctttggtgtttacaccagagtcccacactatgttgactggattgagggaatcattaatgagtagaaaatacaaacatttatcgtgatctaacaaacaaaaatgcagacttttgtgagacattcatagtaggaactgtattggaagttttacgtacatgtaatacacatgatgtgtaatgaattgttttaaacattctgatattttaaaaatgagtataatgcattttgtttcgtttagataattatatactcttaaatttctgcataataataatcttaaaagtcgggagaaaatgtaatatcaggtgtgactgatataattttgcactgcagtataaattgtttacccaacaatatcatgataattataaccgattttagtatccaaggtattacttggatcataccaaatataacttccagtagtgttgtatattgtagaaagttgataatagatttaaaaaaaaaaaatttaatactttttcctaaaatgtaaaaacataggggcacaaaaagaatgaataagtgttttaatccactgttttaccaaatgaacattctttcatttccttttttccaatgcatttaatcaattatttttaggaatttaactattgacaatcttgtaatggagtactcttaacctttaatcattattgtaacattccatatcatgaatatatgagcaacttcagtcttgattatagtgaagttacttcactataatcaagaccataatcattgtcaaactgagaaaatacctttgataggcaggaattatttaggtctttgaagacttctgtcaactggcaaccgcttatccacagcaagtaatttttacctgttaagtacacggatggtctcaaaaatcattagaatactgcccttttccccacttgctattcacttatttattaccctccgaaagaaaaagtaatctctacatgacaaaccaattctgttggcattaagccatttaaacaaacaattccattttcatctaatattgtcactaatattgcataatcctctgtcaaacaaagcatggttgaaaacatgatttattatttttaaaatatttcatttttattcaaaattatcgggtttctgaaaggatgctcttcagagtgtttcgtttctaaagaataccaggtagtcaaattatcaatgtaccatagaggcattgttggctgaagagcgtcaacatcatatttacaaatgcattttttttcttctcaaaagaacctttcaaatacaaacattacaactcttttcccgtctttggacatggaagcaaagaaattgaattatacaaatctgaaaaataggaaaatatctcttgttatttagcataaatatatataaataaatatatctagaatattattctgtttcctatatgttgtatataactcttggtcaccaagtgtcgtaattatgttttctagatttcctttactataatcacaatatttacgtatagtagctctttgtggaattaaagttggttaattgcgattgatatataatacatgaataaatacacagaatgatcttaacaaacggcttgtttagtatggctcattgtaaatcattgtgaaaagagagagagagagagagagagagagagagaggttgtctgtttgcgtataaatgtggtcgggtacgtatgcctgtgtgcacatgggtgagtgggggtgtgtgagagagaagaaagagaagaagatgacaccaggggagaatctagcttttttctttttaaggggggttgatgatgcggagcatcgtccacgagccgcgtagcgacgaggcgatttttttcttgctattttgaactcccgtaagcgatgttttcctggcatttactattagtactaacacaatggagaccataaaacgcagtgcatgataacgtcgttttaacagtttaatacacagttatatccagaattatcatgtgtttggttaagttaccagatgagttgaatatctgatttcacttggcagtccaagggggggggggggggggg

SEQ ID NO: 92921 - DNA, 4210 bp, Oryza sativa
ataacctgcacatattccatcaggcattatccgcatttttattgtgcagctccaccctgactctctttgattcctgaaaaagaaaagaaaaaaaaagaaaagaaaaagaaaaaccgagtcgtctcgtctccattgcggcggcgcgagctttggactcgtcgtctccgtcccgcgcgcgacgagcgcgaccagcggccgccggcgtctgctgcttgctcgcttgcttgcttccgccccgccggcgccctcgcttcgctgtccgctgtggtgagcatctccgtccgccacgcgccatcccacactcttttttttttctcgaatttgcgttagccttactagcttctctttctagatctggaagctgtttgtctctcaatttttgccttaaaccctccctagtactaatcgcattttagtttgttcccaaaaggggaaaaaaagagagaaagaattgactatttgggaacaaatgggagtaggtctgcccctgtaaaaatgtgtgttttgtatacagtttcagtgcaattacgcctgcgagatgaagtgatttcagtgatctgttcaagaacggcaggtataggagagcagccgatggttcagttccgaattggttgtggcaatgctagatggcaaggtagcaactagcaactgcttgtttagtttcttctgaggttggagcttcaccgtttggaagacatttatgctcttgattttgtggtcactggtcaggcttgcctttgcagagacgataggcatctgatatgtgctatggctttcagacttttgtactttggtgcctatgtgtagttagtgttgaacttggataacgttctcgtcggttgaaccccagcattattaggttacagtaagtcagtaactagttgttttttttgcattctgtgagattctattgtttggtgagttgttcactgcttaataaaatctttagaacaattattgcctttctttttgaaagaaacaatgagattgtggttcttaatacaacatctgtgcagataagaaaaatcatatggttcttgtttaaatttgttcagggatctgacattttctactgttacagtgttacagatttttgtgtgccctgttgttaacttttcttcatgttgtaatgcttggacccctatccttggggcagatgaaactgtctgctatagtttcttctgcttgcctgatgcttaagatttttaacaagttgtacatcctcaatgacacgcaagccttttacgtactcatgaaaaaaatttggtgttcacatcctgctttttgtctggtgtagtttatgtcttactaatccatttgttgatctttgttcagttcaggattttgggataaggctatttgttatttctcaaaagtgtaaatgggttcagaaggaccttcagttgttactgtacatgtgactggatttaagaagtttcatggggttgctgagaacccaactgagaaaattgtgaccaatcttaaatcattcgtggaaaagaaaggattgccaaaaaaccttgtgcttggaagctgcacagttcttgaaactgcagggcagggggcacttggcacattatataaggttttggaatcttccattgcggaaagggagaatgggtcatcggctcaggggcaagtaatttgggttagtatccacctttcttgattccacatcagatactgctgtaatgcagtcggcaccttgcatattgcaatgctctcctgtctgaaaaataactatttgccttcaatgccactcagacagttgaattaattatcattcgaaaaatgttcagatccactttggagtcaatagtggtgcaacaaggtttgctcttgagaatcaagctgttaatgaagccaccttccgttgtccagatgagctagggtggaaacctcaggttgcgggttcatccatttactcctctctgtctatatatatcgacactgtgttttaccggtttgatggttccatgcagagggctcccattgtgccatctgatggaggaatctcacgcacaagagaggtatatgttaaaactttcatctgaaaattaatgatgtttgaagtatagctacaaacagcacaattacttgtttcttttttagtttccacataattctatggctatgagcccacaagactccctcccattgaaagaaaaaaaaacaaattgcaaagtagaacaccaaagattgttaagtctgctgcaataaattcacttactttgcaaagtagaacaccaaagattgttaagtctgctgcaataaattcactttcttcacagttaccttgttactaccttagagccacaagggcgagtttcagaagcactattgaatatttcttttgttcatttttctttccatcaaacaaaatcagttagctgtaaattcaaaagaacaatggtaatctgtgattgcctgattacagcaaagtacaaacttttatacagaaataaatcacagatacccccccctgttcttttcaccagatgttcagaacacccatcttttctgtttacaaacttatcataaaagaaacgaatgtaagttcagtttgttgcctgcacagtaacgcaagcatggatagttaatatccacattatattgaatgaatgcagcttcaatcatcagatatttcatgtcttggattgagagcattgtgaatcttgagactaatcatgttcttctgaactcctcatgaatgagcagactacccttccggtaaatgagttaaccaagtcactccggaagacaggctatgatgtaatgccatcagacgatgctggtcggttcgtatgcaactatgtgtattatcactctcttcggtttgcagagcaacacggcatcaaatctctgtttgtacatgtgcccctgttcttgacgatcgatgaggaggtccagatgcattttgttgcttcccttctcgaagctctatcttgaattaggaagaaaaatacaatttaaggttggaagcggactgaataaaattgtattgtcatcgatgatattggtcttgctccaacgggtgtatttaaggggaaatggctgcttagagtgtgttcttggtgaaattccacttgtatgtatgccactacataacatgatctaaacatgcatgggaacttggttttcagatgctgcggttccatcctgcttttgcatttctgatgccaatacgttggtggatcgtcagtaaacaacgcatgcacccgtcacttcaaacttcgtatatttgtcattattttcttctccattttgctttgatagaaacaggagcaacatttcttcgtcttttgcttcagctttcaccgattgtgttcagtcgtttgatgctaactaaactcctcaaagaatcagctttgccttttggtcagacaaagaagcgagatcagtgcctccttgaattcagttcaggttcaggttcagggttcaggcatcagaaattcagaatctccagaacaatttgctgcagcagagccgttctgacgttcttccgaaacaaaaaattctactatataaatgtgaatatgatgttctaatctcaattttgaatgttatttatttaattctaaaattagtaattatcaaatgtaattgatatagtctttttttttaaaaaaaagctattccattaaaaaacaatttatttactattaatattaatattataatgtttataatattaataatagtaccgaatattattgtttagtttggaactagcaaatatgatagtagctaaacattattatgtttctaaaataaaaatatttttcttgcaaaaaggaatacaataaaaaatatttgataaacatgttgggttaaagatgtgggcctaaaattgaagataagtgtgctagatttttgtttccgtataactattcgaaaattatccggatagtttccggttgttttctgtttctgaaaaaaaatccaaattaatttctgcttcataaactatttagaaaatacccaattgacacaatctatttctgaaaaaacatcgggatcacagaaactatccgaatcgtttttatatccctgcttcatactttctgaaaggacgtaactacgtagctagtggtagctgatttgtctaaaccagctaccactccatctataagaggcaccatccagctatatttcaaatacaattttctcttaaactacttatctgatctacgatccgattacaccgttg

SEQ ID NO: 92922 - DNA, 644 bp, Oryza sativa
tgatgatggccagactacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgaggtagcgcgcctgaagaaggagaatgctcagttgaagggtcttccagcgccaggaggagtccggatccgcactacgccccgtaagaggacgactacacctgtgcgcatccagctggcgcccaggaacccacctccaccagcggcccccgcagcagctccagctccgcccgcagttcctgcagctccagctccagctcccgcgttcactctctccttcgctccagcatcagccgccggaggttcagccagtggtaccggaggatggctgtctgctactcccagtggcagcggcgagactgatccgtcaggctccaggagtcgctcagagggaccgggtgacgagcaggaggacgctttcgactccaccgaccgcaggagccgttccgagcattaggct

SEQ ID NO: 92923 - DNA, 529 bp, Oryza sativa
ccgagtccgagcacgagccgcctccttctcctctcaaattcgcctcaatccgaccccgattcctccgggtttttgaggggttttgttcctctcgttctcctctttcttttcccccaagaatcaaagagaatcgttgaggatttgatccgaatcgagttcgttttgattttatccctaaaaccgagttttaatctttcccgagtcgattgctctcgtttggagttcgatctcttcaatccaagcttatataaaggaccacctcgtcgttctctttcgtttgccccctctcccgagctttcccgtgcaccgtagcgccgtcgccgcgtcgttttagtcgccgccgccgccggccatctttcggccacgtcgcgccgccgcgtccgtcgtcgccgccgcttgccgccgccgccgttaggtgcgccgtggtgagaggaatctcggccgccccttccccttcgccgccgaccaccggagctccgccgacgccgtcaagccgagccgccgcgccgcctcttctcgtcgccggccg

SEQ ID NO: 92924 - DNA, 554 bp, Oryza sativa
cctgcacccccctcgcgtagcccgatccagctgggtgccgagctgtacggcgacgccagccccaccagcgatgtcgaagtcatcagcctgatgctcgccacgctgcagctgaccgatgtgccagatgtgcacatggacctgggccacgtcggtatctaccgcggcctggcccgtgctgccggcctgtccggcgcggtcgagcagcagctgttcgacgccctgcagcgcaaggccgtggatgaggttcaggtgctgaccgccgacctgccgaaggacctgggcaacatgctgcgcgcgctggtggaactgtgcggtggccgcgaagtgctggccgaagcccgcgtgcgcctgggccgagccccggccagcgtgctggcggcgctggacgacctgctggcgatcgccgatcgcctggcgtcgcgcttcccggacctgccgctgtacttcgacctcggcgagctgcgcggttaccactatcacacaggcgtggtgttcgccgtgttcgtgccgggcgaaggccaatcgatcgcccagggcgggcgctatgacgacat

SEQ ID NO: 92925 - DNA, 652 bp, Oryza sativa
atcactccaatggtgttggagcctcacgattttccagtcccaacgccccatttcttcaacacgcccatatctaaacagagcaacaagctgcaatgccgttgatacttccatcacaaagttaacaaagtaaacctgtctctctgttccctcgaagccaactacaaccagctccttcagcttttcatgctgcaaagtggatggtttccaaatgatttcatcacaatgctcatcatcccaaggggtaatatggatgtgaaggctctccaggcatggtgctgcttcgagcaggagtcgaggccaagagacatcccatgatgaaggcacatcagcaatcaggagccttgtgagattagccagcaacaatgaggggcaagatggcacgaaccatctcccatatccagtgaatcgtaggaccaggttcgttatgttcttggtgaatccaagaaacctctcgatgttcaagtcccaaccaatacataaatcacgcagacgattaatgtaaccatggcgtaagttcaggtttatgtgcataacacgcgagaaggaggagtgatgtttgtaactcacccaggtctccctgatagctattctctcgagcatcccaagagagtgtagcgcgatgacgctgcagaactccacggtaagctgcttg

SEQ ID NO: 92926 - DNA, 655 bp, Oryza sativa
ttacctttttagccaactgttccatttaatgttgtcctcacattcttgcatttcccccaattctttgtaggaaaatgtgttgtgaaacgataaggtctctatttgtagatgaaggaaagcatcgtggtgaggcaactgttgaagctgtgagattgattgctgatcatgtgaagctaaacgattgccagcttcatcctgatagcattgaggtatgtgccaatatttgtatttattacatgtgatatgtggttattatttgtcttgtcgcatcttcaccatgcaattaatatgttaatggacttacttcaccagcttgggccctatgggcagcagctcattcctagctgctgaccactgccccatttcatccaacatagctgaaaatcaactccatgtgctaatcgtggccacttttttctgtaaggtcttcctatctttgagatttgatgatgatcttggaaaagatgacacagaggaagaaaagggaaaaccaaagaagaacaaacgacgacaaaaccaggaagtcccaaagcaattgccagtgagtgataataagaaagccaaacaggaattgatctcaaaggctagagaagaggtaacatttgttgcataatttgataggtatagctcaaactgtataagaaattcacttatt

SEQ ID NO: 92927 - DNA, 523 bp, Oryza sativa
aaaataaaaaaataaaatccaagattagcaaaaaaaaaaaggaaaagaagagttcgagtagaaatacaatttaaaaataactaaaattcggaattaaaattaagcaatattaaaagaagagaccatataaaatcccaatacgagattataaaaattcagataaaaaaaataaaaaaaatcaaaattagagtggtggcggttgatgtgacatctaaaaaactattaataaaacaccaaatgtaatcctaatgacgattaataggaggataacgcgtaggccgtgaagtaacaggtcaaggcggtcggcgggacttcttagagagtaaaaaagcataatgatataataatattcaatttttaaaatctcaatggcaataaaaagaagaggcggcgggcgggttgtacaagagtacaatggcagagccgtcgacggttggtgggacttctagaaagtaaaaaatgaattccaatgatagttatgttcaaattttacaatcccaatgacaacaaagagtaagcggca

SEQ ID NO: 92928 - DNA, 4043 bp, Oryza sativa
atgggagaggaggactcggggatcatttttatagcgcggggagctcgagatcgaggacggaaggggccgattttaaaggagaatgggtgccgccgacgtgggcaaggtgggagctcgaattgccacaaaaatttggggaaaaatgggggagagatggaggagtggcgggcaaccacgtccgcacggtcggacgtgcgcgcggaagccagaaggtggcagttttagcggtgacgtggggcgacccggtttccatgcggttgccggcggagaggctggaggaaggggaagagctgacaggtggggcctcaggtccacctgtcggtgagggaaggagagaggagcccggaaaggggttatgcagacttagggggagacgggggcccgagctgggccggcccacgagaaggaagggggaaatgagggagggcgagcggaccaaggggaggaggagggggattgggccagggcggttcaaaaacaaagagggggaatttttattgcttttatttttattttaattgatgatatgaactttgtgactttaaaattaactattgagcttcgaaaattcgcgggaaatttcagagagtatttagggcacaaagaatattacaaaatattctcggccaatgatttttaagggaaaattttaatttcccccataatttcacttgattaaattgctttaacttttatttaatttctagaaaatcgggggcgttacaaatctaccccccttacaggaatctcgtcccaagattttgggatggctagaaagaaagctggtgctggcgggctgtctgactgatctgctgacacatgctgcctctttctgattcaactgactgattgctcgatgaaccaaacctgcataagcttgctgttctgttgcttcccatacactgaatagaccgactccgattagtctgaccttgaccaaaattgctagtgctcatagaatttcttttctttggactgaaccactagcattgtctcccttagtaacctgtgagctcaccaagcatactagaaacttgcaaagctttcatgaaaccttgtatgtggacttgcatgaatgacagattctgactttattttaacctacttctgacgggaaccacaggtatcctaagaggctgcttgattggtctttcggctgaactgcaactgttcttggcactgcttgcctaagctgaacagttgacttggcctcacgggtttaccctggaatccaatcagataacctgagaccggtgtaattctgttgacgccctataattggcttcttcaaatattacccaaatggctgcactgagttgaacctccaaatgaaacgacgacgaggtgagccaacactcatctctgagacctaccccccttacagagagtagtcttactttcgcctgactgggatcaattgaactgttgtctttgaaatgtaaccaacacttttccgatttacaaagagccctggctttgaaaactgaaaacttcatcgatcaatcaaaatagagcaatgacgatgcactttcattctagcaagacttggaacttaacccttagctgaggataggaaagtccacataaaagagactctcacttagctcatgaacatattgactcttgactaactttcccatcagttctaactgctggcttgattgtcctgcttctggcctgacttcggtgtcgagttgcatagttgatttctgaaaactaacctgaccgactctgcattggaactgatgtaacttgaggagctcgagatcgaggccgggaggggcggatctgatggaggaatgggtgccggcgatgtgggcgaggtggagctcgaatcggagcgaaaatttggggaaaaatgggggagagggtggaggagtgggcggcgaccacgtccgcacggtcggatgtgcgcgcgggaggcaggaggcggcagttttagcggcgacgtggggcgacccgggtttccatggcggttgccggcggagtggctggaggaagggggaggagctgacaggtggggcctcgggtccacctgtcggtgagggaaggagagaggaggccgggaaggggttatgcagacttagggggagagggggggccgagctgggccggcccacgagaaggaagggggaaatgagggagggcgagcgggccaaggggcggaggagggggattgggccggggcggcccaaaaacaaagagggggaatttttattacttttctttttattttaattgatgatatgaactttgtgactttaaaattagctattgagctccgaaaattcgcggaaaatttcagagagtatttaggacaaagaatattaccaaaatattatcggccaatgatttttaagggaaaattttaatttcccccataatttcacttgattaaatggctctaacttttatttaatttctaaaaaatgcattattaaatgatttttaatcccaaacgaaaatcggggcattacagcaagcgccaaagcaccaatgctttcgcctttttcaggcccagaagaatggctttgtattctgccgcgttgttggttatgtcgaactgcagccttgcggcatattgaatcggcacgccccctggcaaagtgagtactgtcgcagcgcccgtccccttgtgcgaccacgagccgtcggagtacatcacctagggttgttcgacgggctcgggctcagcggcaaacactggtatccattcggccacgaagtcagttagaacttgggacttgatagcagtgcgagtgacaaaatgcaagtcgaagggagatagctccgccgcccatttgctgagccgcccagtgacttccttgcctcggagtacttcgcccaaagggtattgtgatggcaccgtgactttgtgggcctggaagtagtgtttaagcttgcatgaagccatcaccagggcgtaagcaagcttctccatttcaatgtatcttatcttcactccttgcaaggcttcggagacgaaataaactggtttctggcctgactctgtctcttggacaagggcagcactgactaccactggcgaagctgccaggtatagtagcagttcgcttcctggcgccgggctgatcaaagcgagcagactttgcagatattgctttagcgcatcgaacgctgcttggcattcgggtgtccaggtgaattttcccgtgccccggagggtcttgaagaagggcaaacctcattcggctgcctttgagaggaatcgattgagtgccgcaattcggcctgcgagcttttgtacttcacgtactgtcacgcccggaatttctatccaaaattccaaacgcttacatgtgtgtgaaccctcgtccaggaatcagccgaggcacacaataacaaattgataattgagtacaattattactctaattaataagcgaacaaaatgtcattacagaggtagatagttcctctcaatcaataaaaatctaagcagcggaaagataagataaacggcgcagacgactccactccacaggcagcttgaccagggctacaccaaatcctccacaccatcagcatcactgtagaacctttcctctgatgaatgattgaaaggtgagtatatgacatactcagcaagccacgcagcaaatatgcaagtgcacaggataacaaaggatggcatagtagggtttcatttgcataaacagcatttgataaacatttcagaatttaataaaacagttaagtaataattaaacaatattaatccaacgctatacaacataccctgttgtataggcccaaccattctgaacaaccatcccggctgtacagttctatctccaaaccaggaatataccattccaaaccaggagctaatcaaattattaccagttatagcatcttttattaaggtaagaagtgtgagactaatcatgaaagacattgttagacccgcccataaccgggggcacggttattcgaatagttttattctggccaaaggtgtaccactgtacccacaagacacagccccacatcatgtctccatgtgcctcaataccaccacg

SEQ ID NO: 92929 - DNA, 9066 bp, Oryza sativa
ttccgggggaaacaaattgcccgagacaacgtacgaggctaaaaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacatgacgggatgctgagacaccccgccgatggttcgcagtggcgaaacatcgacagaaaatttaaagaatttggaaaggacgcacgaaacatactgtcggtgatatgggaccgggagtatcgtgaccagaggcttgaggcagacacaatcgcccacgtggcctgacaccctcggggacgtcgggcccgagggtgaggtgtccgccctcctcctgatttccccgaggggggtcgggttactcctgccccggccccgagggccgaggcgccccgaccccttgtgggttttttgcgtcacatgtatgggttaggtgaacacggcagggctcacctaaccgcatttattgcggctcggctaaacgtgtcacgccgcacgaaatacagtgcagtgcactcgtttatccggtctgtgaccagtcacagaccggtcagatcgcgggttaggtggcgacaggcggtcagacgcacgcttcgtcccatcccatcaaggcgagagcttctaagcactcgtccccagctggagctagcgtgttacctcccagagatggcacgttagacccggtcgatatatgccaggcttcatcctaaccattacaggcaaggtgttgtgtgaagaagggcaaacatgcatgttgctgagctgacgcgtggtggacaagaattaccgatttgtgaccggtctgacactgatcatgtcgtcggcagacagccacgttcccacgacgcgcctgcctccggcagaagtggaggtaagtatgtgccgtcccgtcagaaggatgttcggagggcaaccatgcaaatctccgtccatttatgaaaagaagaaaagtccagtttggaaagagaagggtgcatgtggtatccccttgaaatataaaaggaggaccttgcccattgaggggttgagattcttttccagattcagaacctagagcaagggggaggttgccttacactttgtagctccttcacactcagatccaccaaaacacaggagtagggtattacgcttctcagcggcccgaacctgtatacatcgcttgtgtctcatgctcttttgataggtcgcgatctttccacatacagagagagcttggaatctcaccctgagcccccggccgaaccggcaaaggggggggcctgtgcggtctcccggtgaggagcccgaagctccgtcatctggcgcgccaggtagggggctcagcgtgtgttttctgagctctcgcactttttcgtgtgcgccaagtttttcttgttcagcctaatggccgggcaagcaaaggcgcacgacctctctccgagtgtgagcggcgacgacggggagccaaacccacgccgtcgagctcgtattccaccgcctcctccacaccaaagtcctaagcagggggaggcgctcgagagggtcgaaagatccgcggcttcaccgatcgcgggcgatggaggagaacggcgagatggggagcgtcgcctcctcgtctatggcgacggcagcacgccccagggcgcgcttcaggctgctggcgcgctcctacgtcacccgcccgtcgtccctgacccggagtctccagcctagcgatggctggacgacgtggccaacttggttatgacggcacagcagcgcctgggtgctggtggacggtcctccaccaccaggacctccggcgccgctaccactggctccgtgtcgtcaaggcggagggcgcggcgagcggcggctgttgcacgccattcggctgctactccctcgtcggcgcctccgactcgggaggatcagcggggagagccggatgcccgcctcgacatcgagcgccggcgtaatgatcggcgtgctccccacgcgacggagggcgcctcttcgtccagagtgtcacctcgacatggacgcgaggaccagccctccgtgcccccggctggtggtgtcggctgtagagcctttgtggcgagtcttcggaatgtccgttggcccccaaggttcctgcccaccatcactgagaagtatgacgggagcgtcaaccccaccgagtttttccaggtctatacgactgggattgaggccgctgggggtgatgacagggtcatggcgaatttctttcccatggccctgaagggacaggcgcggggttggctaatgaacctgccacccgcatcggtccactcctgggaggatttgtgccaacagttcaccatgaactttcaaggcacatatccgcgcccaggcgaagaagcggacttgcacgcagtacagcgaggggatgatgagtcacttcgctcgtacattcagcggttttgccaagtccgcaacactataccatgcatccctgcacacgcggtgatctacgcgttcagggggggtgtgcggcacaaccgcatgctcgaaaagatcgcctctaaagagccccagactaccacggagctttttcagctcgcggaccgagtggctcgtaaggaggaagcgtggacctggaacccctccggttccggagtggcagcttcggccgcccccggatccgccgctcagacagggcagcgtgacaggaggaggaagaagaggtcggtccattccggcgacgagggtcatgtcctcgccgtcgagggcgctccgcgggccacccgaaaggggaggcctgcgagcgacaaaaagaaaaaggccggcgctcccagcagggagcgcccagccggcaagtggtgcaccgtccacaacacctccctccacgaccttgcggactgtcgcgccgtcaaaagcttggctgagcggacaagaaagtgggaggaggagaggaggcaggagcgccgggaaggcaagtccccggcggttccttccggcaatcggcgaagtgaggccaagcagaaggcccccgccgaggacatcgatgatggcgatgatgacctaggtttccaagaacctggggccaccattgccaccgtcgatgggggagcgtgtgctcacgtttctcgccggagcttcaaggctatgaagcgagagcttctggccgcggcccctactcatgaggcgacgcgtcgggcgcggtggtcggaggttaccctcacctttgaccagaccgaccacccaccgtgcattgcccggggagggcagattgcgatggtggtttcccccaccatttgcaacgtgaagttggggcgtgtcctcatagatggaggagcggccctcaacatcctttcccccgcggcctttgatgccatcaaggccccggggatggtgctccggccgtcccaaccgattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgtttgtctggagcagcgcgcggaccacctcgctactgcgtccaagcccgagggtggtgacgagaggcttggcacctccgcccccaccgccccgaggcagcggattgccacatgcgacgaggtcccggtcaaggaagttgccctgggcgacggcccatccaagaccacacggatcggtggtcttctggatggcaaataggaagacgcgctcgtctccttcctgcgggcaaacgctgacgtcttcgcatggagaccggctgacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccactgcggggtgcgaccttttgtgttttctagatgcatactctggttaccatcagattcgcatggctagggaggatgaggaaaaaactgcgttcattacccccgtaggaacctattgttatacatcaatgccctttgggttaaagaatgcaggtcctacttttcaacgtactactcgaatttctttgggtagccaaataggacgtaatgttgaggcttatgtcgatgacttggttgtaaaaacgcgcaaccaagagactttactctcagatctagcggaaacttttgagagtctccgctccgcccgcataaaactaaaccccgataagtgcgtgttcggtgtacccgcgggcaagcttctcgggttcttggtatctgcccgaggcatcgaggctaaccccgagaagatacgagctatagagcggatgtgcccccccagtaaacttagggatgtgcaatgtgtcaccggttgcatggccgccctaagtcggttcatatcgaggctgggagagaaggcgctacccttatttaagctcctcaagcgctctgggccgtttacttggacggaggaagctgaacgtgccctcactcagttgaaggcatatctcagctctcctccggttctagtcgccccggagccaaatgagcccctgctactctacttagcagcgaccccccaagtagttagtgcagcgttggttgtggagcgcgatgaggacaaccctcattccgcgcacccccaccctgtgctgacttggcccgggagcaagcagggaggagaggcccccgagccgaacggtggcctaaggcccctgacgaccggagtcggccctctgcccgctcgtcagacggtgctgggcgcccccgaccctcaggaaggccccgaggccactgcgggaaggccgcacctatcgccctttgaccccgaggctaaccctgtgcggactcgacccgggagagagcagggagaagaggcccccgagccgaacggtggcctaacgcccctgacgaccggagttggcccttcgcccgcttgtccgacgacgccaggagcccccgacccccaggacggccccgaggccactgtgggaaggccgcccctgtcatcctccgaccccgaggtcatcggcacagaaaacgagtgcgccccgagaggccacttggacgaagagcgccccggggatacggcccctagcgaagaggatcggccccgccgaaaggtgcagcggcctgtctactttgttagcgaggccctccgggacgccaagacccgataccctcaggcccagaaaatgctttacgctgttctgatggcctcgaggaaactgcgccattattttcaagcgcatcgggttatggtggttacgtcttacccactcggccaaatcttgcataatcgagagggtacaggacgggtggtaaaatgggcaatcgaactttctgagttcgatttgcactttgaaccacgccacgctatcaagagccaggccctcgccgattttgtggcagagtggaccccggctccagagcctgtctcactccccgaggtcagctcggacccctcgcagccgccacacaccggccactgggtgatgcagtttgacggctccctgtctcttcaaggcaccggtgcgggggtcacgttgacctccccgaccggagacgtcctgagatacctggtccgcctcgactttcgagcgaccaataatatggcagagtacgagggactccttgccggactcagggtggcagccggactggggatccgccgcctcctggtgttaggcgactcccagctagtcgttaaccaagtctgtatggagtaccggtgctctgacccgcagatggacgcttacgtacgccaagtgcggcgtatggagcgccattttgacgggatagagcttcggcatgtgcccagacgggataacatgattgccgacgaactctcacggctcgcgtcctcgcgagcccagaccccaccgggcgcctttgaagaaaggcttacccagccgtcggcgcgacccgaccccctagggaagacggatgtgcctgaccggcccccgaggcccgtcggagcccaggcctcgggacccgaggggagcgcttctagctcccttagattgattgcttggatctctgagatccaagcatacctcacagataagactctacctgaggaccgcgaagggagtgaacgcgtccaacgcatttccaaacgctacgtgctggtagaagggatcctctatcggcgcgcggctaacggaatcctcctgaaatgcattcctcaggaacaaggcgttgagcttcttgccgatatccatgaaggcgagtgcggagcccattccgcctcgcgcaccttggttggcaaggcctttcgtcaaggattctattggccgacagctctcaatgacgcggtcgacctggtccggcgatgcagggcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacggcccggtttggagtgcctaaccgtattattacggataacggcacccaattcactggtgaactcttcggcgactactgcgaagacatgggcatcaagctctgcttcgcctcacctgcccaccccagaagcaatggtcaagtggagcgcgccaatgcagaaatcctcagaggccttaaaaccaagaccttcaatatcctcaagaagcacggcgattcatggatcgaggagttgccagcggtgctctgggcgaaccgaaccacaccaagccgagcaaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccaagtccgggcccgatcactctgcgtcgacgaccttgtcctacgccgcgtccaaacgcgtgctggattgagcaagctctcaccaatgtgggagggtccgtatcgagtgatcggtgtccctcggccgggttccgtgcggctggccacgggcgacggcactgagctgcctaacccgtggaacatcgaacaccttcgtcgcttctacccctgagggggggggcgggtgtcaggttttgggctcgggccaaccccgcaccccccctcgggtgtgcagggctggccgggggctaccacacatgcacattctctttcctcttatttcagtatttcaataaaagctgtttcaatttcctaagggctgtgtctgtgccgttttttccttttgaagaatcttgacttgaaataaggtcactcgtgctcaaccttgctctcgggggctcggttcggtctgctaaaaccgccaaacggggcccagaaccgagccgtgccctggggcgtggtgaactccgggggggaatcggcaaaaacccacaatcgggtcacccataacactcggtcaccacgttcccggcctggccagtctcgacatgcggatctccccaggcactagccccgacccgcgcctttcgaggactgggacttgggcacgagcccttaaatcaagctaagacacaaaagaggaccacggcacagatcatcctcatctcattcgcatagcaagataaaattaacacaaagaaatttttcatcatttttgattgcagattataagttgatctatacaaaaaagaggcctgaaggccttagaagaaagaaaaaagaaaaactggagattggcgggggcctgggggctcaatccgatgcgcccgggtcgccggcctcgtcgtcacggtcgtcagcaccgctggcgtcgccctcctcgtcggagttgggggcgaacgcgagccgaggggccgacccctcgaaactgtggacgatgtggtcggcggcatcccggacccgcgcgcgcgcgtcgtcctcggtcccgggagggaactcatccagcgccatccatggggagaagttggggtccctggcctggtaactcgctagtacgagttccaccgctccttgggcgaggtccctcgaggatgacttgatggtcttctcgagctcctcagggagttgctggagagccccggccatctttgagaggtgctgagcgaggcctcccaagttggtggagtacttcatcgtctggcctttccagaggcccgcctgccgaccggcgcgatccagacgggagactgcatcccaaagcatccgggccctatctcgcccgccaagcggagggcctcggcttccccggtgatgagtctagcgcgcgctgcatgtcggcgacggtgtgttcggcagctgcgaggcgggcggctaagtcgctttcgcccgcagccgccccgccgatgcgcgccctcgcgtccagctccttttcccgcgcctcgaggtcagcagcccgctgctccagtgcggctctctcggcgcggacgg

SEQ ID NO: 92930 - DNA, 2168 bp, Oryza sativa
gatgttgagtgccaggttctacgcatggttcggcatcgcaacttgataaggatactaagcatatgctccaacttagatttcaaagcactgctgcttcagtatatgcccaatggcagcttggagacgtacttgcacaaggaaggccaccctccactaggattcctcaagagactggatattatgcttgacgtgtcaatggcaatggagcaccttcactatcatcattctgaggttgttttgcactgtgacctcaagcctagcaatgtgttgttcgatgaggagatgacggcgcatgtggcagactttggcattgcaaaattactgttaggtgatgacaactctgcagtttcagccagcatgccagggacaataggatacatggctccaggtacttgcacttactattcatgagaaatttgttttaccatttgagttctgtaacagagttaatttaatttgtttctttctctctttttttgaaaaatcattcgttgaacagaatatgtatttatgggaaaagcatcacgaaagagcgatgtgttcagctatgggatcatgttgctcgaagtcttcaccgggaagaggcctacggatgccatgtttgttggtgacatgagccttaggaagtgggtttctgaagcatttccagccaggcctgcagatattgtggatggtaggcttctacaggctgaaacattaatagaacaaggtgttcatcagaacaatgcaacctccttgccgcgctctgctacctggccaaatgaaggccttcttttgccagtattcgagcttggcttgatgtgttgcagtagctcacctgcagaacggatggaaataaatgatgtggtcgtgaagctcaagagcatcaggaaggattatttcgcttttacaggagcaatataaaattagcatttgagcgcattttgtttatctatattatatgcggacactatctcacttgctagtagccacaattattctcaagtaagactcattcgagcctaaagtactgtatcgacatataaatgaagagaatttttactgtccagcaggtggaggcggtaccaaatacgtccgttgggacagatctaatggctgaaaatcgtcagtatcgtgaggtaccgtaaatcctgtgcgatgatacctcttctccatccgcatgaattgagcaggtggaagggtagaactggatttttaacttaaatttagagttgattttgaggttttttcatcgtagtttatttttcagcctttacttttagatctatatgaacacatatataaaagttttaatttacaaattattttctatttgcaaatatgtcgtttcgcttattcgaaacgatggagtccttgagtttttttcgaatgtgaaaccagattactttctactacaaataaacaccgtagttttttttcaaaaactatactttgatctaatttctttttaatgttatcaataactacaaaattagtataacatgaaagtattttaaaatacacatataatgatatgatatgcatgacagtaagcatataaaataaactagaagttgaataaaaaaacgtttgttcgtcccacttgcatcagtacttctcctagtaatattgatttgttatctttaacttaggtggcgtttagatctagggagtaaactttagtccatatcatattggatgttttgacactaatttgaagtattaaacatagactacttacaaaactaattacacagatagaggctaatttattgagacgaatctattaagtctaattaggccatgatttgacaaggtagtggtacagtaaatatgtgctaaacatggattaattagttttaatagattcgtctcgcaaattagtctctatctgtgtaattagttttttaagtaatctatgtttaatactctaaattagtgtccaaacatctgatgtgacaacgactaaactttagtctctagatccaaattaacaccaccttaaactcagtactccctcggttacagagcatgtcattttaaacacgcatgttttaagtcgaaaaagtatactttgactcctttaactatcgtctgagtatgattcatgacctccaaccataaaatcgggtatatcgactcctttaactatcaaaaccggtgtaaacaatatccctcgctggttttgg

SEQ ID NO: 92931 - DNA, 2238 bp, Oryza sativa
tgaatcggtacaattaagcatcaactgcaagagtttactatcgaatctctgcttcatcaatcaataataagattgccgttgattatacaaccgtcgttgttgatttggacaagagaaatctattatttgtgcgggcctcatcagtacagcagcagtggtcgttcgactcgccgtcgcacaggcctccgttgaaccccttgatttggcagtcactcatgcacttgttcatatcgcaatttacaaggaccatgcacgaatccatttctccatatccacctatatatatatatgcacatgtaaaatacatatttttagaggaaaaatcattatattgttaatgaccccgacttttacagagagccgaaatagttcatacagaaaatgtaaaatgcatatatacttgtcaggctatatatcagattattccagcatcattgatcactaatcatttcatgcaaaagagaacaaattaaactgtttttgcatttggatgtgatcaatcgagaggtgtatatatatatatatgtataccttgtgtagtatgaccggatgagaaatttacggtggccatcaccataagagatgtgaagaagaacactgctgcagccttcttgttgagaatttgcgccatgatgagatgagatgagaggagatccttttgacaaggaagctactgcatatgctggctactacctggcccctagcttcattttgcagctgtttatatagagtcacaagagcaaatcttggatgattcattagtaaattacctccattattatgcattaatgacgtgtgtgaggtttcattaatgaccgtttctcaaatttattgcatgagcatatcgtttcaattaattttgtttctatatcattttacctatgtcgtcgtttagtgtccacctctacaaaatattccattgttcaaacaggcctaaatgtacgttgagtcattcgaatgaaacaaaagcccattacaaacataggcccatgggctataaagcatgtcaggctaccagagaagtccacgacaaaggcccaatgtttacaagcaaaccacattcctttttcaggtcagaatattcctttttttttttgtttcagccagaaataagaaaatacaaggagcacatcatctactttcattttcatgatggaaatttattgaccagcagttcaatcacatttttaccccaactataaattgttgcagaacctgaagcaccatagatattgaagttttgggaatttttctctagaagcttcactacttttttcatttctctaactctgctatatacatgtacatatgagtagtatatgggcctcatgggccaacacatacataactcaacactccccctcaagatgggcgatagatatctatcatgcccatcttgttacatgatgaagtacactccccaacacttaaagcttttgttaaacagtcagctacttgttcccccgacataacaaaacctagcttcaaaatcccttcatctagtttttccttgataaaaaaacgatctatctccacatgttttgttcgatcatgctgaactggattgttagcgatgctaatagccgacttattgtcacaccacaacttcatgggaatattcattagcaactttaactcagaaagaagatttctcaaccataacagctcacttaaactcactgacattgccctgtattctgcctcagcagttgagcgagacactaccggttgtttcttgctcctccaagagaccaaattgccaccaacaaatacgcagtaaccagaggttgacctcctatcatcaaggctgctagcccagtccgcatcacagtagccctccacacctagatgtccatttttcttgaaccataagccttttcctgggctcccttttaaatatctcaggattctatatactgcgtccatgtgaccacttcgagggtcatgcatgtatcgactaacaacactcacagcataagttatgtcaggtctggtatgacacaaatatatcaatcgtcccacaagtctttgatatctttctttattcactggatctcctaattcagcacataacttatgattttgctcaattggtgtagaggcaggtcggcaaccgagcatacctgtgtcacaaagtagatccaatacatactttcgttgtgaaagaactatccctctaggagatcttgcaatctcaatgcccaaaaaatatttgagctgaccaagatctttgacttc

SEQ ID NO: 92932 - DNA, 6341 bp, Oryza sativa
agccaacaaaactgactgaaacgaggagacatagtatgaaaattcaagagttaagccgaaaccctaccaaccggcaagcatcccatgacttgagaagatcctcaacattccgtatgatgtcctgttaccctttattccaaggctaattacatttgacactaactacttaaggccactacctaattaaacctgaaagtgtgtggagtgcgttttggtcctctgttcattttttcgagtgacccacagcgtatttttctgaaagaattggcattcagacaacgcggagtttcattaaataaaacacaaaagaggtgaggggggcgatggcgattaggtggctggtggccggtggaggtgatgggggccggcggaggtgaggggggcgacgtcggcgagtaggtggccggcggaggtgttgaggacgacgtcggcaagtcgtaggtggccggcggatgtggtgggggcaagttggagtaggcggctgtggagcagaaaatggttgttttggccagcgaggagctggggaaggtggccggcatagtggcttggcgaggtggttggagtgctggaaggtggtcggtggtgttgccgcttggagaggccgtcggtgatgcagtttgcttgttggaaagccgcaggacacggggaacaacagtgtgtatgtcggcctggtcgacggcaagtgatcctccacgatcggctggggcttctcccgttccctggagctcctccccttctgttgaccggtctctcaaacaccagacgtggggagtttcatggcaagggagagagccagtttggttggaagagtttttgattggtggagttcgggagccttcatctctgctggtgctttgattgttcttgcgatagcgagatgcttggtatggtagagaggtgctgcacgagaccccgcgacataaccttttgttggtgtttagggtggagtcggagctgcttgcctaggggtggcaagcttggcaacgtaaccccctttgccttcttggtagtttcgttggggttgttgtgcaagtggcttcccagcggggctttgcattagtgtgttggggggagtcgtgttggggggagtcggagctgcttgtcagaggtggcaagctcggcaatgataaccctcttccgctttcgtcatgtcagtgctatggcagcttgggttgttgtagttggcagggagagagagctagggcgaaagccctgctcgatcttgggtgagagcccgcgatgtcggcgtctgtgggctccgttttccttcttgaaaacatcgtacctagcttgctttcccatttcttcgggtgaaaccttgttccggtgttcggacggatgttgtttggcattgcgacgctaccttgctcgttggaggcttcgtcttaaggaccctacgctactttgtctgtggtgtgttgttaggaagtcggagctgctcttatgagctcggcaacgatgacctatgtccttcagttgtgctgtcgcaagtttttggtttgttcttcgtgtgggttttgctcggtttgcccttttaaactgtgcttatgtgaggtttttgggcccggtttttcctgaaaaactggaccaagtctctccttcttaaatgaaaacaggcactccctgtcctctctgaggttttagttaattaaaaaaaaggctattagactataactttgaaagataaaaaaaacaaacgtaccaccacatgcacctatgtcgcccacatacaccaacaccactgaggaagggatagcagaaaccagccattgctagatcctataaagagctacaaaacaattgagcaacgccgactccaagcaactgaacattagcctcatagatgttgccgaggcaaaaggatgcaaatagagagagagcagaaagatccctctctcttgcacaagcccaccgacttgccatcatcgaagagcttcccacatattgtttgagagtggatttggtgataatgtgcaccccccccccccaagatgacgtttgcaggaagaaacacgactaagggtgacaccgtccgccatccatctaggtccaaaggaaaccaagacaatgttttgatctggtgggtccaccagggaggaagatagacgtcttgaccacgtatccaagagtgaaaacgacgctcaaatatgccgtttgtcggaataaggagactggtttatacttttttgagataaattaagacaccttattttaagataaaattaagtcacggctttttagtttccattagatcaaggtccagtagggatcaccacacaatccccaatatggatgaaaaattcaggatttaattatgtttcacggtgataatataatgtgatatgccgcctaaacaatatatatgctgccgaagctgctaacgaggcatttgccactgcaattcctttaattggcagacatcccacaattttgggtatagcttgatgcttctagatcctctttaagcccgcatatacatggaaccataaatttaacagaatccaataaaaccatgtatagtttagttagtgggatgagaaaggactgcatggttgttctcttggataagggacgagatggttaattatttgtttgcggtacagggaatggatatggttttgggatggagtgggacgaaccgtacgtacgatggtgcgtaatttattgagatatgactgataatccataaacaaagcaaataaatatgttttacgggtagaactattacatctgtattattaggtgtataaaagtcattgttacaaaaattaacaccaaaaatttaaattttagctacaaataagatagctaggccaacaaacaaataatgagcaaacaaagcaaactctctccaagagcgaaagacccaacaataatgaaaaaaaaaacgtgcagcctatatattgtgagtactagaaattaaactcatataaaagcacatatatttgtcatgtataaatggcattaagagtctctatatgtacactttctatttcatgataccctaggcacatattatatatattttacaacatataaatagaaaaattggacagttaaaccatgtcgatattttaaatatatatgcacagttaaaatatgttatgattctgatatttaatcaaattgttccaagatgaactatctccctctaggattctagctgtctctgaaaaaaatactatagcttccataattttttgactttttattgagatcaaacaattaaaactttgcctatcaataattttctcaatatttattttagagacacttttttattgagatcaaacaattaaaactttgcctatcaataattttctcaatatttattttagagacactataacatgatatttagattaatcttaaaaagcactccttccgttttgtattgtaagctgctttaattttttttgtcaaacatttttagtttggtcaagtttataaaaaaatttggtaacatctacaacaccaaatttattttattataatattgaatatattttaataatatgtttgtttataattacttaaaaatatttgaatagaaaaaagtcgaaacaatttataatactccctccatcttttttttatagtcatattttatcttggcacacagaccaaggataagtaattctacttatcatctatttaaacatactactagccattcctcataaacaagcggttcattaatatttacatttctcgatgcccatgtagccaattttgtgtggaagaatggagagtcacatattaaatccgagaaagtcattaagatgataggttgttggattgaaatatgcctatcaaaaataattttttcagatttgaaaatataactatcaaaaatagatatagggagtataaaacagagcgagtaatttaataaaattaattatacctaaagatatatcttaaagatcatgctgttataagtatgttgagaattattgaatatatttataaaccgagatagctctatagctagaaaacgcaaacacagggtagggccccagttaattaatcaccgacgcggacacacaagtaaccggccggccgttgatcggcatgccagtagtacactaaaattgtaaagtacgagaaggcatgcagtgctccactccactgatgtatgtaaacaaatttaactcttgcagctgatgggccatcatgctagctatgtatgtgcataatactatgcatttatattgtttttttgctgcaagcaccggcaccgcgtgccctccgaaaggtgaggaatatgagttaacaaattgggagctgggactatactgactttcctcccaatttcgccttagccatagcttagcttagccggccgaaagtcagagaactctatctctcacaggtagcagtagagtatactactgtactgtacactgcccatgcatgcaaccatgccgttgtagtagtagtagtctacatgtacactccattcatgccacatacatacatatacatgtagatcgagctacagcacttggttttggtttgagaggttttggatgcagatcaggtattaattataattaattggtcgtgtggtctaacagacacaccatgcatggaccttgatgtgttgtcaacttgtcaagtgtgaaaccttaagattgttgtgattgttgtgctaggcctgccggtttgtgtgatgacccttagaaagatttgcaaactgtgacaactttgcttcaaactatattataaagaagacatgtacaatcatgctgccatgtacacatatgctaaggtagtgtgcctccataaaaccaagaatggacgatatgtggtaaatctgttaaattgaaagaaatctctattaacgcaaacacaagtctggataaatggaaggactagggtttaaactcagctggttgatgaagtatagtgtagaagtcaagctaggtatggtcctatatagatagagatctttgcgagattcaatttatcagatgatcgatctcaccgagagtttttttttccaaaagtatttttactgaatgaacttcaataaaatttgaaaaatcaaatggatctgaaatttcctgcaaataatctaaataatggtcaatgcaatgaccttgagaaacaactcatcacctctgactttaccaccgaccaagagctggctccttcctacaaaaaggaataagttttaaacataacactaattttatttggctacaatattttatatagtatgtgaaaaaacataccaacaatctgacttgtaatttctcaaaaaatgaagtcaagatccattcaacaccaaaacatcaaaaatatttttttatcccaaattggcgcccacaattccacttctattaacttaagaaaaagacactccattatccatccaaaaaaaatcatttctaacaattctcaaataaatcagtagtgagacaatggtgccaatcattaatactctttgttgtatttcctaggctccaaattaatgcctatgttttagcattattggctgtaaaatgtgtaaatgaagtttttgtgagaaaatttgaatgctagaaatgaaatctttataggacaaaagaagtagtacggtagagccaatgccagaactgaaattagtactctcaaactatattcagatgcgtgtgttggtttattttaggattcgtgcataaaagttggtttattttgaaatgtaggaagcacttatacctctaaaatccatacaatctcttctgttccaaaataagcgcgccatatagttcaaattatccaaaataagcacaaccgtgtagttcaaactttggactatatgtggctgcgtatattttgggacagagggagtagaaaatatcaagacactaatacatttgtcaaaaaataattttatatttttaatactatttctacgactatttaattagttcttttttataaaaaaaaaggtagggtcgaaagacggtgccgatgtccaacggtccaagacatagagtgaaaaagaaagtatacctccacacacctaaacaaacgatgtatcgatcgagtgcacaggcacagctacacacgcgctgagagagtgctcatttccaagttttcaaccaccctctccctcccctatttatacccccctcccgcccttcactcccttcaccaccttccccctcctcctcatccttgccttgcctagctactctcatatctcaccctacttacttacttcctcgctctcgctgtccctcgctcactctcacagtctcactccggccggtcaggcgcgggcggctatggcggcgagggtggtgtgggtgaacgggccgatcgtggtcggggcggggccggcggggctg

SEQ ID NO: 92933 - DNA, 4555 bp, Oryza sativa
tgtttgaatggagagtgaggctgacatgtgggctcgggtggcatttgggaataaaaatttgggagagtggcatttgagcactggcattttgagagagtggcaaatagtaaattctcccttaaaaataggtttcaattatttgacatccaaccccacttttattcacttagatggtcccatatgtcatcctgtcaattaaagcaattggacaataaaaaaaatgtcgaattatcaaatttctcccacacggttagtttcggcccatctattcgctggacctatccacaaatctaccttaatgggcctctagaatagacccaaatctaaatgggccaaacaggcccgaaccattaaaacctaggtttttagagggttccgacccaactcgaccgcactcccagccggcggcgcgcactctctctctcccccctactccgccgcgctggtggcgccgcctcgaccccaactgcggcggctgtctccaccccctccggttggcagcgcccgcggccaccgccactaactacgcgcctgccgccgccgccgccaaggcctttgacagaatatggggcacagcgacggcgaccacggtagcgacctctccgccgacgattccccgtggagcgaggggagctggtccgacgacgatgacgaggtgcggctctcctcttcgaaggatttcgacctttttcacccaattgtttgtggcgtgcttttttttttgtttgtttgtttggtttgtgagtaagcgttgatggttcatctccggttgttcgagctgcagggatcgctatccttcgaggacagcggcgaaggctccgacgccgagtccgacgaaccggatgccccggcggtggaggagagcgactcttctgaggacgaggtgagacccatctgctgtttgatgtaaaacatcgcccgtttaattatttcaggttttaattcattaacgattccgcaatttcgtgttctcttgttgcaggtggcgccacggaatacgataggagatgtgccgttggaatggtacaagaacgaggagcacatcggctatgacatcactggtagtaagatcaagaagcgggatagggagggccgaattgaggcctacctcaggaatgctgatgatgctaagaattggtgagttgctgctagaactttggttggtgtagtttcagtagctgatgcagccaaaaaaactttggtccgatgaacataggattggattagtcatccataacactacaatttctattttgctacataagcatcacaacaaaaaggatgaatgagtaaatgatgaggctggtaggatgcttcattgcttccctatttactgctttttcatttccagtaggatgccctcattaagtcttttgattgtccgagtcttgtcatactcaaaacatgctagcttaagctcaatcatgatttcaggtaagaaggtgcagccacatgcgtattaacattcattttgaatatttcgttgcataacattttgtaaagatgtcgtcgggtccagatggtaatcttgttttggccaataaagtgaaaggttcttgataaccattacaattaaaatgtccatattttccttgtcgctccattgattggaaaatgcattttgcatgcactattgctttgcacatcatctaatgctagcttaattggctattaatctacttatgaatttaatttatcctcattgcttttttccgatttgtaggagaaagatctatgacgagtataatgatgaagaggtgcagattaccaaggaagaggctaagataattagtagattgctgaagggaaagactccacacacaaatgtggatccatatccagtacgtgcaataacacatatattatgcatttgtatttaatgctaaagttcatagctatagtaaatgcttatcggtagggggcaatgttgtcttaatgggtatgcaattatgcatgctgctatgcttatgtattttatgataaacattactaaaaaagaattcccaacatgtggcatacatatctgtaccaatttaaactgatatttttgccattacaaaaatattaatctacatttactatgcaaaattcaatgggggttacctgcatacatctagatagatagtgtttcctcaaggtttttatggttctagtgatgtattgagaggtagaggtatctcctagtgtctacaagtctcagtagagctatactttatgattaacactacgagatacatgtaccttccaatacctcttaaggaatgtaaaaaagtcctccaactatttatgattataatgtgtgttgctcgaaaatgggctgactaatgccttattttaggattatgttgattggtttgaatatgatggtaaaggccatccactttctagtgctccggagccaaagaggcgatttgtaccctcgaggtgggaacagaagaaggtatgttccttgtaatgcccctatttgtttagttatgtttttcaagatataaacaactgtgtagatgtttattaccgagttcaacttgattaaaagacaagatagatgaatgcatattctatatggaataatttattttctttttgctagagtgaaatgaatgctggcaggttacaaatatcttttttagtgaatcaaattcatgaatacaggacaatgaggtgtttcttgttttcttttattatgtttgctctattgcactatcttctgtttcagcatttggtattctaaatgagtgcacattgcagttagtctttaatgatgctacatgcactcttattccattgtgaagatattgttttcggttaaaattgaataagccataccaaatgcctcaattgtccataagaattttttgttaacttccgtctgaaatacattcgaatttttagtgcatgctgtcatgtttctggcacgctattgaactattaaacagttggcattgccattgagatagccttgtagctcatgtggtcttttgtgcaggttgttaaacttgttagagccattcgtaaaggatggataaagtttgataagccaaaggaggaacctaacttttatctcttgtggggagatgaaactgatacagcagacaataagcggcaaggcctgagctacattcctgcacccaaaccaaatttgccaggtaccatgctacaattgcgtaatcagccacaaaatgtttggacatgaacatttccgtgccagcaaagttatttagtgcagttgtgctgagcactcattatatttcaacttatatccattcttataatggcgttaatttgcatattcaggtcatgaagagtcatataatccttctgttgaatacattccaacacaagaggagatagattcatatcagcttatgtatgaggaggacaggccaaagtttattccacgaaagtatgatatctacattgttattttagttctcttatgtatgtcttaaatatatttaatattttatctgttggttttgtcagatttgattgtcttagaagtgtacctgcatatgagaaggcacttagggaaggctttgatcggtgtctagatctttatctctgccctagaacacgcaagaagcgtgtaagtagaaacctcttttcatgaggacatgtggttcattttttacttttcctccatttatcaatttggaccattcttttttttttgtcattttctagtacgtgttgattaatttataatctgcagataaacattgatcctgagtcactcaagccaaagttacccagtaaaaaggatttgaggccatacccaagaacatgttaccttgagttcaaggggcataatggtccagtgaagtctctttcagttgaagcaactgggcaatggatagcatctggtactatattcattttctatgagccacatgcatatatacgtgcagaatattctaatgattcaggtgttaaaagatctggcattaaccaatgcacaagatttgaaggattaggtcctttgacatccatgattgcacgagtttattgtaacagttacttctaatgtaggttcatctgatggaacaattcgtgtttgggaggttgaaactggtcgctgcattaaggtttggaatgttggtggtgttgttcaccgtattgcctggaatccttcacctgatagacacattcttgctgctgttgtgtaagctcatgctgtcccctttgatgcttttcctttctttgacctttatgtattctaaattccaatcttccatctttgaaacagagaccatgatctgctgcttcttaatgctgaggttggggatgaagacgctcaaatgaagacaaaagggctcctccaaatcgaggaactggctcaggaagaggataatggtaagataaactcaaccaagcaattctgctaatgtttacagactcattcactgtttctgaattcttcatactatttctatattgtaggtgataagaaaccagctgtcaagtgggtcaagcatgaaaaatttgatggaatcatgttgattcatcataaggtaaccgggtagtattacttaaaatatgacttccttttaagtta

SEQ ID NO: 92934 - DNA, 1903 bp, Oryza sativa
gccacgtggtgaccaccccgaggggtcggggcgacccgaccccctgtgttaggtatgggtggcctccacttgtccatgggcacgacccctcggggtgaaccctgcgtggatcccgagggcagctccatccctttaagcacggtactcctggtacccccgggcctatatcacctacagtagcccccagcgttacatctggcacaagatcagctttgccgtgacgacctcaactatcttgaagagcgaagaagacacgaggcccttcgggccgctcattaccaacagagcctgcggcgttatcatcagcgccatgtccggacacgatcactacaagtcaacgatctcatcttgcgccgcatacaacgacaccgtgagcgtaggatggatatggtttccccatgtaggcgtaattggtggtgcgtaacccattcacctgtacgcgtacacctttcgatcgtaaatggtgtacgcgggggatcatatcgcgagttgcctaatggttcacgcctgcccgcatgtagggcacctcacgatgcccacgtacacttaaactgcgcacggcttacgtcgaatcgacgagccggcccttagtcgtaccatacgtatgagtgcgactgcaccctcctcgcggcctcatttcctgcttcctgggcctggcttgcacgctgggcctaatgggctgatgggttgggggaggtgtcgatacatccaacatgcaaagtagaagtacttaacaccagaaatataactgctggttcaactatataaactataatatacttgcattttttctgcttcttcctcggtggcaggtctccagatgaaccgtcgtcctcgtcctcgtcttcgtcgtcgtcattgtcatcatcatatgatgcgagcagaggatccttctcgtcggcgtcccagtcgtccgatcgatatgtttacaaaaatagttgcagtccttcgattagcgacaacggagtgctgcgacgcctcaggcacgtacgtcgtgtctcgcgtgcaacgacaccgtgagcgtaggatggatatggtttcctcacgtaggcgtaattgatatgtaacccattcacctgtacgcgtagactacctttcgaccgtaaatggcgtaattgagcataaatggtgtacgcggaggatcatatcgcgagttgcctacatatggttcacgcctgcctgtggatcatggacgtaaactcatccttcgtgtgcgtaaattagcctttcgagcgtagcatggatgtgtttacgcgttgggcacctcgcgatgcccgcgtacgcatacaagccttggaatctgaccttttgcagcgtaaactctcatcttcttggcgtagacagcaactggtggtgtatgggctgattccctgcttggcataacccttgtcgtcctcgacatataatccatcttttttggtgtatgggctgattcccagcttgttgtcctacttggcgtaatccaatttttaaatgttccaaggatgataaatagtagttgtggaagatcctatgagagtaagtgagtaaccacatgatgatttacgcaattacctttgagaaattcaaacgtaattacctatcaatctatggggtatcaaataaaatatctaacagtagttaataaattctaaaaatattaaggtgctaaatggaatacatatgtaagaacttgagcataattatgaaaacgtaagggttttagtagtaaaatagtatagcgcaaatgggctattttcatgtacttctgttagggcatccgctatgaattgcaatgtcttttcagtattttattttaaaaaaatacgatgtttacaaaccatgttgtggggctagcccacaacataacattattatttaacagaacatagtccattcatttagtccggatctgttgtggctg

SEQ ID NO: 92935 - DNA, 3194 bp, Oryza sativa
cgtccgttttctcctaccaaacagaccctaatataccatatgagcttttactaagctacagtatccggcccattttactcatttcaggccgtagcccactcccccctgaatccagttggcatgtgggcccagtctgagcaatcctgctggattcgacgtgcttcctccaatcgaccaatcctcgtcccttcccgtggtttcgtgttcctccgttcaactccatgattggtccgagcaagaaaagcctctctttttccttaggcccttccatttcagagccagtcgccacctgagccgagctctgattcttccatttctctctggttagatcttgcacttacctctccattatattgtgtcctcttacttcaaagctctttttttggggtaatttcgatgcaagattgcttcttgttgtagccgggtgcatcaatctgctttctgggtctgaaagattgatgtagcaaagatttgggttttgttcctgtttcagtgaccgagggaatcatctaccagattcggtttcttgatgggaagcagtaatcgtgaacccgtgcctgcgcggggattcggtagcctcgtgcagataccggataagattcagaactctctcaaggttgtttttttttcttcagaagtgaggattttttttttttagaggagttcgaattagctgggaaggtttgagttcgtttggttggatcttgctacaggtgcattttgggcgtttcttgaagaagaatggctttggtggtggttcagaggccgaaatgctgccgatgcaaatgcagggaacttgtactactgttgctcctgaggttaggttggacaagcagctccaagcttggaagaacaatcctatttggtctgatgaacctccagaaatcaaggtgtttgtagttctttcagtgttagaaatgattgtaggtcatatacaaatcgattgaagttgggctctttcagaaaatgaaatggtggttaactgattgtctgagaacaacagttatataatatatttaccagaaccgctaactttcttctcattgtaaacccccgaatattttcttcaacctcaatttgatgtattcagtaattttggaaaaaaaaacacttatagttgttcatcattttgtgggagatttcaggaatgagcaatgtaggcgactactgtcttgttgaaatgctaatgctaaccttatatgatcaaatctttacaggtgactgtgccacaaggctctctttgcaacctgaatctgaaatttaaggcaggattacctccagacgcagtttacaacattataattgatccagagaacaaaagagttttcaaaaacatcaaggtatgtataagcaagttcctgaatagggtaacaggaaacatgaaggctcattcatcatgatattgtggcacttgcttgatttccctgatttggttactgataccaaatgagcagaggaattgctctagtatcttaaccggccaagtactcgtgagaaagttcttgttccaattttcaggaagtaatatcacggaaagtcgtgcttgatgaaggacaaaggcaaatagttgaagtggagcaggcagcaatatggagatttctctggtggtctggtgtcttgtcagttcatgtttttgtcgaccagaacagaacaaatcacactgtaaagacttgaaacattgctactagtctttgagaaacagctaagatacattctctgatatgtggcttcatgcaacaactattggcaggtaaagttcaagcaaggaagaacaggttttatgaagaaatttgaaggttgctggaaaatagagcctctatttgttgacaaggaagcatgccatcctttagacccatgcacattagaaaagtatgattcctgcaccaatggcacaggaagagttggatcttcaattaccttggatcagcttattgaacctgctatggtacccccgcctccgttttcatggtatctgagagggattaccacgaggacaactgagatgctggtcaatgatctgatagcggaaactgctcggctgcgaggtttggcaaataatgctattgacaagcaatatgttgagggaaagtgtgatactagtagagatcatctaacagaagagtgcaatgatattaaggaaagatggcgtcagagaagaaaaacaggacggcatggaaactcccttagattaactgctcaaggataaactaggcattttcgcttctggacaggatgcattttagggccaatttacctgtactccaatggtaggtggttttcattgtagaatttgatgaattgcagggtattcatattgatattttgtagatggctaataacatcatgtgactagtttgtggactgtttcacacgactctttcgtacagtaataatgtaaaatggatgttcagctgtgtacaattgatgaggtgaataattgcccagttaaaatgtctgctactgaacactgctcttccatttctaccatttatctgaagcacagttttttttaacgaaccggccagcgccaatttgttcaaaagaaaaaatatatgtgcatcagactgaagcaaaattgaacttacttgaacctcacgacagttcaaacatgataagtatgcctgacacaacatttttatatgtgacaatatgaaatcacaattttggtacctcttttcacgaaaaaacatatgctaaatcggtgactgaaaactgaagctagatagaacaacagataccatttcctgagcctgaagtcctgaaccaaactgacggcaaactcaagttcagttgacaacacaaaccagttcatcctttctccaaagctgcaagccaagaaaagccccaaattccttacctttcttgacatgctcaaggcaacagcaaacaccttccttgcattgcatgagacttatgaacctaaaactctacatagcttcatggacagttcaaacaccttcgatcactcgatcgagctcgtcgaccccagccatgtccggccagcctccgccgccgccgtcaccggcgatgccgtcgcagccgcagccgtttcgcttctggctcccgtataggagcaatgtggcgtcatcctctcggcagcaaccgcggccatcgtcagggacggcgccggcgccgccgccaccaactccggcagatcgtccgccgagagcgtcaccggcgccggcgcgggcaat

SEQ ID NO: 92936 - DNA, 624 bp, Oryza sativa
aaccttatcttgatcaatttgtactggtattcatagatgatattttgatatattccaagataaggaagatcgtgcaaatcatttgagaatagtactatagacattgcgagatcataaactatttgccaaattaaagaaatgtgatttttggatggataaagtatctttccttggtcatgttatttcgggtgaaggtatatcagtggatcctgaaaaggtcaaaaccgtctcagagtggaaaaagccctcatcgataactgagatatgaagttttcttgggttggaaaaggccctcatcaaaaccgtcgatttattagtaacttcgctagaattgcagctcctctaacccggttgacacaaaagggagtaaaatatgagtggactcagacttgcaaagaaagtttcaaagaattgaagaaccggttaacgacatcacctattcttgccttgcctataatgggagaagaatttaccatttaatgtgatgcttcaaaaattggattaggttgtgttattatgcaaaaaggtaaggtattgcctatgcttcgtgtcaattaaaatcatatgagcaaaattatccaacccatgatatggaattagctgctgttatttttgccttaaaaa

SEQ ID NO: 92937 - DNA, 1950 bp, Oryza sativa
tacaaaattggctagcaaatacttaagttgggactctctacatatttataacaacaaaactgatttcttttaattatacagtttcattcaaaaataataatttgccctgccagtaagggcacatgcataacacttatatctttgcatatataactggtgagaactttagatcaagaagcattccttcacttcaacacatgcatactcctgcttgatccattgtcactgccatgtacttcagatgtccaagtgcgacacattagaaatacacatatgtttcattaataatagctacatgacaaaaaataaataagtttaattaatctggtgtctgatccgacctcatttttcagggaaaatatctaaacatacaaatacaaaaaggtactttagaaatgggcagcttgtaacctcttcggttatcatattaaaagctatgattcttcaagaaagcctccttgattcgtttcaatctacagagagcatcgcgcatggtgcttcgttcatcaggagactccagagcacaagacaacgcaacctccatgacaggaagtattatgttgttaagcatcagctgctgccggttctgctcagcactagcctgctgctgcccttcatggcagatatcaacgattgttcccctaaggcgctcgtcaactacttcatgagctcgatgcgggaatccatctcgcacccatttttcaagattcatgtcccctccaaactgcggatcaacaggcctctttccagtgatcatctcgaggagcaacattccgtactgagacatcgccttttgctgatggtttactcccatacccatattctgcacaatatagttttagtgtaaacatatcgcaattcattctttttttttcttagaataaacacaatgatatgaatgaacacaaattatggcaagctagaaggagcacctggtggaatatatccaatggagcccttaaggccatgagtactggatacatcttgtccagctgatgttggagacaacaaccgagccaacccaaagtctccaaccttagctgtcatgtcttcatcgagaagcacattgctcggtttgatatcacagtgcaccacttgttctccacaatcattgtgtaggtaatctagtgcactcgcaacatcaatggcgatgctaagtatcatatcggcgttcacccctgcaacattctcaccctgcctgcctttgtggatcaaatcctcaacacttccgcagctcattagctcataaaccaatgccctgaactcattgcctgaaaaatcgatactcgcacacatggtgactagctttactaagtagcggtgccgaacatttctaagggcctcacactctgcggtccagctcttcagtgctcccatcttatgcagatccaacaccttgatggccacagctgttctgctgcgcaacactgccttgtacactgaaccaaagccacctgtgccgatgaggtttctattgtcaaaggagctggtcacctggtttagctcttcatatgaaacaagtgggtgacttttcttgatgaagctgcctagttttttaggcttcctatttcttaaccatttccttggcaacagcagcatgcttatgatgacaacgatggtaatagcagccattgctgctgtgccaactgcaatagcaacggccatctttcgacgatgtgaggaatggatgtagtagcatagcatgtttgagtagcataattttgggttgccgtcaaggtaaacaacagagtggtccttaaagatgccgttgtttggcaccaatccatcaaggtcattcattgagaggttcagtagcctaagggcttgcatcttcaccaacgttgcaggtataatacccgataactggttgctagacaggtccaaggtttgcaaacctttcagattcccaatagtaccagggatcacacctacaaagaattggctgcagga

SEQ ID NO: 92938 - DNA, 2012 bp, Oryza sativa
  unsure (1)..(2012): unsure at all n locations
caaagcaagatacaatgtctaaccatcacaactaaagcttggatacctacaacagtggttccatttattattattactttttttttcaccagctacattgcatattacattggttggttcacttaccaacttattgttactaggacgataccttatacttagcatgcaagtatgtcctctggatgcctctaaagactaagtagaccacactctccactaggtctacatgtcaccatttccctctaacatctcatcttgactagtttctacgcacatcaaatagtaataataatatatgagtatgttataaatactcagcaagattagtacatatagctatatgtatttttttaaagacaaaagaaaatactacaacccatagatattaacggccaataaataataaaggacattaaacatagtaaatgagttaaatccacactgcagaggtattaacataatcgtcgtaatctccgttcttcaaccattttctctnccactagtgatacccctcgtntgagaatcaccgcccgccgatttcctacctgtgtgagggcattcacatntcacactaatatcagcccgacccatattgttatttcaggtattgggcctctcaggctaagtatnacaatcacgttattattctccacgataaaatcatcaatncattattcggtgttcataatactttntgttagattgttagtatcaccatttcaataatacctggaaacaaatttagtcaaagtaaaatagttggtgggtgccgtccttgcctgtcttttgttgttcttctctgcatcccatctaatcaaatataccggtccttcgtattaatttatatctatatttgtcgcgccggacattagctactgacatcagctactagcaccatagatagctggctgatgtgactatactagagaaagaaaaccaacatggagtagtgtgtaggtgcttgcacgcctctagtccagtgagcagtactgcatgcatgcatatagcatgtagtatagctgctagctagtaactcctagtctctatactagctaccacaagcagtggcggagctaggtttggaggagagggggggctcagccttcttcttcttcccccattttcttcttcctctccctcttttcccccctctcctccctcacatttccatggagtccagcggggtaacaggggctcgagccccctccgcccccacgctggctccgccgctgaccacaagtactaacctttcacactaatatatctacctcctgctgcatttagtacacaggattatgaaaagcaccctaaaaaaatggtaagtgtagcagcctactagtaccacaagaaatttttgctaatctagctagcttattactagctgctacttgctaggtctgaacactattaaaatgtaacaatacacttacctccttgctctgtgcagccctgtgcttctatggtgcgagtagtattcctaggtttttgggaggctttatagcagcagcttccttcgggtctaaggagacacctgcccagtttatgagaggaatggatagctttcacctcctggacatttatttatccatttttttaactggtccctacgatcctatccactggtgcatgtctatcctatcccctttggttagtaaaatatactgccctccccattctctttctatttctatctttctcacacactttaagttcactactactactactactacttcagaaattccgtcctcgaaattattataccttggtgatggaaaaactgaggatagtttttctggagatcatcttccttctcccatgtggcctcatccttggtgcgatgactccattgtacctttaaaaatctaattgtttggttccttgtttttcgatctttaatgtccaagatacaaacaggatattccagatatgtcaagtcgttctgcaactcagccatatgaatttcaacctgatcacttggcctccgaaggcatttacgaagcatggagatg

SEQ ID NO: 92939 - DNA, 619 bp, Oryza sativa
acctgaatcacgccatgaagggagactacggggaaagggaactctcggaaggaaagcaataatgacggtagacaacaatttattccgtaaagcccatttcatgggtctgcaacaatcttcattggtagctccttacatcgaggagcacttggctctagttcgcgctaggaacatcggtaagtccgatgcatggattacacggcatcacattgatactttccccgcatggctacgacaacatctcatgggtaacaagtcgatcaaccaataacttgccttcctggcgaggggaccgtttgggtcgatcgcgacattccagggatatgagatcaatgggtacacattctacacgagagcccaagacatgaagagcacgaaccaaaacagcgttgttcgtgttgatgccatgggacatgatagaacaactggcacgtattacggtgccatcgaggacatataggaacttgactatggtcctctcaaggtccctctgttctggtgccaatgggttaggttgactggtggaggcgtaatgattgatgacagtgggatgacaacggttgaccttaacaagcttggatactcggacgaaccttttgtccttgccaatgatgtaacg

SEQ ID NO: 92940 - DNA, 668 bp, Oryza sativa
atcggcgttaaggtcgggcaaggacggcggagctggatccagtggcgaagctagagagaaataagggggtgcactacatcatcacatataaatgacaatgtacagaattttcaagcaatattatactagttaatatatttttcaatagtctcattagcatagcataagtggcgatggtacaccgacaaaggaacactgacaaaaagaacgtaccataccgagatgaataaaccactaatatttggaaatacaccacctgtcctcaatatcttgcaacaaaggataatataaacatattaagtttccattgtaaactatagaaaaaccatgtgaaaacaaacaaattaccttttcataaatcataaattatatttgggctctgtcatgttcataaaacgatgaaccacagcttcgttggtgactttcttcatttcttctttttctatatagcaaataaggctatgactcaagtagtcatcaccgatgcgattacgcaaagaacttttcacaatcttcatagctgaaaaacacctctcaaccgtcgcagtggcaacaggcaatactagaactagcttcaaaagtcaataaactaaaggatagcaaagatgtttccttgtctctaccaacttttgtgaaagctcaccaatagtttgtatgttggagaatct

SEQ ID NO: 92941 - DNA, 785 bp, Oryza sativa
tgcaggaactgagttaacaaggaacgtacccaaaatcacatctggagcatcttgaacctcttgcagcagcaacatgattgacacgggcctttgatgctggtaccgtagagttgctctgggtagggacaaccttcacgcgtcggggcttcggacacttgtcagcataatgtcctgggtctccacagttgaaacacaccacgggcttgctgccttgctccctcttggcaggttgttgctgtgttggagctgcaacaggacgtggagcttgattgcggatgttgttgccagcattgttgttgaagaactgacgctgcggacgaacaacaaacgaagaacctccatgtggcatggactggggtcttaaagtaagacgcggcttctgattattcccctgttgtgtcttgaattgagcaatccgacgtttcttctgctccatgcgattgtatttgtcctcctgacgaatagccttatccactagcttctggaaatcatgataatctccagtcatgagtgggtaagaaagctcatcattaagtccttccaaaaacttctcctgacgctcttcaccattgcgcacatcttccggagcataacgagccagacgattgaactcgtgcagatactccgtaacagagcgagatccctgggtaagcgacctgaactccttcttcttcagagacaccactcccgatggtatatgcgtcttctggaaagcagcggtgaattcaagccagtgataggttcagcagtaatcctattcaggcggaagtgatcccaccattcag

SEQ ID NO: 92942 - DNA, 684 bp, Oryza sativa
catgagtagggtagttcttctcatgcggacgtaactgacgagatgcataggcaaccaccttcccatcttgcatcaaaacacaacctaacccaagtttggatgcatcgcaatacacttggaaacccttctttggatcaggcaaaatcaaaataggagctgttatcaagcgattcttcaactcttgaaaactctgttcacattcttccgaccacttgtacttcacatctttctgaagcaatcgtgtcatgggcttagcaatcttggaaaaattctctataaaccttcgataataacctgcgaggcctagaaaactgcgaatctctgaaactgtcttcggttgtttccagttggttacggattccacattactaggatcaacggcaactcctccggctgagatgacgtgaccaaggaacttcacttcagacaaccaaaattcacacttgctaaacttagcatacagttgatgttctcgtagcttctctagtgcaaggcgaagatgttcttcatgctcttctttggttcgagagtagataagaatatcatctataaagaccaccacgaacttgtctaggtattccataaacaccttattcatcaagttcatgaagaaagcaggggcattggtaagtccaaaagacataaccgtacattcgaacaacccatacctagtggtaaaagctg

SEQ ID NO: 92943 - DNA, 5824 bp, Oryza sativa
  unsure (1)..(5824): unsure at all n locations
attgcgatatctacactgaccacaaaagtctgaaatatattttcactcagtcagatctcaacctaaggcaaaggcgatggttggaattaatcaaggattatgatctagaggttcactatcacccgggcaaagcaaacgttgtggccgacgctttgagttgtaagagccattgcaatcatctgagaatggaagggatggctcctgagcttaaagaggaaatagcccagctaaacctacatatagtacctcgtggacagataaacaccctggacattcaccctcttttgagaacccagatagaggaagcccagaaggacaacgaagtgatccaagaagtgaaggagcgcatggccgctggacgtgcgaaagaattctcaattgatgagaaggaaacgctatggtataagaagaggatctacgtacccaaacagggtggactgaggggattaattctaaaagaagcccaagaatcagcatattcattgcaccccggaagtacgaagatgtaccaggatctgaaggaaggatactggtggcccaacatgaaaagagacatagcagaatatgtagcactttgcgacgtatgccagaaggtgaaagctgagcaccagcgaccggcaggtttgctgcaaccccttaggatttccgagtggaaatgggacgagataggtatggattttattgttggattgcctaaaaccgcatatggttatgattccatttnnnnnnnnnnnnnnnnnnnnnnnnnnnnnnnnnnngacggcgagatttattcctgtcaagccaaactatagcggtgtcaagctagccgagttatacatgaccatgatagtatgtcttcatggtgtacctaaaagaattatatccgatcgaggcacacagtttacctcgcatttctgggaaaaagtacatgaagccctagggagttaccttgcttttagcatagcttaccacccacaaacggacggccagactgagagaacaaaccaggtcttggaggacatgttgagagcttgtgcgttggattttagcaaggattgggagaaatgtttgccctacgccgaactctcctacgacaacagtttccaagctagcctaaagatgtcgccaaatgaggcattatttggtcgacgatgccgtaccccactaatgtggtccgagactggagaacgtgcgttgtttggacccgacataatcaaagaggccgaagaaaaggttcgcctgatccgtgaccgtttaaaggtggcacagtcacgccaaaagagttacgccgacacccgaagaagggacctagaatttaaggaaggagattatgtgtatctaaaggtttctccaatgagaggtacaaaaaggtttaaggtcaaagggaaactagcaccgagatatgtgggacctttccaaattatggctagacgaagagaagttgcctatcagttacagctactcgaaaacatcgccgatgtacaccgagtctttcatgtatctcaattaaagaagtgcttgagagtgccggaggaagcaagctccgttggaagaaattcatattagcaatgatctcacgtattcagaacacccagtccggatattggatgaagccgagaagaggactagaaccaaagtgtggcgtatgtacaaggtacaatggagtaatcacactgaggatgaagccacttgggaaagtgaagaattcttgaggactgatgtcgggacccaaaactaacaacttggatccgactgagattaatgtatcaatccctggatcagtaaaggttgatacatacaatataactggttcttcattgcatacgttaaagtcttacaatatcaagggttttacaataataggtattcttctaactgattgatacacagcggaagtttctatacattctgactagtgaggtataacctttagggattttctaaattatcgaggtcttcgtagtaatagtcataagggtcctcctcttgacccaaatctgaaaaagggggttataagagcaaggatgagtattcacaatactcagcaagttatctcggaaatatgatatgcactgacatataatagggttctttgcaaaaagtagtattggacaatctggaagaattatagcaggatttataaacatataaactttaggtttctaaccagggtaccatatgagtcccggtactcaattccatgagtacggctattcgaatagtttcaaagatattctactgcagtagatgtacgctttacccgcagtccacgacttgctgataatcatcggcttcagtcatggcccagtattaagtcattaacaattgtggcacctgttccatgaacttatatcctcatatgccctgaacgtaatattaacagcagcaagaggagttctggcgttcccgaggtatttaaggggaactgatcgtatgacaccatgtcatctcgatcagggtttagaaatataaccataattataattgagctcaataaaccaattacctgtacatggtaatggtagaaattgcccttcgcggctatagttgcctcctgcgcgaggacttaaaaaaaagaaccactatacagaggtgccatattgccaattaacctaataactaggtctgtccccattctagaaactgcggtcgtactcgttcgttcgacataagtacctggtaaatcttatatcgattgagacaatactagccacccggaaatcatccaaatcttacgtattgtcccaatctaagtataggatattttaaccagattgtaagcaaaataagcaatactaaattgtctgggtttctataattgatttatgcatagaaaatagaatattgaatagaaggctataaataaataatttgtaaaatataggcttaaatgatcaaaaggtgtatagtaacttgccttgctcgatgtcctgagattgattgatattatttagagtgtcagaggaatcctcaagacctagggttagacatataaaatccaaattcaaaaaggagttttaaataaaatctaaaaataagaaagtagagaaaataagataaaatgtaaaaataacaaaaaggggtccaaaagatagagagtgattttagaagaatattggtccaagtttcactggaattggatctatattttaaaagatatgggcttctaaagtttgaaaattgaataaaagagaaatggcactgtgagcgggtcccacctgtcagtctctctctctcttctcttcttcaacctccggccgttccccagatcgggccggcggcgttagggtttaggattgcggcggcgctagaggataaaagtagttgcggccgaggaggggagggagctagggatctccggcgacggcgagcggcggcggagaagttaatttggtgcgtggacggcttagcggctagggcggcggtggcacggttaggccgagatagcgatcaagatgataagggttagacatggctaggggaggggttctagagcatctacgaggtatttagagggattccgacagcttgccgacctttggcaaggtgcggagaatagttgccgacgagcgcctccataggcgacggccgtgttcacgtcggcagctcagagggtgatgtgttagtgcaaagggattgctaaaatagaatctaggtagtatgtagatggttgaaacggaagaactcaccgaaatcggttgaaacgacggattgcggccggaaaaacttcgcggcggtgaagaacagagcagcgcgggggcggcgatgctcggcttgatgcggcgaggtaaaactcgacgcagagctttggttagggcttagtatgctagaacatggctgatataaggtgttctatgaggtatttagggcggaggatggatggagaagggtgaagtcgatcgcgcacaaggtgttcgaccgacgggcgagggtggttggtgagatgggttgatgaagcagagcttcggggttgtggggctatggtcgtggatgatcgatgatggacagggaagggattggggtcctatttatagggctaggagaagcggatgagctcgggcaccgtcatcgccatggatgagcttgagctttggatatggttagggcggcagaggctgagagagggcgggcaagatcgatttgagtggcgggaggccacgttcgaatacttaccggcgaaggattgacttgaccgcggttggaatcggctggcgacgtgttggcgccaatccgagcatgacgcgcggcggcggcgagggtgaaaacagccggcatgggggtgaatggtttgaattgagggaggggataccaccgtctatcttcaatctaaccgtgcggcaagaattggcgcgatttatcccgggtagaaacgaaatcgcacccgacggcggcttggacgggagtgtacggcgtcgagcagtgatttcatgcggcggtcgtcgtcccggctttgtcgtcgtcgagattggtgcggcgacggtgggttgaaggcgttggacgggcggcagcgcgccaaggcggttgggcacgcgcgatcgatcccgagaccgacgcgcggcggctcggcgcgcggcaaagtcggctgccagtcggcgcgcgtgaaagggaggaagaggtaaaaagaaccacggttttgagtgggatgtggtcccctaggaccaattctaaactttgcataagattgggttggagttgggctgctctagctgggctgggcattctgtcgagcaccttgagtgcaatgaacagtagatttcaggaattttgaatatttccctagaaaagatttgaattcaaactaggagtttggaagggtttcactagggtttaaagtatggcaaatccttactaacattagggtgaactaagaaaataatctatggtttgaatttgagagaatttgctcaaattcactagggtttagaataaagggaataaattggaagggttctaataatacttgaaccaattttgttaaataaacaagaaatagatttttgaaccaaacaaatttaattaaaagccagcatgatgcagtcaaattttagtttaaaatttgaggatgttacaactgaataccctcatctgttcaacaaccggtaagaaatctcgggacgagatttatttaaggggggtagatttgtaacaccctgaaaaatccgacggacaaaatcgaaaccctaaaaatacggaccttcaaaaactttttaaataaattgcatcatgccggttttattcgcctatttcattggattttgatttcggagttcattaatcgcaaataaagaataactaacgaggaataaaccttaaaattaattttgctaaataaataattgaaatacaatttaaaataaagattaggagtggatagaaataaataaaatattatcgtagccatattggtaacaattaaatttatgtgtgagggaataagaattagccctaattaaaaattcaaataaattatataacaataaaatgtgggtaacattaatctcgggtgaatcttttggttaaaataacacaaatattgagtaaacttcatcggtgcaaaaattggaatttatagggcaagatttaaataggaaataggctaaattagggttaaataagagctagcactgttcattgcgcggtagatgctcgatgaggtcccctagctctgccccctcttctgcctcgcgcctgcaccccgccacgcgtcgtcgcgtcgccgtctcgagccccgcgccgccgtcgccatcgccacgtgccatcgccgttgcccgctccgagccccgcgccgccatcgccatcgccgtcgccgtcgcgccgtcgcgtcgccatctcgagccccgcg

SEQ ID NO: 92944 - DNA, 956 bp, Oryza sativa
tcccaataatccaacaattccaaagtgtccaggtgatgaaaaatatccgaaagtctaaagttgtaaaaccacctaatgttacctaattaaacagcgaagcatctacctaaaatcatactagtggtaccatgagtagagtatccactagttggggttttgtttaatctagggtgaacaaggtaataataacaataacaataataataaggtcataacaaaggtaaataggcatggctaaataaaacagtgataacgcgggaatttaaataaagcgacaatgcaataatttaaatcaaaataattttataaactaggattcaatatgttcaaggatgatatgacttgccttgctcgctttcccaaacgccggcttcaacttccacgaagagcggatcttacgaagctgcagcgtctacacgaccaacggaaaagaaaaggcctttactctaataaactccatataacaagcagaaacaaagcacaaaaatgggttcttgacttcttaaggaaaaattagagacttgaacggtccaattccgagttcaaatgaccaagttatggccatttgaaggttatatgctctttaaatgaatatttgcgaatttcttcatttaaattttaatttaaaattggatttattgcgtcagccgaggggagagggcgcgcggaccgggtccacgggagtggggcccacgcggcagcctcacggtccacggtggaccgggtgcacccggctcacaccggccggcgccgggggtcccacgcgtcagccgcacccgagggcgcgggcggctgacggccgggccccacgcggcagccactcggcgcgcccgagggcggccaagccagggtggccaagccagcgcgggaggcggcgcgcccgcgtcccgatggtagccgccggcgaccaccggcgcggcggagcggcggccgagagaagggagggaagggggaaa

SEQ ID NO: 92945 - DNA, 1918 bp, Oryza sativa
tttgaatcatgcgttgataggttgctcctgcgttcttcaatccaaagggcatggtgatgtagcagtaggccccaaagggcgtaataaacgaagtcttcaagcagtcggattcttttagtcggatctgatgatatcccgagtaacagtccaagaagctgagtaactcacagccggccgttgaatcgaccacctggtcaatgcgaggtaaccgaaaagggtctttgggacaagatttgttgaggtcggtataatcgacacacatgcgccattgccccgtctttttccgaaccaggactgggttagccagccagtcgggatgaaggacttccttaatgaagcctgctgctaatagcttggttaattcctccttgatcgcatccttcctgtcctgtgcaaaacggcggagtcattgcttgatgggtttggcgtcttccttaacatgtaaagagtgctcaatcacctctctggggataccaggcatatcggatggtttctacgcaaaaatgtctttattattctgaagaaaggtgatgagcgcgctttcctatttacaatctaactcagcgcctattacagcagtcttatcaggatcggagggatctaagggaatctttttcgtcttggcatcactttcttcggtcttcgtcagcttggttgcaggcacttctccttcgcttgccgtggtcgcagccagtcggatctcttcgcgggcgagagtagtctcgtgggtttgggccatcttgcaactttctttgtcgcatgtgacggcctgcttgatgtcgctccgttgtgatatgactcctcgaggaccaggcatcttcatcatcatgtaggtgtagtgtgggacggccataaatttagctaaagccggtcgtccgagtatagcatggtatgctgtctcgaaatcagcaacttcgaaacaaacattttctgtgcggaaattctctcgagtgccgaaggtaactggaagagtgatctggccgagtggtgtagctgacaatcctgggataacaccgtggaagggtgcattactcggttttaattccgtgcgaggaatctgcatatcgtccagggtcttagcgaaaaggatgttgagtgcgctgccaccatcgatgagagtccgtcggagcttgacattgcgaaccactgggtctagtaccagggggtaccgccccgggtggaccacttggtcgggatgatccgagcggtcgaacttaagtgctatctctgaccaccgaagatattggggtgtgttaagctgaaccgcattgatctcccgttctgttagcttctgttttctcttagactcataagccaggggtccgccgaagatgtgattaagttctttgcgatgatcttgaaaaccagtcggggcatcgtcttcatcgtctttcttctttgatgtgccttgatctccgtctgaaggtttacgtgcgttcttgacgtattgctccgtgaactgtttgtagacgaagcaatctttggccacgtggttggagttgggatgatgcggacattgggagttcattatcttgtcgaaggtgttgacgcgggaacgttgtcgggaagatggagagatggtcgccacaagttcttcgggcttacgcttgcgatccttgtagttgttacttccactccctcctgcagtcggcgtgtccttctttggcttctaagtggtgcccgactgtttggacgcggtgatagcatcttcggctggggctactcgttggctttttcgaacatctgcttaaccgtcctgggaggcttagtccgaacttgccgactaggtcgtcgtggcgaatgcgtttagtgaaggcggcgatgatgacgtcgtcggtgatgtcggagatcttgttgcgttgttcggagaagcgtcagatgtaatctcgaagggattctccagacttctgaacgacgt

SEQ ID NO: 92946 - DNA, 1092 bp, Oryza sativa
aagtgacactaaatatgaaaccctgcccagtcaaagcgtcagacctttgtgccatcaacatcagaagcaaaaacctggccataatcgcccttgtcatcctcatccagatagtcagaccttgcattgagagctagcatctggcaaacaagccagaagagagcagcatcaagggccaggaaagcggctcctccaaagaggccagtcttcgcagtagggcactgggtatccaggtcatggtggatgttgttgcttcggtgaagaccctcggtgaccgttgcccagagcaacattgcaaacgccagagctgagacaagcctgatttcacaagaatagatgatgaaaatgtatcaatggagttagcaggaaaacaaaatgcaatgtcgagattctcaaatatcagcagaattaagctagtcccactaaaaattttgaatacaggtaattcttttgatctgaaaaaaaaatgtgtcattggcacagcttagcattaatctatggaactgtacacgactaatagaactactaacacctttagggtccatctaaggcaatgattccacaaaacaaatatgtattttttttattaattaataattttgtagctaatcataatcaaatgaaggctcgatgaggtggatccgcatcaatgccagatactactgcttcaaatgcacatgaaattgttagctgcagatctgagaatcacttactcagcaataacgaagaacgcagataagctggcgcttcgaaataatgctccgcgaggaacagacttgctcttgtatggatagaagatagcggcatgccctacgatggtggttaacacaagtgacaccacggagaggcttcccattgcaatagttgggtcacttgggaacttgcagatgacaacatcctttcctttgataggagttccataaggaggctgcatcaaagaccaaataaaattcacaacaagtaacaattttcaaaagttcataaagagtggcagttgatgaaagatatagcgcagcagaagatgtgttactaccctgcactacagttaaagtgtatcgggaaattgcaccaagtggtcatcatagtgtctattga

SEQ ID NO: 92947 - DNA, 3208 bp, Oryza sativa
tttccggctgtagattagccctgattgtaaaaagcatgttccccttcttaggcagctagaggcccatgtggtgacccctgaccagataaaaaggaggcccaggcctaataaaagaagaggggggaaaagaaaggagggggagttgggactctggcgaatggttcctagagcctgaactctctctcactctccgccctctggattccttcacacacagatccaccacaacacaggagtagggtgttacgcttctcagcggcccgaacctgtcctacgtcgcccgtgtcttgcgcatttcttttctcgttgacgttccctcagatcgagggcgaagaacctcacttagcgcccccggccgaaccggcaaaggggggcctgcgcggtctcccggtaaggagccccacgctccgtcagactcccttaagagtcggttgaatctaattcatgctctttaccacaaaaccggatagaatgtctccccgaaatatgaaatcggtgtaatttgactcccttagtggttttggagggtggtttcgctgatgtggcgcttacgtggcggcattgactgggttttcatcacatgtggcgttgacgtgacgcttatgtaatattagaattaaaaatagatatgtgtgacccacatgtcatccacacacaaaatatacaatggacccactgactgtggggcccacatggtcatcctctctctccaacccttcttctttctcactctctcccccttatctctctctctctctttctcttcacgtcggcggccgtttgcgaggaatggaattggagcggcggtggcgggcggtggagcggcggacagggaaacggcccatatcccgttccggcccaacacatatgggccgcactagagttctggtccaacatatatgggccgcatttaagctggaatcttttgctccggtccaactgtagtgggctgccttcccaacggagacgacacaatacaatcatgatgacatcatcatcccaccagagcggggaaggaagaagctccgcgaagtccggcgcggcggcgagcacgagatggtggtgctccacgtcaggtgggctgcagcctcctcctcctcctcgccgccgccaccgtcatcgccggaggaggaagagatggagttcctccacgagtgcgccgcctccacccccgtcgaggacgtggcggccgcgctcgccggcgtcgcggcactccaggcccgcctgctctccctctgccgctcccttcgaggtcaggtcaccgcaacttcttctgcgagacccactcaagccttggctgctgtcatgaactgacgcgttgcggtttgtgttgcagagaggggcgcggcggcggcagcagcggcgggtgaggtcgagagggcggtggcggaggctgaatcctacgcctccaaggtcagcttctcactccgattcggatgctgctcagctcagatagttttatttggttgttacagttttgagcgatttataattttgtgggtttcaaagtatgtcgcctgaattgttcatatcaatcttcttcctagttgctacgattgattgagtacactagccttcaaattgaactccacaggccaaatggaaatggacattggcttcaaatttaattccacaggtcaaatgtatcactagttctctgctactaatacatgttacatgatttttaattggatgataggctgatattgcatctgtcaccacaagtgaccagtaactattctctggtacaaactaccattatgcaattactgttttgtgaaagggaatctaaacttggcatcgttgttctcttcaatcttcatcatttgtcaagctaaattttgtaaggtgtcaagctaattaagcaaatatatgcctgttgcaatcaatgttagagctttcaagttgaaacgacagcccctttccagggtatttccgttcgagatttttatatgtgcccggtttttattccaggagcaagtgcggtacaacagattcttatcccctcgtgctctaagggagcatatcaagaacatcgaaaagacagctgttaccgctctacaggagtctcctgaagcgttgtgcctgcaacagaaatcatcaggtaatgcatgaattgaatttgcgtgacgaagatatgattttccaaatgaaacggtagtaaatgttgtatctggagaaaaataatgaattgcctgctagattggctatttccatcttttgtttgtagttccgtcaatctttataaactgtatcgaccctgatgtgagttgttctgactctgaagttggctatttttttgtcgtaacatggtttttcttccctatttcacttaacacagaatatcatcggcttactgttaacttgttcttgtaagcgatatccaggcgacaagcttgagaatgttcaactttggtgggctggaaaagagctggccatgggcaagaagttatgtgactatattggtgttaatgacaaaacaaaggtaacctgcaactgtagtttaaaatggttccttcaattcgtgttttccttttttacattttctctttttgtattaacttatgcagattatcatcaggttaaagcatgttcctcaatcctcatgagctttgagtgtgcttcaactacccttcattgttcctgcagagttagtttacttttgtttttgggtagtatgctagtagtatgcaagttatccccgttgtaaattattattcatcttcttcagaaaactcctatttttatctgtgccattgaaaacctgtatagacaccttaactgtaacattttcttttgatatcttagtattcaattttgtcttcgagagatgtggccattcaaggaaggcaatagtccagaatttgataaggggttgggaaaacaaaccataagaagcaatgtccatggttaggttcaggctatcttgggtgggcttcagagtttgtatggaaactggacatcaatcaaggctgtctgggaaaagttcagatttactgagaaatgatcacacctaataccatgcttagaggaccatgaaatcaggtgataaccaaactcatttcacaacagtttttgttattaacagtgatgctctatcgattttctttgctaagaaactagagaatggtgcgcagaaaagttgcccagcttgtctagcattgcagcctatatatataaagggggccctaacatgatgggctcgact

SEQ ID NO: 92948 - DNA, 625 bp, Oryza sativa
gtgcatcttcggagtaccgtcagggaagttgctcggatttatggtatctcaaagaggcatacaggccaacccggagaaaatcaacgccatcctcaacatgaaaccgccaagctcccaaaaagacgtccaaaagctgactggttgcatggcggcgctcagccggttcgtctcacgactcggcgagcgggggatgctcttcttcaagctgctgaagaaaactgacaatttccagtggggacccgaagcacaaaaagcctttgaagacttcaagagacttctcactactccaccagttttggcctcgccgcatccacaagagccgctactgttatatgtgtcagcgacctctcaggttgtgagcacggtcctggttgttgagcgtgaagaggaaggccatattcaaaaagtccaatgaccaatttattttgttagcgaggttttagccgactccaagaccagatatcctcaggttcaaaagttattatatggtgtcttaaataccgtcaggaaattatctcactactttcaaagtcactcggtcacggtggtcacatcatttccactcggagatatacttcataatcgcgaagcaaatggacggattgcgaagtgggccttatagttg

SEQ ID NO: 92949 - DNA, 729 bp, Oryza sativa
attaaacccgatcagtagatccaaacaaggaaacactggatctgcccatcagtgacaccaattgaacaatgccccaaaaaaaaggaaaaaattatatgcattccattgcacgcaaaaatcgattatttccatcttccctagcaagcaaatctccccttgtctgaacaaacatggaaacaaccaacccacaccaatcaagcgcgtgcattaaaacacccccgaccacacgcggaaaccccgcacgctagctcgaatcaaaacccggatctgtgtcccccgagctgaacgcaaactaaactaaattaaccatcgtccccatgaaaacgaatcactataaaccatcaaccaaacgaacgaacgagccaaacaaaactgagctatagatccacaccaaactagcaccgacacagaagaagagcaagcgcgacggcaatggaggaggggatcttacctcgcctgggattgccgggctccgggtggatctcgcggagctgcgaggaggaggaggcgtcgctctgggcttgggggaagctggctgcctcgccgcgttataaaggcggcatacagctagcgcggggaggggaggggagcaccgagagtagcagtgttgggggctagtggagtgagtggagtgtgccgtgtttgtgcgtgtgagcgagccggtcgagaagaggaaataatcagacaaccgtacgttcggattaaactaaatacaaactgatcagcggc

SEQ ID NO: 92950 - DNA, 635 bp, Oryza sativa
ttccattccaacaaacggaaacaacaagtctgtcataatggggctagtcgagcttatgataggtaatcatccatttccaggtatttgcatcagcatcatcttcctcatcatctgtatctccactctgctgatcaagattcagagaatgaagctggaaaaagagaagcagaggttctacgatcagaacggtggccacatattataccagaaaattatctcagggcaagtcaatacagtggaaatattcacagaagaggtactaaagaatgcgaccaacaacttcgacagcggacaaaagcttggcgccggtggtcatggcattgtctacaagggcattctcagggacaacaatgtcgtcgccgtgaagcgctccaacttcctccacgtgacagacgccgaggaattcgtgcaggagatcatcatgctctcgcagatcaaccaccggaacgtggtcaggctcatcggctgctgcctggaagttgaagtgcccatactggtctacgagttcatctccaatggcactctctcctacctgatccatggcgatagcaggcggtatgcttcactgaaacttcgtcttaggattgctcaagaatcagctgaagcattggcatacctgcacctgtcgacgaacc

SEQ ID NO: 92951 - DNA, 702 bp, Oryza sativa
  unsure (1)..(702): unsure at all n locations
atggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagccatgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctacgatcccaggggctcacaggggccatggtgtacggcgactacctccgttgtcggattgcgccgctccagcgacgcgctcggngcgctggngagtaccaccggtcccgagacttcacgaggacccaccagggagtgagatgggactgggctcctgaggacttcaagatattggtccaacgggtgcttaatctcaactccgtagaggcggccctcaatccccaaggaatcctccccctctcgagcgatccagaccgtgcctccatcctgaccattatgatggcggtcggggcctcagagaagcgagct

SEQ ID NO: 92952 - DNA, 622 bp, Oryza sativa
cttatgtaatatgatgattaattagaaaaagagtgagtaatattttactacggaggaagcattaagcttagtagagactttaatcagttatactctatatgtttcgtattataagttgtttgatatttccacagttaaacttttttagatttgactattatagagaaaattagcagcatctatgatgccaaattagttttgttaaatttaacattgaatatattttgacacaatatttgaaaatattattatattttgttataaacttagttaaatttaaagaaatttgattaaaaaaattaaataacttataatatgaaatgtatcggagggagtactgctcacggatgtgctgtggtgcagtatgatcacgcggttaatttaattacagcaacggacggagatgtttgctttgctagctttgaattaattcctcgtcgttaatttcgttcatcagtactactgttctttacgaactagtctcactcactagctgccttgcagtgtcctcgaccggtcgttaatttccatggacacatcaaggccgcgtaataaacatatattgctggcacatataatttgacggatcgtactacgtatatgcccggaccccgacgtaaaa

SEQ ID NO: 92953 - DNA, 1677 bp, Oryza sativa
  unsure (1)..(1677): unsure at all n locations
cgcttagtcttctcagttttctaacaagtatatattaaatccaccagttataaatgattcaattggcgatcttctgtaggagacaaaatcttattttcatgctcaggcatagctatagaacaccagttttttacaaagtttttgactactgcaactctggttagagctcttaatgctacgaccaaacaccatgatgacttaaaggttggtgctgacagtcatcctttactaatctgtttacttctgatcattgtgtgctcatttctcgctttttcattttttagattcaagtgcgccttgacggcaccagactgtatgatgggtatatggctgaatatgatttggataatgacttttctgttgtcgaagtctatagtgtccgtgatgttcaggttggacctttccaaagtgcacttgaaagtctgcnccatggtgaggtattagctgtagggcatgacacctccggcgaaataatggtcgagactgtggagttgaatggcgattcaaaggtatccgaggatgatagagatcttcattgtaaaatctcaaaggtacacttgcatgatgatatgagcatttcatttttatttctgttaggcatggaggcaacagaaatatttgatttcttgtttgtatttaactcttgttctgtacaactttattttgttcaaatgtaacccgtgttgcttgttttatttcttagccttgggaaggtgggccgcttctttctgttgatggggatatggttggcatgaaccttttttttaccaatagaagagccatttttctaccatggggcacaactctcaatcattacttgacattcgtgcaaaagaagactggccttgtacaataaaaanaaatgaaggttcacaggtatgtctatttaatcctcgcttctctgtcttgttcctgccntatgattctacccacatagtgtttggcaccatttttcgtataagtgcactggtttgatccattttactttttgattagtagtcaactagtcattttttatgatctgcaggcctgaagcatccataggtgagaaatctaacagccatccagaaggtgagcacacaggcactcctcacaagtgcttaacatcatattgttatgcaaattattgagttcgtaatggtacctatttagaagctgtgcaagcgtttacatttgtacatcaattattccggccctttcagtagtactcttgtattgttggatcttattagttaacatatgtacaataggtatgttcatgcacgctgacttctaatgctaattgttgctcaggctgttataatgatataactcatgttacatgctatgtatgcgcagagtttatgtgaatttactttttgtgtatagtattagtatatgtcagtgctgatcacttcaccttgttgaccagtacatggagattntctcaaccaggaacagttagatcttgacttcatgggttatcctaagttaccatcctnncatgtaggaggtgagtcagtgcttctaaaaattgctgatcttttacagctctcatgtaccactaacaacttattctacaatgtatttatccagctggcatgatcttggttaattcttttgaagacccttttggcgacatatatggtgaaggtgtctggagaaaattcagcagaagagcttctatcctaaatcgca

SEQ ID NO: 92954 - DNA, 622 bp, Oryza sativa
ggttgtaatcctttactcacctactgcttacccctccctcctatgaattccttttcgtaccagtaaggaacattgagaattatgcagtatagtcatctaccagctctccaatatattttgtgtgcagtcatatacaacttgctgcaacgtccttgcccatcacaggaactaaagctgatcttccgaaaaaatctagaaaagaggatcttgagaatgttgctggcatgggatctgcaacagcaagtggtgggaagtttgatgagaagttgcctggcgagaaacctccaaagcatcctggcaaacataaaaaggtttttatatcttaatggctttgatttatgagtctgcctttgtaggctgaatttgtgaactatagctgaatcatgttgtttctgcagtttatcccagttgctgaaggggagggaatgggcaacctggggaaacagcagaatgacaaaattctgatgtctctacttgccagaaactctgaacagcttgatgtttgcaaggcaagttccaggattcaatggagtatattaaattgtgttttgcccaccatcattggcactgcttgttctgtttgaatgaactaaccgcatctgtaaacatttttgtaagcagg

SEQ ID NO: 92955 - DNA, 1191 bp, Oryza sativa
tgccggttgggcgctccctgttgggagcgccggcctcgttctttttgcctcccgcaggcctcccctttcgggtggcccgcgaagcgccctcgacggtgaggacatgaccctcgtcatcggtatgggctgacctcttcttcctcctcctgtcacgccgccctatctgagcggcggatccgggggcggccgaagctgccacaccggaaccggaggggttctaagtccatgcctcctccttatgagccactcggtccgcgagctgaaaaagctccgcggtagtctggggctccttggaggcgatcttttcaagcatgcggttgtgccgcacaccccccctgaacgcgtaaatcaccgcgtgcgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcttgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcctgggtcggaggcgttgacgaaggagtggcggccgaatggcgaacagcggctgccgctcgccgcgccctccgtcttgacgatgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgc

SEQ ID NO: 92956 - DNA, 1145 bp, Oryza sativa
tcgtcggagagatccccgagcctcgtatcttccactgctctatcctcttccgccttcgcctttgctgctgctcttcatgtgctgccaccacctcttcgtccttccctagccgtcattgccattggccgcaccaccatctatgaggacgctggccggcgtcgtactcttcatctccaccatgctgccgctccctctcctcacctcaccccttcccttctctagatcgacagagccaagcagccaacagggacagtaatggcggtggcggtggttgaaggtgttggtaggaaggtggcagtggcgggggatggggacgaggtggtggcgagaggtaccgttgccgccaccatcacctgtcgccaccattcgttcatgcctttatgtgtcggttaggcaaggaatagcccatggggatgggggtagagagatgcctttagatttctatagcttttctagtgtagaagcttttgcatgctcctatagccctatccacttaggctttcaccgattcttatgctggtcacgattcagtacatccaaataaataccaagcaaaccaatagcacgggcaatcaaacaataaatcaagccacttgcaatcaacgtactactgcacacaagggctggcaatcacaaaataacagagccaagccgccggattttgtttaaaatttgggtaaaagataaaataaattttaaaattgaatttttaatacgaattccataaaaaggtcattaaaattcaaaataataataaaagttgaacaacctagcaaagcacattctataaatatacaaaagtaagagtaattgaaactcagaaaaaaaatatttctgaaattgcttttcaacactaattccaaataaactttaaaagatcatgaaaattctgaataaagtaggaaaataattttgaaattactaaaatttgcgattaaaataagaaatatcaaagaacagtccatatagtacacaacacaggattaactaacttttgaaataaaaataaaataagttcaaaactggatttacatatgaattccagataaagatgaaatcattaaaatcacaatcacaaatataataaaaacttataacataatcgcggcgaataaatttcgatttcgctaggcattgatgacaaa

SEQ ID NO: 92957 - DNA, 560 bp, Oryza sativa
ggcagctgagaagcagtggactctgcttgactggaagcgcgaagatgtctgacatgctggctgacacattcggctttggtaggatcatccaagacgggctggtgtttaggcaaaacttcttgattcggtcctacgagattggggctgatcgtacagcttctattgagacattaatgaatcatttacaggtgatacaatggagctatgctgctttagcttttcttccgtatttttcactattggtacattatgttcgtggcatactaactgtaatttgaagctttgcaggaaacagctctgaaccatgtgaaaactgctggtctcttaggtgatggttttggtgctacgccggagatgagcaaacggaacttaatatgggttgtcagcaaaattcagcttcttgttgagcgatacccatcatggttccttttctgcaatccactactctccacatcattttcttggatggcaaaatttctctttttactcttaattcataacatttctttcattcttaatgggagtacttttgtccccggtgcatttagtgtcacaattta

SEQ ID NO: 92958 - DNA, 690 bp, Oryza sativa
ccatgtattcctcctctctaactgtactccatatttgctctgctacatggttgaaacaatcattagtaggctttgtaagccatcttccaaattttcatgtactacaataaaatagttgaaacaagcatagtttctgtaatagtgggctatagactaaagctccacttaatctgtatggctgctttactgcaagtacttcgcatttgataaagctcacatatatgccagatagtcgaagatgtggacatgcaaaagataccagttcgctttgcaatcacaagtgcaggtctggtgggatctgaaggcccgactaactcaggaccatttgatattacattcatgtcatgcctgccaaacatgatcgtcatgtcaccatctaatgaggatgaacttattgacatggtggcaacagctgcaatggttgaggacagacccatttgcttccggtatcccaagggtgccatcgttgggactagtggcactttagcatatgggaatccacttgaggtagctctacttcaatttctttttttgattctaagcagaagtcacttggaaaatagtacagcttgaaagctatcagttacgctaatgctgggattcatgcccacctaaaagctggtgttctttggtgaactgaaaaaaacaagctggcaatacctttgtgcgcttaaacattttgcatgctgt

SEQ ID NO: 92959 - DNA, 624 bp, Oryza sativa
  unsure (1)..(624): unsure at all n locations
cgggaatcttgtggcgttgcactcattgatgtctgcaatattaacaactgaacaaagtgaggaatcaataataataacttcatatgaatccatggagaacagcaactcgcatatatagggtgcatatataattaatttagcttgctctgtgtgtgtttgagagagagtgatcaaatttatttgttggagtccttttgaacaaatttatcccctccatctcataaaaagacccaattctaaccatgaacctgaacacatgcgtatgaattaattctgacctcggcagccgtctttgaggtagggatttccctcgtaaccttgggtgcagttgcatctgtacccgggcgcctctatcacatcgatgcatttgctgttattggcaacgcaagcatacgactccttcagggctgcttccttgcaggtttcattaccagcaatccactggagaattataggaatcccacgagcgagctcctnncatgaaatgtctgttttggcataggaactcttgaactttgaatgatccttctcgaccacgaacgcatagctgcgtgaaccaaaaataagaaattttttggttgtgttataattatagaatcctaaactgaacctcctaaggttggt

SEQ ID NO: 92960 - DNA, 1244 bp, Oryza sativa
gaaaacggtctctggttttgaattctgaatgtagttaacacatgttctcataggctgaaaatttgggtgcaatttttaggggagatatggtccaagttgacacatgggtagctgctgctggcaaaaatggcatgcgtcgagattggcatgttcgggactacaactctggtcaaccaatcttgagggctacaggtttgtgtttatcgttgcatttgttgcatttcttttgttcatgctgtttacagcatgttttatcccttttcgattgctaattgttcctctcttgtttgcagtgtttgggtgatgatgaataagaacactagaagactttcaaaaatgccagatgaagttagagctgaaataggcccgtatttcaatggccgttctgctatatcagaggagcagggtgaaaagttgcctaagccagggaccacatttgatggcgctgctaccaaacaattcacaagaaaagggcttactgtaagtcagttaatattgcttgttaccgtcattcattttgctggtggttctcatgcataaaatttctcatgagggatcctttgttcatgtcagccgaagtggagtgaccttgatgtcaaccagcatgtgaacaatgtgaagtatattggttggatacttgaggtaacttctttttccttttctctatccgaacatgctatctctagatcagaaaagagagtgtctgatcgtaattagtaacctagttcctagtcatatgccaagctgtaaaaacacttgcactgtatattcaaaagctattcaaatttctgagtacgttttggttttttttcctcagagtgctccaatttcgatactggagaagcacgagcttgcaagcatgaccttggattacaggaaggagtgtggccgtgacagtgtgcttcagtcgcttaccgcttgttcaggtgaatgcgatgatggcaacacagaatcctccatccagtgtgaccatctgcttcagctggagtccggagcagacattgtgaaggctcacacagagtggcgaccgaagcgagctcagggcgaggggaacatgggctttttcccagctgagagtgcatgagcgcttctgtagtttatccggcaagtaacctctttgagaagtgcagattctaacttggctagcaacacaggacaaatgattgttggtgggaaatttggcatgccgagcctgggttttgtgatgcacacagcacacattcagatttgaagattgagagatg

SEQ ID NO: 92961 - DNA, 717 bp, Oryza sativa
aatctgacttcctgaaatgttgtttctacaatctaaatttagtttttaaagtctgatttatacacgtctggtctatcttttgcttgtttcagtgaagagaaaagaacgaaaattttcggtagtccatacacaaaatgccatcagtccacttgcacttggtgatattgtatgttttctcatttccttttgaaatgtttagaataatagcatcccaagtataaacctttgtgatgacattccatgccctcttctcttgcagccactcatcaatctagacttgtgggaggtaaggaaatgacactgcgtttagatattacattatgctaaatattgacatatctacttttgtgtttcagcatgcttactacttggattacaaggtattttctagatcctctttttcttcttatacctaaaattgtaattcaccaagtactaagctatcataaatcactggtgatgcttccttttgatgcttcaggatgacaggcgaatgtatgttacaaactttatcgaccatcttgtctcttgggatactgtcactctacgcatgatgcgcgctgaggcttttgtgaaccttggtgaaccaaatatcccagttgcatgatatgagatgatatggatatgacctagagatatctatgcatgtattctcatcatgaggtaaaatccagcattttgcaacatcatatctggtacatatgcagcttaattatg

SEQ ID NO: 92962 - DNA, 791 bp, Oryza sativa
atattccatagtttttttccatcttcgactccgattagcttccatgcattttatcaatagttcagctacctgaaacagagaaaaacagtgcttcttgctttttaaaccaaggtatacagtgccgggatgtacgactcaaaatataattcaagaaatataatataagttctgatgtattcaagttcatatccttctggtgtggtatcagcagtcatgatatgaaattcttaaactatcttattttgctaatggagttaataatcattatagaagtttgcatagtctattagaatcctaagtatgtttctacatttaatcatgaatctcctgatgttttattcttttatgtcaaatgatttccttttattcgtttatagcttgaaaatgatctcttgtcagggatggcagtcgcaagggatctaggtgggaggaaaaaccgaatagtaacagttataagtaactggacaactatggctggtcaggtgtatgaggcaatgggtcatgccggtttccttgattctaacatggtagtgattttaaatgacagccggcacaccttgcttcctaaagcagatagccaatcaaagatgtctattaatgccctctctagtgctctgagcaaggttcaatccaacaaaggatttagaaagtttaggaaggctgcaaaggtaaaactttatgcttctgtatgacataatgtactagatttgaacttgctaataaaacatagttttttttacctgtcctgttatttcctgattatgattatagtatagacatatagtttctag

SEQ ID NO: 92963 - DNA, 1810 bp, Oryza sativa
atagatccctcgtgtttcaagtgatcaagtttctctcagaattggtgatacctatccctaccaaacttcccattaactgctacacacaactcccgaccaactttctacagcatgtaattcctcataagtttgtaaccacagagcagcatttcctacgaagtgaagggtagcaaaggaggcccaagttgcataaggaacttgatacatgtcaaagtatttttcagattttttcttccacaacttagggttatctccatcaaacttagggaattcagttttaggtaatctaggcccctgtgttccaaattgagaattcccaatcccccactctgaactctccccaacttcgaaattaactgcagattgagggatttggatcttactcttgaccagggttcgctcctgggcagactctgccgcagtcgcttcaccctggtacttgttgtccacgcggtgcccatttggcggaggcgtcgccgtcgacgactgggcctccagcttgatgacccgcgccttgattccttccaccgaccgccggaggccttgcattccagcgtccacgcttggaatccaagcctccacaccctttagcgatcccaggatgcggtcgaggttcgtgctgagatccaccaccttctggttcagattgacaacttctccttcagcaatcgacatcctctccgtcaaggtgggctgggatttcttgcgcgccagatcgaaagataccaaatgtgacgatcctagggttcggggctctagatttggggaatcgtcacagtaaacatggaagaacagaggaggaagaaggagaattcaggaccagaaaggttggtagtagtttgttatcatttcttttcttcgataccccacttcaccaacctcacagggtttataacacacccgtgctgttggctcggttcttataaagatggcccaatagctggcccaacacacacaatgtcccttacaaggcccattgatcatgacagcataggcccctatactgaatgtcttaacagtatgctgacatacacaaaaatgctcaatatagctcatatatgttctcttccgcaggatttagaatccaatacttaaaagattcaaaccagtaattgagaagctgcaaatattgaaccactgcatctttcagtactctgtctctatagctcttccttgtaaattgcagtgtaaaagaagacataagcttactgactaaaataatgtcttgtacaagtcataaaattgctctttgagggaaatttacactaattttttgcactgggatatccctttttgtatgtgatagacaacagatcactgatcgaagttcttcagatgattagaaattcttagagagcaccaagataatttaatcatgcatcccgctttgggccagatgcttttccatccagttgaatcattgctgattttccttactgattctgagattgcttgtacagtatctgtttgagagcatttctgctcaatccgaaccacacgcccaattttggtgtcacaggtatctctcagagtgaccagttgcacagacctggatttttcacattttggtccttttgaaaaacttatttcacaactagacccctgaaaaaacttatcccagaaatggtccttttttggcgccagagtggctggcgccgtcatccaacgggacggcgccagagaggctggcgccgtccttctgccactgtggcgcacgcgaaccgacgtggcaggaggagggcgccagccatgctagcgccgccgcctccattcctgtttctctatatggagttgcaacggtgtcattttt

SEQ ID NO: 92964 - DNA, 1248 bp, Oryza sativa
tccccgaacttgatggagcctcggacgctggagtcgaactcggtgaagaactcccgccggtcggtcatgtgatgggtggagccggtgtcgaggtaccacccatcagccttgtcgttgctggagccgttgccagaggaagacgagtaccttcggctcatcgaggtggaggaaagccgttgcggccggtgccgctggagatagctcgatgccgcgtcgtggctgtcgacagtctttggcccaatggccaagcttgccacagttgcggcaagcgtcgtctcgtgccggcttgtggttgccggcggcgccgccctgggcgcctctgcgagcaccaccctcggcgcgtcttcgcgcccaccgcagttggacgcctccgcgcgccttgcacggcttgcggccgcctgtcgagggagaggactcccccttcctcccgtcaccctggctggcctcccactgctcccgagtgagatggagcttcccgccaatggtgataggccccgagagaggctgtggctcatcgccgtcgacgaccttgaggcgacctaacgcctcctcgatcgacatcgtggagaggtccagcagagattcgatcgagcgagcgatctgcctgtacttctcagggacgtaacgaaagagcttctcgacagctctctcctcgtcgtaagtgtcgtcgccgtactgcaccatcttctgcaaaagagtgttgagacggagggcaaagtcatcaacatcctcacctggcttgaaggccaggttctcccactccttgcggagtgcctgcagtgtggacttgcgggcgcggtcgctgccgatacgtgccacagcgatggcatcccaggcctccttggcagtccacttatgggaaagcgagaactgcatctcgagcgggactgcagcgatgagggcatccagtgcccgccgatcctcatcgtagtcaacgtcgccgtaccggactgcctcccacatgtgccgcacctggagcctcaccctcatcaccgcggcccgctcgatgtagttggttttggtgagggtaggccacccaccgccgagaccaaagtcccttaccaccgtctggacgccgtggtgaccatggcaccggtcaggggagggagagccgcgctgcctgcgagggccgcgcgcgggctccgggctgccgccggcacgcccgcgcccatctgggttcccgtcggcgggtgcgcggtcccttgggccgccgccgccgctctgcccgttcccgtgcccttcctcttg

SEQ ID NO: 92965 - DNA, 1168 bp, Oryza sativa
gttcatgatcccacgaactatcggagtcttgctggcgccctccagtacctgattttcaccaggccagatatctcttatgctgtccagcaggtctgtcttcacatgcacgatccacgggagcctcatcttgctgctctcaaacgcatcttgcgttatgtccatggcacggttgattatggtcttcacatccgccgctcctccactgttgacttgagtgcatactctgatgctgattgggcaggttgtccggacaccaggaaatccacctcgggttatgctgtgttccttggcgacaacttggtctcctggtcctccaaacgtcagcttattgtatcgcgctccagtgccgaggcagaatatcgtgtcgtggccaacgcggtggtggcttcgacagcttcttcatgagctccatacccctccgagccgatccacattggtttactgtgacaatgttagtgctgtctatctctcttctaacccggtgcaacatcagcgtactaagcatgtggagatcgatctacatttcgttcgcgatcgcgtcgctgccggatctgttcgagtgctacatgtacctactacgtcacagtttgccgacatcttcaccaaagggttgcccagtgccatcttcttggagtttcggtccagtctgaatgtccgttcccacgacgttccgactgcggggggtgttagattgtgtttatcccttgccatccttccttaatcttctccgatattgtttctataaatcggttgctagatatggaaggcatgtgcctatatgtactctaccatatgtgataatccaatctatcgtgttgagcctgtcgtcgatgacggtccagctctcgtcgccaggcttggcaatggcgcgcaccgtgggatcggagaaatcgactgccactactgtggaggcatcctcgacgacaaaaccggcggcgttcacgcgaagacccacgccatgggcgcccaaacgccagctcgctcgtcggcgccactccggtgtcaggagcgctgtcaccggcgggaggtcggtgcggtggcgggtgagcgggttcaggaggtggaggcggaggctgggctcgtggagcagcagcaggaggccctccggcgtgagcgccagcatcgtgtggtcggcgagctccgggatgtcgtccgtgtggatgcaccc

SEQ ID NO: 92966 - DNA, 557 bp, Oryza sativa
gtcgagtacgtccacttcgagggagctgggggagtaggcagctctttttcaccgagcgtgtctaccccagcccccgaatctccaccgactccgacaccaacacaccctcgggccacgacttcgactacgacgagctcttcgtcgacaccacctcagccggtgaccccacatgctccagcaccaacagccactccaagcacgtctactccgacgccagctcgtgttgagcgcaacccggtggagttcgctactccgctctcccacgacggggagcgcatcgacgcgtaccacgacggcgagcagctacggtaccgtacgatggaggatcttctcggcgaccagccggtgccgggactggtgcctcgcgacctggaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgaccttcctcgtggtcaccgcgcgatcacccttaagtgggtgttcaagct

SEQ ID NO: 92967 - DNA, 650 bp, Oryza sativa
ggagctcggatgaattagttatgaattttagaagattcactgtgtttattactataaaagaaatccttaaataatttattgcgcaatattaaccagggctgacgtcagcgagggggcgcggcgccgacatgcggggcccaccggtcagcgaccgggagagagagaaagggggtggcggcgcgcgggcccactggtcagtggcacggggaaaaggaggggcggcggcgccacgtggcggccgaaccgacggcgacggggacctcgcggccggggcgcgcggtaaatgcggccgccggcgcggctcggcatcaaagccgaccggccggctgggttaaacggcgacggcacgcgtgcgacgacggcggctaccggcggcacgggaaacggcggcggcagtcgaaggcgacggccgacgactcgaagcggcggctagcggctctaggaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagagagggattagagagagagagatggaccatggcgatcgggatccatggccgaaggcggcggt

SEQ ID NO: 92968 - DNA, 568 bp, Oryza sativa
cgcgcccaggtgaggaagcggacttgcacgcagtacagcgaagggatgatgagtcacttcgctcgtacattcagcggttctgtcaagtccgcaacaccataccatgcatccctgcacacgcggtgatttacgcgttcaggggaggtgtgcggcacaaccgcatgctcgaaaagatcgcctccaaagagccccagactaccgcggagctttttcagctcgcggatcgagtggctcgtaaggaggaggcatggacctggaacccctccggttccggtgtggcagcttcggccgcccccggatccgccgctcagacagggcggcgtgacaggaggaggaagaagaggtcagcccataccgacgacgagggtcatgtcctcgccgtcgagggcgcaccgcgggccacccgaaaggggaggcctgcgggagacaaaaagaaggaggccggcgctcccagcagggagcgcccaaccggcaagtggtgcaccgtccacacacttcccttcacgacctcgcggactgacgtgcagtcaaaagtttggctgagcggacgaggaagtgggaggaggag

SEQ ID NO: 92969 - DNA, 1221 bp, Oryza sativa
ccatttgctctagttcataatcatgcattgaaacaatactgagtaaagtgccgaattgaactatgcttcacaacccggggaaaagacatcattgaaatcaatacctggaatcttgctataaccttagcaactacctgtgctgtgcacatcgcctcaccatgaggagatacacacccttctcttgaaagacctatgcacagcgaaagaggtctcttctcttggcacattttcacaaattcccaagtatgattctttacaagtgactccatctcatcatgcatagcagttatccatctatggcaatcatcagaaccaatagcctcagaatatgtagaaggttctgcattaccttcaatttcttctgccacactcaaagcataagcaactatgttcgcttcttcaatatatctttgaggaggtttagtacttcttttgggcttttcttttgcaatagaacgttttggagactgctgaacagtagaagaatttgtatcttcaataacaggtgcatcttggtgaacagtagtgaacccttttccatagactttgaggcgaatcctcgtcaaagctgcaccttgtgatcttcccatggctcgcgttcggccacgtgctcccttacctagagctcgcagagcgcgtggcatcgcgtggccaccgcgtgtccttcgtctctacaccacgcaacatcgcgcgcctcctgccggtgagccccgccgtggcaccgcgtgtcgacctcgtggtgctgccgctcccgcacgtcgatgtctctcgtttggtgccgagtgcaccaacgacgttccctccgacaagttcgagcttctctggaaggccttcgacgccctggcgccgccgttcgccgagttcttgggcgccgcatgtgtgggaacccgagcccttccggcaggtggtgacgttcatgaaaaagcggcttgtccccctcggccttctgctgccgtcgcccgacggaggacgccgccgcaccgcggagatggtcgacgacgccaccatgcagtggctggacgcgcagccgccagattcagtggtgtacgtcgcgctggggagcgaggtgccgctgcgcgtgaagctggtgcacgagctggctctcaggctagagctcgccgggacacgttttctcttggcgctgagaaagccctgtggcgttgatgactcggatgtgcttcctctcggctttctagaacagacgcatgggcatggacatgt

SEQ ID NO: 92970 - DNA, 601 bp, Oryza sativa
tatcgcttggtctattaaaagggattagaaaaccgagctgctggtgctttatctcgttgctctcatggaaaagtgttacagttgagtgctttgtcatcttgcattccgacttggttggaagaagtaaaaaatgggtatgctgctgtaatcggttttcgttgagaggttctttagttagctaaaccttagcattgttagacttgctaatttatatgatgacattggggccttttatactgtacagctggcttacacacattaagatatggataacaatattgggggctccacaccaacatcgttaagaagatcatgtgagtttttttatcgctctatttaagggcaaattattcagtgcattaagatgtgttttgcatgctgatttcgaatgatttcctccctcaggcccttttgctgatattaataatgcgagtgctggggattcgcccaaaaaacgtaacaatattggggtcttcacaccaacattgttaacaaaatcaagtgagtttttttatcgggttacatatgtgactaatattcagtccattcatatgtgacctgcatattgatttcgcaatatttcctccctcagccccgtttg

SEQ ID NO: 92971 - DNA, 1470 bp, Oryza sativa
gatatgctgcgcgcatgcgttctagatctcgggaagacctaggataagagtctcccctatgccgagttctcctacaataacagctaccaagccagcatacaaatggcaccctacgaagcgttgtatggacgcaaatgccggacaccgctattgtgggaccaagttggggaaagccaagtgttcgggactgatatcctgagagaagttaaagcgaaaatcagaaccattcgggagaatctaaaggtggcccagtctcggcagaagagttatgcagacaaccgacgccgtgacctggaattcgcagtggatgactttgtgtaccttcgggtcacgccattgcggggcgtacacaggtttcagacgaaagggaagctcgcacctcggttcgtgggtcctttccgtatcattgctcgacgcggagaagtcgcttaccagttggagctgcccgcatcattgggcaacgtgcatgatgtgttccatgtgtcgcaactcaagaaatgccttcgagtgccgtccgagtaggccgactcagagcaaattgaagttcgcgaagacttgacctacgtggagagaccggtgaaaatcctggacgccatggagcgcaggaccaggaaccgggtaatccgtttttgcaaagtccaatggagcaaccacgctgaggaagaagctacttgggagcgtgaagacgagctgaaggcagcccatcccgatctcttcgccagttcttccgaatctcggggtcgagattccgtttaaggggggtaggtttgtcacgtcccaaaacgaccgtaaaatatatcctctaaattatgcctagaataattaaaatccgtgtgaaagcctccaacaattaaaatgtgcaaagttaaaagtcaaataatgcttagaggatttttgtatatttcctaaaagcctaaaatacgtaaataaattttagtggaattttcagagcacaaataataattgttaagaaataaacaaagttaaaaaggttttataaaaagaaaaaaccctaaaaagtcccccttccctcccttgggccgacccggcccatctctccccccctttctctctctcctctccccgcggcccatccggcctctccccgcgcgcgcgccgctgacgggcgggcctgcccgccaccctcgctgacaattggggcccacccgtcatccccttcctcccgccgctcccgccgcctccccgcgccctagcgccgccgccgccgagaatcccgccgcctcccgccgtccccgcgtgcaataaagtggggggaattactccccgtgatcccctctgtctttcccgccatttttccctctctctctcgcgtgcaaacgggcggatttgcccccgcaaatctcgccggcgccattgatgatggccgaacctcccgcgccggtgtccttcccctccggccgctctctcccccttaaaaccctatttaaaccctccccgcacctcctccgt

SEQ ID NO: 92972 - DNA, 726 bp, Oryza sativa
attgttaaaatttctaataatcatatataattaacatacccatgatttaaagttgttttaaattctagtattcatatgtaattaacataagcaagatttaaaattgctttaaactctaataattatatataattaacatatgccatacaacaattaaattatatggatattcaatgcatccaaaacatatataatcaatacatccaaaacaatttacatcgtctacaaaacaactagggcaatacgttggcggtgacgactgaccgcacgtactttctcctcactaacgttcattccttattatcgctgcgtgagtaaggggtgttttcatttgataggaggatgctagggtcaaccgtcaccgcgaacggaggttgcccgtcaaattgatcataatcctcgtcagtcttatcctcgactccgacgatttttcttttgcctaggagaaccacgtggcgcttcggctcgtcgggccctttccccttctttcctttgctagacatgtcctttatgtaaaaaacttgcgttacatcgtccgagtatccaactgtaatgcctcgagtttcgaattaatatatttcgtggaatattagaacaaacgcacaaaagatcaatttttaaactgttgtttgaataggcgatcaggaaccgtgaatgcgtagagctcgccgagtagtgccaaatagactataagtttatagtaatcggagtctgaacgaagtcccg

SEQ ID NO: 92973 - DNA, 4707 bp, Oryza sativa
taatgagatcattcgttcttgcttgatggtcgagtcctcacatgctcctcagctctgtcatgaggtgctgccctttgcagttgtgctgaattatccaagaggctgtggaaacatttcggttaaattataaaatggcagaggattctagtacataatctttggttgtaaacaaccacctagcttctcagcatttggctgacctactcacacgaatagcttactgttgcacattgaaaacaaacagcttataaaatagcagaggattctattacataatatttggttgtaaacaaccaccttctcagcatttgactgacctactctcacgaattgcttactgtcagctctgttacgaatacaaactgtataaatcattgtgtcttaacacatatataacaaatcatctatgcaaacaagttcttttattttagacttgaagcagagaaccaactgtatgttccaaagctagttatgcaatggttaattcttcatcttgccgatggacccaacatggacatcgaaaacttgttatctcttgctatattttccatgtcgcccatgtccccatgagcttcctccaattccaggctttccttcaattgcatgaccacggcggacatcattggcctttgagcagcaatatctgctgtgcacatcatggcagcatctagaaccttccacatggagttgacgttataagaacctccaagacgtgcatcggcaactgagctgatgttaccagtgaccatcttctgcttcacacgttcaacaatgtgaccatttccaggtattatggtaggttcaccactagttacctctagtaaaacaacaccaaagctgtaaacgtcactgctctcagtgagtctaccggtgatgtagtacctaaaaatggcccacattatgttaaacacaatgattgcaccaagtgattaaggataaaattgaatagaatcattaaaatatatgaatacacagcacaaaattagcattaattgtgtagaaagaagctcatactcagggtcaatgtagcccatagatcccgctgcaatggctgatatgtgagtctgggagtcactatggtaggtttttgaaagcccaaaatctgctatttttgcttttaaatttccacccaagagaatgttatttgtctttacatccccatgaattattggcaggttacaacccttatgtagatattctagccctacatacaagaaaactacagttagatcaagagatgagcgataaaacatagaaatccatttatatcactgagatcagtttagttcgatgatttgtcatcgattttgtctttcttataatacgccactgactttgtcaattttttctacaatataccattaggggtggatacttttagaaaatacctaaaatgctcttcaagacatacaagaggttacacctactagaagttttgaataaatttgaaaatttttatgtagcctccttgcataatataacagtgtgtatatttcaagatttttcattttgcacgtattaacttttaaaaaatataatttatgttttatatggcaacaaaatactctcgtgttaatattcctttatgtatatcatcattcacatgttgtaccttttttattgtgatgtggctatcttttgtgtatatgattcctctttcaaacactatataaaattattatttaaaaaacatgaaagaaaaatttaaaatatacacacattctatatttcgtaagaaggctaagtacacaaaaactttcatattttttcaaaacttctagtgggttaaacaattgtcaactcttggataactcgaagggcattctaggcatttcagaaaagtatccaccacaatagcttactgtaaagtcagtgccatttatattatagagggagacaaaattgatgacaaattgttaaagtaggataaattcagtggcatagcatagattctttctttgcgtatttgccattgtcttcttactgtagcataccttgtgcagcttcaagcataactcttacgcgtgttgcccaattcatggttccacccatgctagttttaccttcatacattacttatacgcaattaaaaggtgagggggggagggggaaaaggggggtaacggtgttaattgacaagtcaaaacagtattattcctttaaaaaaaggatagaatcaatgtaataatttattagatagatacaaccatctcttgatattactatgtctgcacaatcagtcgagatagaccttcaataatgcaaaaacatttattttgtatacaattttaaacatccacacaatttattattgtgttgtattaatcagatgtctagataatgagatgatgagcaattatgaaaaaaaattggtaatgcaagattaacatattctatacttgagggcagcagaattaagggtagttttttgttttctgtcgtactaaataactggcactattagaaccaaggcaagtttgggcactactaaattttttgtagggtagagttgcatggatcatctttggttagaaccaatttagagccaaatttgattggtacatatagagttaccatattaatataggccttgctaatagtttggctttaatacaaactactcacatctactattcaaaaaaccaatagactggtggggcacattttagtatccaaaaattgctctaaatatattatgatatctttagtgagtttaagcgatggccatgaagccccttaggtagagactaactatgctctctccagtcttttttttttctcaaaatgtctaactatgcactctccaggtaagcagtactacttgtcatagttctgcaaactgttatgcaacatgagttaattggcttcgctgtgagctggttcggtcatgcagagtatttaagttgtaaggaaggaatgactagttggtctacgtaatgtatatgcccagtatcctccctcagatttcccaaatattcaatacttaaagattgcaatggacaaacctctcagataatcactaagattgccactagacatgtactcgtagacaagtgctaaatgatccttctcccagcagtaaccaatcaaagaaacaagattcctgtgattcaccttggtcaagctctgaacctatgtaatgggacaaaacaaatggtcaaatatcttgatgcgtatgaaacctcacagtggatgcgactaagtttacatgcacatatatggcattctaagtattgaatcttttttactgaaaacagattgattttatctatggttaaacataatagtaactatatttggcacctcagctaagaactcatcgagcccgtgggacgatgattcagatcgcatcttaacagcaacctcggtattgtcttctaaacagccgtaatagacatttccaaagcctccatgcccaattaaacatttgaagctatcagtgaacttcgctagttcctcatatgtgaatcgacgattctcaggtttttgtagatggtcccaatgatttgtccaatgtcctggaggacttatctgttctggtaccgtgggagaatcatctgtagaaactggtggagaaagaacatgtttagcagtattaaatgcagatattaaacaatgtgtttttcaatgcagattatagtattacacacaatggggctttcttttggctctccagatcaaatatgctacaacaagcatggcgactacaagcactggagccgctacataaacagctaaggtagctgctctgtttcttgaggacgaagttattggttttttgcacatatctccgtcagactcgtagctgaaattacataaaacaataagtccatggttttaaattggtatgctcgccaaataaaaatctacaccaaaattaaagcacatcaatggtgggaattaaaagtgatattagcagagtaattcccattagaaaggggcaattttgtccttagaaaaatctgagcccgtattcttgttgatcctatcgatcgagcgatggattcacagcgcgggcggcagttcatccaccaaggcaacgaacatcagggtactgctagtaggcgggtgatcgcttccccctactcctagcgatcacctaccaaggcaacgagcatcaaggtactgctagtgggcgggtgatcacttccccctacttctagcgaacacccgtccctccccccctatacactcttcttctcccccttcctctcccttcttctcttcctactacaacacaccataaaatttaaaaaaataaaaaaaagttagaaaaaattatggatagaaatactatatataaaaaatttgaattcaaatttaaaattgaaacgggtatgtaaaattttgacttataaactttgggtctataaactaatatttgaattcaaattcaaatttgaatcagatataattcaaattcaaatttgaatcgggtatataaacttttgacttataaactttgggtctataaactttaggtgtataaactttagatgtatagaaatactttatataaaaaatatttgaattcaaattcaaattagaatcggatatataaacttatgatttataaactttgggtctctaaactttatatgtgtaaacttgaggtgtataaactttatgtgcataaatttactaaatggaaagtaatgcggtaccaaaaaaaagaaaccacttagaggagaggaaggaggggggggg

SEQ ID NO: 92974 - DNA, 1493 bp, Oryza sativa
ttttttccttatacatttcctttgctttttttttaaaaaaaaacactgtgcactgcaggctggcgggctggcggcctgccttcacgggccgccgtgccccgaacggcccgtgggccgcgggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggacacctatacccatgcacgtgatggatagggagcacggatccacaatatgacttttgctaccggccacggcgcctctaggcctcaggagcttgcatccacaccaccgagcctggcatttcctccttagctcctgccgtcgaccctgcctgcagtcaccaggccttgtgggaccggatcatccagcactggctagcctcaggggcatggatccaccaaccgccagccttgaaagcgtggatccactttccagcctcggaatcttactctttgacccctttttgtgatcaatttattgaatggattttgaggattgtgataagtttgtgaatggattatgggtggcaaggggaatagaggaatttggatctaccatagggggatattttggaatcagcaggtttttttttgcactctgaaaacattttcataggcagatcactttaggccttaaattgcagttgtcgcgactagccgcatgtcaaaaactgttttggccgactatggaaatgctttttctagtagtgtttttgagtggcagatccggcggcggcggctccccaagcagtgggcgctgccgcggcagcgtgatggctcgctgtggacctgcgatggacggtgagaagcaagcgcgaccgcaaggtggagatggaggaaatgttcgatgccgttgtcatggccaccaccaggtgctactcccagccgaggctctatgcgtcgataggatggacatgtacaggtggaggaggcggcggttgcatgcgtgggtgcaccgtcaattaacaatggcgcccgcttaccttctcatgttacgacaaaaggttatggcatgagtgttgattttgtagattagtcattactttgtacaatatatgcttatgtatgtctttctttcgggaatattcttatgtatgttcttataaatcccttgctgggcccattcataatcgaaatcctggcttggctgcaagggataaaaatcattttggactctatctagagactaggtctgtttggagtagcatgcatacctatatgttcttcctaaaatctttagttttttaaacaattcatattttcaatcagattatgaggggtatagttatagaatccagaaaacgaactagaaagcagaaaattaaagataaaaaaatcatctttttttccaattttctcactagctgttctttaaaatctt

SEQ ID NO: 92975 - DNA, 8451 bp, Oryza sativa
ggttaatggctagtattcctagtcaatttgcgtttctattaattggtaatcgtcttatatatcaaatttcacatatacaggtaccctgatgatcagtacgatcggttctggtccacagatgaagcccatcccttgtcgacaaacatttccacccaaactaccatccaacctagcaccgaatttgcggtgccctcgcctgttctccagaaagccattgtgccgagtggcaactccatgaaactagttttcttttccggccaagtagacgtccttcttcgtaaccacttcgtgatcctgcatttcgctgacttccagaacaacaagtcccgggaatttacagtttccatcgacaacggcgtgcatagcagcccatacagtacaccgtacctaaatggtttgtcagtcaccggcagctggtccagcgattctgaaggcaagtataacttcaccattgctgcaactgccatatcagctctgccccccatcctcaacgcttacgaggtctacggtcgtattgtccatgacaatccaacaacgttctcccaagattgtaagctcgctatatctgtcggtctcggttgaggtacactaaacaaacattatcaactctccctcttgaactcctattttttttcctcgtatgctagttgatgcgatcatggctattaaatatgagtatggaataaagaagaactggatgggtgatccttgttttccacatgaatatgtttgggatggtgtgaaatgcagcgatgcaggtgataaaatcatgaggataatatctctgtgagtatatttgaaaggtatgcatgtactagcattattaattgtatacatcaggctaaattttgttggattacttgaaattattatgcagtgatctttccaacagcgaattgcatgggtcgatatccaattctttcacattgtttactgccctcaagtacttgtaagtatatctgagatcccctctgccttcagttgttctgcatttaaaactcccaattgacatgactatgcatcatcttccattaaaaatgaaaaacaccgactaaatattatctagaggggtgaaaatggtacggaaactttccggattctggacctattttaaaaaacggaatctgtcggtcggagtttttttggaatttttcggaaacggaaacgaattcgaaaatattttctcggaaacggaatcggaaatgataaggccagtttccgtcggaactcggaataagtcggaaactttccagaaattttctaactaaaataccctggattcatttttaagcactgaatagtgaataccatggtgtttggctgttattctttaaaatatatttgttatgcaaatctgaagttatataagaatattttttttctgcattgggattaatcaacatcattactctcttaaacatagataatttattccatagattgtgttttgtgatgtactgttgagacttaaaaattggacttatatgattgtgttttatgatgaatcgttgaccgttgagacttgagaattggatttattggtttgaggggttttgtattctcataatttttcgttaccgtattcgcgttggttcgtttttgctccgttttcggtttcgataatattcgattccgttttcatatccggagtttccggttccgattccgattgcgaaaaaaaatgaaaacgaaaacgataatgatggttttcgtccgtttcagtattgttttcacccctaatcaagagtgatgcagctttactttcataaagtggtaaaaatgaactaaaggtatgataactaggggtgagtgcgagtggatattggctgctcttgggctacaagctaccccctgtagtgaaggaatactattcttgagactccagagagggtaccacttagtatctattatttttcattcagaatcactaaatcaattgaaatatataattgagactttaaaccagggacatgaagatcccagttatcatagtacccacctgtaagactgttatcatggttctgaacctataaaagaaatcatatcatatgaaaaacaacctcattaacagtttggccaagtgttactatacgtgtccgaattcgtattaggtttgtgtcacatctcgtactaggtttgtttttttatgggacagagctggtaattctctatgtaccacagtatccaaagctgaacataaaaactcttggtaattttaaagatatctgagtacctgacggtatttaaagtggtttgatacttatacttggaactttacagtgttgttataaaagtctgcagtttgttaacaagccatagacatattgcttaatgccaaaattatatatctctttgtacagaaacttatcatgcaaccaacttaatgggacaattccatactccctcctcaaaaataatggatcaattgatttcaggtttggatatttttattaacgttggtttctttcagtaatctttaggcaaattagcactgaacaacgattcttttgaacccttcaggactgatagttttatgtaatttcagttatgagactgatggaaatatgtgcaaaacacctgttactccatccctgtcaagaaatagagccgttaccttggctgtttccgtagtggccccagtgctggtactggccatacttgttctcacatatttgatatggagagccaaaagaaagctcaatagtacgtatgctctgttataatagtctgtactgaaaataattgactcttatggtttaataactcaatgtaatattgctaatactttttttttttgcactagcttcttcaactgatcttgccatggtaccagaactcaggggtgctcctggacatatcacaaatcattgggaccatttacaagaacctgaaaatcgccgattcacgtatcaggagctagagaagtttactgataacttcaaacatttaattgggcatggaggcttcgggcatgtgtactacggttgtttagaagacagtactgaggttgctatcaagatgcggtctgaattgtcttcgcatgggcttgatcaatttttagctgaggtgacaaattcagttaccactaagttcaccacagacaaagtcaatattgtcactgtcatataacttaatcacagccacagtgagatttcatacacattagtccctcgtgttctttggtgcaagttcccaactttagtccctcgttttccacactcaagtttcccaaactgctaaacgatgtatttttggcataaaacattatagaaaagttgccttaaaatatattaattaatctattttttaaattttttagataatacctaattaatcacacgctaaacctctgctccgttttgtgtgttgtggggaggggttcccaagccccacaatcgaacacagcctaacagacttaaccttcctcttgcttatagtacaggttcagagcttgaccaaggtgcatcacagaaatcttgtttgtttggttgggtactgctgggagaaggaacatttagcacttgtctacgagtatatgtctagaggcaatctttgtgattatctaagaggtttgtccattgcaaacttcaaagtattgaatgttgcgaaatcatagggaggatagttggacacaagtgagcacctacacatagcgtaaactaacttaatgttctacatgctccctatagatgtacgaagcaatttgcagcacaataactactataagtacttaatacacggaatgaccacagttacaagtgagaacttaattatcactttatttagtaatgtgcctatatgtgtttcttaaaaaataaagataccgatttttgtttagtggcggcatattggcaatctctacataagggaactccatggccttcgttaattaaactcactatagatacgacaacaaatttagttgtcatctttaaggaagtatcttgatcttgtatttccaatcatttgtagaagttttgtcgtcattgttttttttagaactgtcatatttgttcattgtttcattctcaacataattgattcacacatcatgtaaatattttaaacataattgcatatggaataattgttttcaattagttggacatgaaaatccatcttgactgatttttaagacatgaatgcatatgtgatgtacaagcttttttataggtgtaatctacatctgtgctttgctagtccctatgatacaaagtgatatctagtatgattcttagagatcaccgcattaactactttttgttgttaaagggacaatactattttgattatttatgttattgctccccctgccgatgtgtgcacacacacaagagacgagtgttttacaactcccttaattgctatttgaagttgctcgtagaattcctttctaactgtttgtctgtgaatatattaaaagggaaaattggtatgggagaaaatttgaattggaagacacgcgtaagagttgcacttgaagctgcacaaggtattctataatagcaaggcaaaaaaaacaaagcaaaagtgttatggctcatcttttcttctaactatagtttccttatttgtaggcctggattatctccataagggttgcaacttgccaataattcatggggatatgaagacgaacaacattctgttgggtcaaaattttaaagcaaaaatagcagattttggaactcatatttcagccgttgcagctggatctatgggttatattgactctgagtatgaatctcttctacacactataatcacttatgcaatctctacatatattaacacgggtcaattttaggtactacaccactggtaggctcaccgagagcagcgacgtttacagcttcggcattgttttactagagataacaactggcgagcctcctataatacctgaaaaaggtcacattgttcaacgtgtgaagaaaaagattgtcagtggtaacattagctcagttgcagacgcacatcttggaggtgcctacaatgttagctccatgtggaaagttgttaacatcgccatgatgtgcacaacagatatagctactcaaaggccaaagatggctgacgtggttgttcagctgaaggaaagcctagacttggtggaagttcaaggggacagaggagacaaggaaaacctagcaagtgataccatgtcttcgatgtcgacatttggtccatcggcaagatgattaaataatacatacctagccttggctttcactacattgatggatccctgtgacaagtctataacgatatatacaatgtgcatgcacagcctgtttgttttgttaatgtcaataattgagacagccagtataaaacatagatgtcatggaaggatcatgataggtgtgtatatggcccataatgtatagtttgcatctatctatgtgtgtcaactattactcacattagctccaatattcttctgatactacaactccaattaatccttagcaaagattgtttgcacatttccttattgcttcttatgtcctatttcacataatctatcattagtacttgtatgctccagcactagtacagatctagacatttgtgatgagcgttcgtgctgagctaaggtgactcgtttgtgctgcatattcatatattttagtgattctatacaatattatccttaatcacttggcgctatcattatgtttatcaatatgggctattttttggcactacatcaccgataggcttactgacagcagtgacgttgacagcttcggtgttgttttactagaggtaactatcggtgaacttcccataatacctggaaatggccacatcattcagcacatgatgcagattgtcactggtaacatcacctcagttgccgatgaacgtctaggaggttcctatattttcaactccatgtggaaggttctagatgccatgatgatgtgcataacagatattgcttctcaaaggctaatgatgtccgccgtggtcttgcaattgaaggaaaaccatgaattggaggaagctcatggggatgggttacttggaaaatgtagtaagagataacacatcttcgatgtccatgtttagtccattggtaagatgaaaaaaaccattgatagctcgctttggaacatactgatggctctcttcttcaagtctaaaataaaacaactgatttctctctagacgatttcttctgtgttaagacacaatgatttatatacagtttgtcttcataaacaatgccggtaggatccttaataggtgtgggtattgcaaagcaatagtttgcttcagtgtaacagtaagctgtttgtgagctttctaactatagggtatcattgctcaaataatatgtaacaaagatatcgaaaatgtttacatgtttcgttatcatatccttttctgtgttgatttttacatactcattatgtattttttaaataatagtactgattatggtaattaatgctgattacgggggtggggattgcgcagcgcgagttgagcagctggcgcttgcgcgcccactaggaagccccaggtgaagagtgatcgctgccgcggcttttggcactaggctttggctgatgcaggccatggacaccatagtcaagcacaaacttttgtccacatgtccgaccgaagcttagatggaaaagcatttcagggagatgcaggggaagcattgcttggactgcatcacaacggcaagctcctgctgatgttggacgagcccaccggagtcttgcttcttttggcatacgcctcatcgccgtctcacggcagtccaagattctgctcccaccgctgcgactgccgaccaaatatgtgggagcgtttggggtgccacgaaaaaaaatatgtggagtaatgccacgagacatgcaccgtaggtggtcaccccatcaacctaggaggctatgagggaggtttgcccccaagtgtcatcttgccttgtagcacgcaaaaagaattgaataacaattcagtaacagaagcgattataaaacaaaataagttatgatgcaagctatatatctgatatatgccagcttcctttgtacgtcaacactagggttccattgctcccatgtccgcctaaccgtgtcgtccaaaacccttcaacgccgtcgtcggtggctctactttgttgcctgcgtcgaagacttagctgttcccggagtcagcgtcaacggcgccaccaaccttcgcggtggctcggactctctaggcggcgacgcttctcctgctggtggctatggctcagctgctcccggacccagcgactcgatgtcgggttctggaggcaacaacagtcgccatttgcaaggtttgtccctcggatttgcttgcctccatcctccgttcttcttgattgtctcaatctgcctcatgccctcatcacctctcttggatctgtcattttgtacctgtcttgtttgtcatgcttggaaatttactagtaattttaaactaatctatgcattctattctcgttcaggtccaatataatactcacaaggaaacaatatgggaaagacgatctagcgatgtcttcaacttcacttccacaggtagctcaactagattataaaccaaaggtcttctccttcagagtacttctccaactgtggtttgatgattaaaggtgagcatatgaaatactccgcaagccacataacaaatatgcagatgcacaggataacaaagaatggcatgatagggattgtttccaaatgtaacatatagtacacgtttaagagtagtaaaacagtagattaattaaataacaatgttgattaacactatacaacatacaaggcccaaaccatctccgaactatcaaactcggctgaagagatataaactccataacaagagctaacaaattatcatcaccaatttagtcactaatgagtagtgtgggactactcacgaaaagcatttgctaggcttgcccataactttgggcatgactattcgaatagttttactctagctagaggtgtagcaatgtacccacaagatatgtttccacacatgttgccatgccccgagataataccatggtactataatggaaaattcgagacaagacctttcacataatgcaagtgggagcagttaaccattgccggactgtcatctatccataacccatacaagactccccatcgagtcccatgggcttatgtctgtcactttttagtctggtacctcacaatgaatcatgctataaaaataggccagtcatcactcatgctggcttgtggttagtacgataaatgcttcacactagtagcttgcgggtcggttcttaattatcatttgtacaaccaacacaactatgagctcacaacgcatcattaatcaagttttaatatgaatattaattaactaaacacgactaaccatcatgagctatcattaattaaccatcattaatcataagtgatt

SEQ ID NO: 92976 - DNA, 10389 bp, Oryza sativa
catgccacatctttacccactagcaattactattctagcctattagaatctcatacaagcatgacacatcatctacaatattatattatagagatcaacaagtatgtgtcaaatcatcttcctcacattattttcttaacatttcaactttcatcatttcgacaatatttaacatatactaatccatgaatcccgcagcaaagcgcggggaatcacctagtatcgcgatgcattggttaatggctagtattcctagtcaatttgcttttctattaaccggtaatcgtcttatattccaaatttcacacgtaatacaggtaccctgatgatcagtacgatcggttctggtccacagatgaagcccatcccttgtcgacaaacatttccacccaaactaccatccaagctagcaccgaatttgcggtgccctcgcctgttctccagaaagccattgtgccgagtggcaactccatgaaactagttttcttttccgaccaagtagacgtccttcttcataaccacttcgtgatcctgcatttcgctgacttccagaacaacaagtcccgggaatttacagtttccatagacaatggtgtgcagagcagcccatacagcacaccgtacctaaaaggtttgtctgtcaccggcggctggtccagcaattctgaaggaaagtataacttcaccattgctgcaactgccacatcagctctgcccccgatccttaatgcttatgaggtctacggtcgcatcatccatgataatccaacaacgttctcccaggattgtaagctagctgtatctattggtctttagcgaggtacactaaacaattaaacattatcaactctccctcttgaactcctattttttcctcgtatatatgctagttgatgcgatcatggctataaaatatgagtatggaataaagaagaactggatgggtgatccatgttttccacctgaatttgtttgggatggtgtgaaatgcagcgatgcaggtgataaaatcatgaggataatatctctgtgagtatagtatggaagatctaaatgtactagcattattaattgtatacatttgctaaattttgttggattatttgaaattattatgcagtgatctctccaacagcaaattgaatgggtcgatatctaattttttcacattgtttactgccctcaagtacttgtaagtatatctgagtgccctctgcctttggttgttctgcatttaaaactgccaatcgacaggactaggcatcatattacattaaaaatgaaaaacacggactaaatattatcgaaagtgatcgcagctttacttttgtaaagtggtaaaaatgaactaaaggtatgataactagtggtgagggctagtggaggtattttgcgtgtaaattagacattcgctggctcgctgctcttgggctacaagctaccccccttagtgaaggaacatggaattaaatttgaaaatataccactcatatgttctttcttagaaatattaggaattcaaattgtttggcacaaatatactatcgatatcacctaaccattgtgcgagaatgacgtggaccatctcgcatggccaaatagcgacaccgtattgaaaattgattaactgtcatgattaccgattaattaataataattagtgattaatccacctaattagcagttaattaattattgattaaccactaagcaagataattaatcactaattaagccatttgaaatgacatgatattcggtcttgctgttaggttatgccagaccactcggtctcgcgcctgcgccgcgcgagagcgaggagtctcgcgcatcactgtgtgacaccgccgaagtcgtcacgtccactgtatatgttgagcgataccagcggtatatttgtaccaaaaaatttgaatcctgaatatttctgagaaaaaacaagtgaacagtatattttcaaatttaattcaaggaacatgttgttttggcattcaacaaaactctatgcttgagactccagagagggtaccacttagtatttattatttttcatttagaatcattaaatcaattaaagtatataattgagacttcaaaccaagtacatgcagatctcagacatagatatgatagatggacacatataattttaattaaaatgatttttttttacttttctcactagtgtgggtatttctagcttttatttctcaattaatttgggggttttcaggagtgccactaattagtatatataaatatatgtgtctgtagatagttttttttttcgagatcgttgattaggtcaatgtggtgttgcaaatcatgcggcttcatgatactcagaggagtgtgttacattgtactgggccattttaacttttaccaccaaattatgatatataaaattaccactaagccaataataatacatttgacaattatttcagtatatcatactccatggtgaaagtttagctttcaaagatatacatttctaaataataatagaaatgttttacagccctggcctctcacagttacacagtcaacaagttctgtccttagggaaaaaggttggtatagagtgataatacaaagcccaagttctcaaataagtaatagctgactaagaaaaaaaatcatgaaaactaactagtactcatctgtaagactgttatcatagttttttttttaggtcattcattaggtcaatgtgatgttgcaaatcatgcggcttcatgatactcagaggagtgtgctatattgtactgggtcattttaacttttaccagcaaattatgatatatcaaattactactaagccaataataatacgtttgacaattattgaaatataacatactccgtggtgaaagtttagctctcgaagatatccaagtcctcaaataaggtaagagctgactaagaaatatcgcaaagactaactagtatccacctgtaagactgttatcatagttcttctgaacctataaaagaaatagtatcatttgaaaaacaacaacatcaatagtttggccacgtggtacttgtcttgtccaaattcgtgatactagaatgtgtcaaatatcgcaatttgttttttatgggacaaagctagtaattctatatgtactaccatatccaaagctgaacataaagactcttgatactttttaaagatatctgagtatctgacggtaattaaagtggtttgatactttatacttggaactttacagtgttgttatcaaagtttgcagattgtcaacaagccatagacttattgcttaatccgtaaattgtatatcactttgtacagaaacttatcatgcaatcaacttaatgggacaattccagattccctcctcaaaaacaacggatcaattgatttcaggtttggatatttttattaacgttgatttctttcagtaatctttaggcaatttaacacttaactacgattcttttgaacccttccggctgatagttttatgaaatttcagttatgagtctgatggaaatatgtgcaaaacacatgctactccatccctgtcaagaaataccttagctgtttcagtagtggccccagtgctggtactggccatacttgttctggcatatttgatctggagagccaaaagaaagctcaatagtacgtatgctctgttaaaatatatagtttgtactgaaaataattgactcttatagtttaatgacacaatgtaatattgctaatacttttctttttgcactagcttcttcaactgatcttgccatggtaccagaactcatgggtgctcctggacatatcacaaatcattgggaccatctacaaaaacctgaaaatcgccgattcacatatcaggagctagagaagtttactgagaacttcaaacatttaattgggcatggaggcttcgggcatgtgtactacggttgtttagaagacagtactgaggttgctgtgaagatgcggtctaaattatcttcgcatgggcttaatgagtttttagctgaggtaacaaattcagttaccactaagttcactactgacaaaatcaatattttcactgcatataacttaatcacagccacagtgagatttcatacacattaaggctgtgttctttggtgaatgttcccaactttagtccgtcgtttttcacatggaagtttcccaaactgacaaatgacgtattttttacataaaaaaatatagaaaagttgccttaagaattatattaattaatccctttccaagttttttagctaatgcttaattaatcacgcgatgtacctccgctcattttgcgtgttgtgggggagggattcccaagccccactatcgaacacagcctaagagacttatccttcctcttgcttataatacaggttcagagcttgaccaaggtgcatcacagaaatcttgtttgtttggttggatactgctgggagaaggaacatttggcacttgtctatgagtacatgtctagaggcaatctttgtgattatctaagaggtttgtccattgcgaacttcaatgtattgaatgttgcgaaatcatagggaggatacctggacacaagtgagcacctacacatagcgtaaactaacttaatattctacatgttccgtctagacggacaaagcagttcacgttgaatagttgtttgcagcacaataactactataagtacttattgtccggagagaccattgttacaagcgagaatttaactatcactttatttagtaatgtacctatattgtgtttatttaaaaataaagagactcatgttatttgtttggtggcggcatatggtgatctctacataaggatctccatggcctttggttaattaaactcattatagataccacgacaaatttatttgtcatctttaaggaagtatcttgatcttctatttccaaacatttgtagaagttttgccgtaattgttcgttgtttcattctcaacataattgattgacgcagcatgtgatatttgattctcttaatttcatatggaataattgtttcaattagttgtacctgaaaatccagcttgactaatttttaagacatgaatgcctatgtgatgtacaaacttttataggtgtaatccacatatgtgctttgctagctagtccctaaagtacagagtgatatctagtataattcttagagatcaccgcatttactcctttttgttattaaagggacagtactatttttattatttatgttattgctcccactgccgacgtgtggtcacacactacacacacacagcagatgaatgttgtataactcccttaattgctatttgaagatgctcgtagaattctttcctaattgtttgtcttgaatatattaaaagggaaaactggtatgggtgaaattttgaattggaagacacgtgtaagagttgcacttgaagctgcacaaggtattttataatggcaatgcaaacaaaatttagcaaaagtgttatggctcatcttttcttctaactatagtttccttatatgtaggcctggattatctacataagggttgcaacctaccaataattcatggggatgtgaagacgaacaacattttattgggtcaaaattttaaagcaaagatagcagattttggactatcgaaaacatatcatagtgactcccagactcatatatcagccgctgcagctggatctatgggttatattgaccctgagtacgagtctcgatctacacactattacatttgtactactacattcatatattagattgatttcatgcaattttcaccttaatcacttatgcaatctttacatatattaacacgggtcacttttaggtactacaccactggtaggctcaccgagagcagtgatgtttacagcttcggcgttgttttactagagataacaactggcgagcctcctataatacctgaaaatggtcacattgttcaacgtgtgaagcaaaagattgtcagcggtaacattagctcagttgcagacgcacatcttggaggtgcctacaatgttagctccatgtggaaggttgttaacatcgccatgatgtgcacaacagatatagctactcaaaggccaaagatgggtgacgtggttgtgcagctgaaggaaagcctagacttggtggaagttcatggggacaggggagacatggaaaacctagcaagtgacaccatgtcttcgatgtcgacatttggtccatcggcaagatgattaaatactacatacctagccttggctttcactacattgatggatccctgtgacaagtctatacgatacgatgtgcatgcacagactatttgttttgttaatgtcaataattgatacagccggtataaaacatagatgtcatggtaggatcatgataggtgtgtatatggcccataatataaagtttgcgtctacatatgtgtgtgaacttttacttacattagcttcgatattcttctggtactacaactcccattaatccatagcaaagattgcttgctcatttccttattgcttcgtatatcctatttcacataatctatcattagtacttttgtgctcccacactagtacagatctagacatttgtgatgagccgttcgtgttgagctaaggtgactcgtttgtgctgcatattcatatattttagtgattctctacaaatttatccttaatcacttggcgcaatcattatgtttatcaatgtgggccatttttagcaactacgtcactgatagacttactgacagcagtgacgtcgacagcttcggtgttgttttactagaggtaactattggtgaacctcccataatacctggaaattgccacattattcagcgtgtgatgcagatggtcactggtaacatcagttgcagatgaacgtcttggatgttcctatattgtcaactccttgtggaaggttccagatgctgtgatgatatttcttcccaaaggccaacaatgtccggtagtcatgcaattgaaggaaagcctggaacaagaggaagctcattgggacacgtcttcaatgtccatgtttggtccatcggcaagatgaagaaaccattgatacctggcttcgggacataatgatggttctctgctttaagtctaaaataaaacaactgatttgcatagacgattagttctgtgttaagacacaatgatttatacagtttgtattcataaaccgagtcgataggatcctttatcggtgtgggtattgcaatgcaatagtttgcttcggtgtaacagtaagctgtttgtgagcttcctaactctcaggtatcattgctcaaataatatgtaacaaagatattgaacatgtttacacatttcattatcattccctttttgtgttaatttttacgtactcattagtatttgcgcacttcaaatgctgtgtcaaaataaagaaaatttgaaaacttcagttctttgggtaatttgcccccccccccataaatttctttactttcaaaaatccaaaattatactctttaaattttggttgtaattatacctcctattttgaatttagtaaaatcctgacctagctacatctctgtaattcagactcagcttcctattaatttttctcatctagggtgaatcaagataatttggtcatactgagaaaaaaaaactagcaaaagtggtatggggtatcatgaaatattcggagcatttcaagtgtagagtaatgaagagcggacacttcatataaaagggttagccaggcgtactatatatggttggagccctcatcttcactttgttaaaagcgttaaccctcatccacctaaacttttaaggtggcactaaaccaccactatagccacatggacctcaactgcacaaatacaggctgctaatgggctagggtgtttcattttctctattagtccattttttgtatgatttttttaatattatatacttgtgcagctttgaactcaaagctcaaactaacatccatgacgatcttcaaacttgtctcatttgcaggtaaattccccagtgatgctgttgagagttctgatataagtccatgagtgtaggtcagccaaatgctgagaaggtgcttgtttacaaggcagcagctcatgacagagtagagcaggatgaggacgtactcgaccttgaaacatgaacaaaatatctcattattcccctttcttcttttttgggggtggatgagatggacatgtatgctagattgctagttctccaatgtgtagaacctagctagatgtccttactctcactggtccaatgaagcagtcatgaaacctacaaatctaaagacgtgtttcgtggattttggttaggcagagttgcgcttaacgcaatgcaaagtgaagataagaaaatcttcactttggcggatttctccctaattctaataatgtgaaaataggggatctcatacagagtgcagtgcaaaggcatttctaatcatgtgacataggagagcaaaccgagtagaatgcaaatgcataggatgcaggaattaatctagtaactttgcagtaccaaaatgaggtccagaagacaccttatttttcttccacacaaaagaaaactaatccaccatcacagtgcatgcatacacaagcatacatcactgttccattacatgaaaaaatatagtttatcaaagccagctgcagcttcatcttgctgatggaccaaacctggacgtagaaaatgtgttatcactgactgtgcttgtgcttcccatgaagccactgtcttcacgagattcctctaatgccaggctctcctttagttgggcaaccacagtggccattgttggcctttgagcaacaacatcaacagtgcactgcaatgcagtgtccaccaccttccacatggagctgatgtcatatgcaccatcgagccgtgcatcggcaatcaaactgatgtcaccagcaacaatcttatttttcacacgctggacgatgtggccttgacccgatattatgggtggctcaccggtggctatctctagtaaaacaatgccaaagctatacacatcactactctccgtgaacctgccggtttggtagtacctaaaaaatacattatgtcaggaaatatgaatattgcattgtatttcagaggaacctaaatggtgcattaattacgtggatataaggtaaaggccatgagcccaaaaccatgtattttttagtttggatctcccaacttgtctagataaggcattagatgaaaatattgttaagaaatgaaaaaaaattgacacaaatatacatactcgggatcaatgtaaccagctgtcccggctggagtgactgatatgtgagtctgcgtctcgccgagataagtcttggaaagtccaaaatctgctattttagcttgtagatttttacctaaaagaatgttactggttttcacatcgcggtgaattattggtagactgcaacccttatgcaaataatccagtcctacatatatcaaatcatatcaagaaactatagtgagagaaggtgtgcatgcacgaatgaacaagtgtcattttggacattattgtcatagataaacttatttcatagttaaacagtaaatttcacaaaactataactatttgatccaaactgttgctttgctacaattttagctacataaatcacaaaaaatgatgcaacaatatcaaatgaattttatgatgaaactgcaattttattcttctataggtgtgtcagatgtcttgagtcttgactcgatgcaaaatattgtcagtatctcatggatgtataacatgtggtattgaacctattgtacgaaaagaaaaaactcatgcgttgatattgaagtttactagaaatcctagctaaagacttctcacaatattctttgagtaaatttatcaaaacaacatatattttgaccagattatcacaaaactacatatttagggtgatatatcataaaactatagatttaacactaaatttctcaaaaaactacctatttaagatttaagttggagtatcgtaaaactatagatttagtaataaaattgtcaagtagttttagtgacaatttaatcacaaaacttacacgtttataactcaaacataacactagtgctaaggatttaaactctaaaatctatagttttgtgataactttgttactaaatctatagttttgtgagtaattttgtgataaatttattgttaaatctgtagttttgtcatacatcaaaatttgtagttttgtggtaatttgatcaaagtatatgtagttttgtgaaatttactcatatttttttttcttccagtgccatttgcatgtgacaattctagctaccatttctatatatcatctatag

SEQ ID NO: 92977 - DNA, 3369 bp, Oryza sativa
agatgacttcatgttgtcctttgaactgtttactttaataatcaccgtttgattatcataattcattaagatagctggcgcgcactggtttttcaaccaccagcaaatccatcaggagttcacgaaccactcaacctcaactgtcacaatatctagtgctgtaagttctgcttccattgttaaccttgttaaaatgttctgcttacaaaacttccagaaaacaacaccacctccaagtgtgaacacatatccacttgagacttttatctcatcaacatcagatatccagtttgagtcaatatacccttctagtacttttgaatacccggtatagtgaattccatagctcatagtgccctttagatagcgcattactcttttcagagcctgccaatgatcatctcccggatttgagacaaaccggctcagcttgcttacagcaaatgagatgtcaggcctcgttgcactagccaagtacatcaatgaaccaatgatttgagagtatctcagttgatcccttactattcttcggtttttccttaatagcacgctaggatcacaaggagtaggagctggcttacagtcactatatccaaagcgactcaaaaccttgtccacatagtgagattgcacaagtgtaatcccaccctcatctcctctttgtagtttgatgttaagaataacattagcctctcccaaatccttcatttcaaaactcttgtacagatagtccttgacctcctcaatcacattaaggctggtcccaaagatcaatatgtcatcgacatataagcacaagatcactccttctccccaccacagcgatagtacacacatttgtcagcttcgttcacaacaaagcctgtagatgtaagcgtggtgtcaaacttctcatgccattgcttaggtgcttgcttgaggccatacaaggatttcaacagtttacataccattcccttctgaccttctaatacatacccgtctggttgatccatatagatctcctcctccagctctccgtttaagaaagctgtcttaacatccatctaatgaatgaaaagaccatgagaggcagccagagcaagtagtactcgaatcgtggtcaagcgagcaactggtgagtatgtgtcaaaaaagtcctcgccttccttttgggtataacccttggccacaagccttgccttgtacttttcaattgtaccatcaggcctaagctttttcttgaaaacctatttgcatcctacgggcttgcacccatatggacgctcaacgacttcccaagtaccattagacataatcgaatccatttaactgcgtactatttcctttcagtagtcagcgtcaggagatgaatatgttcttctatggttcttggggtgtcatccacaaggtatacaatgtagtcatctccaaaggattttgcaaccctttgtctcttactcttgtgagtgtctacaatgttgtcctcctcaggatttttctcaggcgtttgatcattgtgttctatcggtgcaaagtgctaggtgtatgtttcatggaaaattcattatcaaagaatgtagcatctctggactcaagaattgtaccaacatgcatgtcgggtactccagagtttactattaagaatctataacccacactgtgaatagcataaccaaggaacacacaatcaacagtatttggtccaagtttccgctttttggctataggtacatttaccttggccaaacagccccatgttcgtaggtatgagagatttaatttcttcctttcccattcctcgaatggtgttacttccttatgcttcattgaaattttattcaggacatgacacgcagtcaaaactgcctcaccccaccattccttggaaagccccgcagtctctaacatggcattcaccatctcagttagagtacggttctttctttcggccaccccatttgattggggtgaatagggaggcatcctctcataaataattccaaactcttcgcaaaaggatgcaaactcattagaaaaatactcctcacctctatcagacctcaaccgtttgattttcctttcaagttggttttctacctcagctttatagattttaaagtaatgcaatgcttcatcctttcttttcaatatatacacataacaaaatctagtgtaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaacctttgatcaaagtgaattttggaattaaactcatgttagctaagcgcgtcatacaactgaaattcacatgacagagtcgcgaatgccacacattagactcatcattctcgctaatatggttcacaacattatgattattacacatgtcattcaaagaaaagcggaacaagcctccgctgtcataaccttttctaacaaaagtcccatatttagatacgacacatttattggactcaaacacaagtctaaaaccttctctacaaagtagagagccgctaacaagattcttctttattgaagggacatgctgcacgttcttcagctgcacggtctttcccgaagtaaacttctgatcgaccgtaccaataccatgaacagccgcaagcgacccgtttcccatcaacatggaggaacctctcccgacctgataagaagaaaacagagaaatgtcagcacatacatgaatattagcaccagtgtccacccaccaatcaggtgagtgaaaaacagagagaactgtaggtaatattttaccgtaccccgatgttcctccgccctcgccaatgaccatgttggcagacttcctgtctttgcgctcaggacagtccttggcccaatgcccagacttgccacacacaaagcagtctccctttgcttttcccttgcctttcttcttaaagttggttgcagccttgggtttgacatcaggcttgactttcttgttgttgtaggatgcatgagggttctttttctgtaccatattggcactagaacctccctcaacctttttttcccggatgtccgttgccctcgccttctcctcaacacccaaagagccaatgagatcagaaacactgaactcttgtctcttgtgctttagagaagtggcaaagtccgaccaagaaggtggcaatttggcaataatgccacccgccacaaacttgtccggcaactaacagttgttgttctcaagttccttagctagcatctgaatctcatgagcttgttctactacagaacggtcatcgaccatcttgtagtcata

SEQ ID NO: 92978 - DNA, 1416 bp, Oryza sativa
caaagaatatttacaaaaatcaaatgtttgtcacatatgcattgcgaatgttctgccattgcgagacgagctacctaggacttcactctaaacatccctttcaatgacaagatatcatctagtatgaattgtgctagctcctctctaatgatttcgaagttgatttccggaatccttcaaataaatttctgcacgttcggcgccaacatcgtccacctctgttatggtgtagacttccttaggaattttattctgggtcctaggattccggctcgatgtagtcccagtagtggtcgtcgacatcggttcgccttgctgcgacatgtcctatgtcactgttgtacggggagaaagtactttttaaacacaaaattgcatctacacacattctcttatggtttgatatacctctatctcctacctacgttcgcctcgtcgacgaaaccatagcatccatactcaatagggccggagcagccgggaactcgacctcgacatcagtataccactcgaacttgctatcaatgtcacttggtgctggccttggagttatattgatctcaatgctgtgcttgggccattgaataaagttcccacgtgcagccccaagggtcagaatctcgtcattaggtgggtgtaggatagtgtagccaacccaatcgggcttcactaagtccacctgaactttggcattgccggcttgcagctgcgccccatgcactcgggtctctgggtaggcttgaatgcttgaccctctgcggcaggaattgcaaatcctggtgtcacccttacgactagggtacacgatgtgggttcctgcgattgattcattagtgtccttagtatatgttgcaatgtattgtggtgctaatataatatatacgttattaagttgtttctaccattatgtggtccaccgcggcggggccttcaggctgttctgccggagcctcagttgatgcgcagctgctacgcctctgcgtggggctcacttgtactacgggaccgggagtggcatcggtcgacctatccctgatgcgtgcctccatccgagccttcatacctaacagctcggcagtgacctcttctctaagctcttctttaagctcctatcgaagttgggccttaatgcgtgcagctttctgcgccttggaaagcttgtgcttcttgtactgccacgcatattggggaaacccaaacttccatggaacattggagccaatgccccttgttcgtccacggtgttcttcgtttcccaatgctttcgtgaggatgtcatcctcgcgtttttgtgagcaaacctcttgggaggcctgtctctcagcattcagttcgacctagagtacagttaggatgcgttagacgaacaacaagatacaacataatgaaacttattctatgtgttcaacatacgat

SEQ ID NO: 92979 - DNA, 510 bp, Oryza sativa
atgaagtctcacgattgccacgtgctaatcacacagatcttgccaattgctataagaggcattctaccaccacaagtccgtcacatgatccaacgggtttgtgccttcttcaatgcaatcggtcagaagattatagatccagaagacctagatgggttgcaggccgatattgtcagtaccctgtgtcagttggagatgtattttccactagctttcttcgataccatggttcatctcactattcacctagtgaagcaaaaaaaatatgtgggccagcttttatgagagaaatgtggccattcgagaggtacatgggaattctgaagtcctacgttcggaacagagcaaaaccagaggggagcatcattgaaggttacatgaccgaggaagccattgagttttgtatcgattacatggctgagactaatcctatcggagttcctacgtctcgccacgaaggaaggttggcaagtgttggcacaactggcagaaaaagaattgttcccgatc

SEQ ID NO: 92980 - DNA, 8677 bp, Oryza sativa
ccaaaataaaagttgtagatcttgatgagaggatcaactttgttgttgttgactttttcatttgaaatcatttactatttacaaatgctgtttaaatttgtcatattgtcaaaattaatttcaagctgttgggaacaaagttatatagacaaaagaccaaaataaaagttgtagatcttgataacctttacaattttgttgttgcccatatttcgatttgaaatcatttactatccgaaaatgtattatgactaataaaatgaattattatatagcagctatatattttgcactcacaaatataaagacttgattggaaaaatggaaaaatagtcatcggtgacggaccttagtttaagcccgataagattaagctatctgtaccgggcattatcttagggcccgtcacacatcagtcatccgtgacaggcgtaaatgtcatctcaatcgggcattagtatggagcccgtcacccatgagtcatctgtgacgggccctacgacaatgcccgattgagatgactcatcactctactataactagggtttcatagatcggatcgaaaatttttctaagtcccgcacagttttccgcctccttagaaccctagcgccgccgccaactcctcctttgccgccgtcgtccttcctcgcagccacagccaccgagcccgccaccgcaccaccgagcctaccgtcgccgccaccgagcccgccgctttcaccgagcccgccgccgccgccaccgagcctctacactgaccggcgtcggccttcctcctcgtcgccgcctgcctcctcaccgacgcaaatagctgacccccatcgagcccggcgacgtccttcctcatcgtcgttgcctactcctcaccgacgcccgacgccgacctcccgaccagcgtctacaccgaccgctgctgcccttcaccgagcccggcgccgccgccgcgaactcctcctttgacgagcccgcgcgccgccgccgccaccgagctcgccgcctccaccgaccggcgacgccctccagcgagcccgccgcctccaccaccgagcccccccccctccccccggccgtcctcaggtgagtcctccatcacggcgccctctactacctgtggtgaatgatgaaatgtggatgttaggatgatgaaatgtggatgttgggatgaatttagagatagatgatttttttgattgatgacatgttgatgaatagatggaatgtggtgcattaatgaatttagtgacagatgcatgatatgtggatgaatagatgatatatgaggtgaatttatgattttcggatttgatgatatgtttcatttatttataagtgacattcaattcattgtaattgattttagcactgaattgtgtattttcattattttgaaaaaaagtagacgatgtctcagcaaggcgaaccaatgtcaacgacagctagtgggtcctcaagggcacgtactactaggacagggaacaaaatccctaaggaacggttccgcataacagtggtgaaccaagtagggttgccgacaggtccaaggaaaatattgagccgatttaggtctatctgcggtgtcataggggggcagaaattcagtattctgcaggatgacatcaagcaagtgccggccgcagagaaggacagtgcttggctagcgttcaagaagagcttcaattatcctgcagagcacaagtaccttattaggcaggctgcttttaaggtcaggggcaattcttgtaagaacttcaagagtaagctagtcggcgagttcgtcttcaacccggcgaatcccgatccaacagagaaatttccttggatcatggaacaggtctgggaggaattacacgcgaagaagtcgacccccgattccagagctagaagcgaggcatatcgcttgctccagaccaagaactagcattcgcaccggcttggcaccaccggatatgccggtaaggaagaggaatggttgcaggaggatgaagaagcggaggaatcgaacacaccgcgggtgtttggcgatatcccacatcctcgggctaggaactgggccagggccaggtaccagaacaatgctgatggtacattcttcatgccaaatccagaagatcaacgaatgtacgaagctatagtaagtgtctagtcaaaatagatgttcgcattgtttcccatcatgcagtttatttaaccccactaaattgtaatgcagaaggagttggttgccgagcaacaaacctcgcaagattcctgctctcaaagacgcgaggacgacctcctcacaaaagcgttgggcaacaaggaacaccgtggacagacacggggtgttgggtcttctgttccctagaagtatggatttccagactacgcgtggcagtacaagaagcggacttccaacaaggcggacaaagatgcacgccttgaagccaagatccgggcgtcgataagtgcggagctgacatctgaatttgacgaaaagctcgagtcgatgagggccaagatcaggcaagagcaacagaaccccaggccgccactgctgctacgcatgaagagttaggaagtcccacccaaaaacgcagcagttgcgcatcaactgagttggcggaaaatccaacatcggtcgacagcgccgtcgaccacataacggtaaaagtttcgtccacaatgcatgaaagacttaacgaatccatatgatatataatattctaaaaaaatgatgaatctatcgcaggaaccaacgagctgcaccctcacagttagggtgatgccgaccttcacggttccagcagccgagggacttgcgtacaagccgaccccagagactagagtgcatggagcacaacttaggggcgactgtgcaaaagttcaagtcgactcggtgaagcccaaatacgagctgttcccactgaagtatccaccaaacgacgaggtcctctcactaggaaatgcttgtggtaccttcatccaatggcccaaggacctcattgagataagggttatagcgaggccaaccactacaccaggcggtcgtccgccaaagagacccgcctctgctccttcagcccgtcctactcaagatcgtcatgcacaatcttacaatgtgcagttgcagtacgacatggattttggggaggaccgaatggaggccaacagcaaggcgattcatgaacccacaccgatgaagaagagcaagaaggcacactcttcccctcagataattactctcgataaacccgaagcaaaggggagagaaaggggaggaaaggtgcaggcctcgcttctagctccaaggaagctagatctgggcaagggccaggaagagactaagggcaaagaggtcaagaagaaatacgtcgctccacaggagttccaactaggcatgccattggttggagatgacgtgcttgccgcaatgggcaccgcttgcaaggaccttcacgtatactacatggagaaatctaacgccaggaggccgaataaagctaccgatatccttggagagcacgatggaaagccattccttggtccaacaaattatatcgtggtcgacttcaaggatctattcgacctctacaggctccgcgcagtagacacaagcctccttaagtactactccttgtaagtattgtcgcccaactcaatctggtaataacaatcggtttaactcgcttacaagatcgtttatcttgtgtgtaggttaagttggcaatggtgtcagaagaatgcaccggaagttgccttccttgatctacaagtggtcactgtcacaaatctctagaatgaccgtcaaggaatggtcaactacatctacgacaccttgtggtcccgccaagacaaggagaatattatgtgtgcctataatcaatagtaagtgtgttatctaaatatacacaatagcatgacacattccttcagtacttaattaactttcactatattaatgccgcagtccccattggatccttctggtcataacacctaagtggagtacatgtcactacctgaactccataattgataagaacgcatatgattggaccccaattcaactagcgatagatgaagcgtgggcccaatacgtgcaaagacgaggcctcaggaagacaggatatgacaccctcatccacaaaaaagacttcccggtgaagcaacaaataggtgaccagtgcggattccatgtgtgccacaacatgcgccttctgtacagagaaaaggtgaagactttggctgagtttgaggtcggtggtctaaatggtgatagactaactacattttagtactttttgcaggtgaaatatgataaatatttgaatggatgtgaaatatgtgaatagatgtgaaatatgagatggctgtgaatgtgtggttgtgtgaaatatattgatgtctatgtatgtgaatgcatatgtatgaatgggtgatgctggggggctggagatattggatatctgtatttgtttctatcatttttgcagcgggcatggctagcaaaggcctgaggctagccaaaaaacaagatttttttttttgtggattatagttatctgtgacgagccataactaaatgcccgattgagatgatggttatctgtaacgggcgtacttaatgcccgattgagatgactgtcatctgcgacgggctctagtttagacccgattgaggtcagtagtcatctgtgacggtcatctgtgacgggcgctagttgtggcccgattgagataggtcatctgtgacgggctatagtttgattggtcgtctgggtcaaagctatcggtgatgggctttacttagggcccgattgagatagattcatccgtgacggctgtttgcccgattgagataactcttcacatcagtgacttctagcctgtgacggatgctgtgcctgattgagatgagggtatccgttatagtgtatactacatatatggttaaaattgctttataactgaaatagtaaggaggatatatatgcgtgaaaatataggttctgtgcatccaaatatccaatacacagcaaacacatgtctcatgcgaaaaatctcctcacgtgtgacttttgccacgcgtgattattgattattgcagatttgggaaaccagcaaagatatgagctggcattaagccatttctgtgagagtgaaggtttgacaacgagatatattattggatcaaaccaatacaacccatacacaggactgtgcatagttgattgcatacatagtgacgttctttaaaaactatatacttctatgtggcatgcaacgacgggctgacggggacatataaaaggaaatgaagtggtcatcataagaatatcgatgcaaacttgttgcgaatgtggaggataaataaggagatgaaacactaccctaaaaacacaatcgatcattcactactatacagaagattcactttggtgcgcttgttgagaatcgatgtttggtaccagattcataactggcacccgtcaggtggcattgatgagatgccttataggagttggatatataaccaggacctataacttcataaaggtgccacttatgatcaataactggcacctatatgatgatgttataggtaccaaattttcagccacgtggctacatcaaaggtgcccatttattattaacatttggtacctaaaactttgtacacactagaaagttatagaaattcaatattcacaaccacatacattcacagccacatccacatccatatcttcatatacaatacattctccatcagcatatacctcccaaattcccaagtccaaagttcaacgtacaaatatatatctaaaaagggcttaatttcttcaacatatatatctctcctaaattcccatgtactaaaatttaacatacacatatatatctccacaaatacgacaaatgtgattgcgcttagggaagatacctagtcagagttggatttccaaattacgatccgctttcatgtcctgcagttatcatgcctgcaatagaaaacatataggagaatacttcctctgtttcacaatgtaagactttctagcattgcccacattcatatatatgttaatgaatctaggcatatatatgtgtctagattcattaacatatatatgaatgtgtgcaatgctagaaagtcttacattatgaaacggagggagtatgtaattatataaactattcaaacacattaaaatgtaaccttacataattctcggacagaagaccttggaataatagatgtcgtactcgcttgactgttctcggacaaccgagaaggtgtggagtatgcgactaaattctcgcttgaagtcaagaaatttcgtttcggcgggtacactgtcattttattccaccttgtcgaattccaccaactgatcttgggtaatcgagtagttgtagagtctatggcaaaaccctgaaatctgacatgattatgttgatatttcactttcctgaaatcaatactcagaacaaattgtttagatagaaatagcccccgagggaatgctcaagggtaacacaatataatatgaatttgaaaattgaaaataaaattaatctgcatgtgacaatctgccattagcaatcggagtatggtatcccttactagccccaagctgtctttatggaaaaatcgtttttccacaaaggcaactgaaaacttataacaaaccaagctgaagctgacaaaatcctagcccctagccatgaagttgggaaaatcaattcctgattacacggcttacttaatacgttgccatggagcgacatgaccaaatatgacatggttgtttggctttgcagtatctgatatggccttactagctctgggcatccccagccaaaatccccttaggtttctcggaggctttgtgagaatagcataaaggaacgatagaaacaacttcaagacagggagatataagaaaaagggatcaacggacaaatattgcacatataacacttacagaagttgatgcacatggggtgatgagttgactaccacacaaggtgaagaccgagtgtgtagttgtactcaacaaatcgcagaggtagtgggagaatcgctacgccgctggttgaagaccaattgtagccatacctcgaccactagaagttgaggcatgaggaccacgacaccgctgctcgaagaccagttgtagttttcacctcgaccattagaagttgaggtatgaggaccgctacgccgctggtcgaagaccagttgtagtcgtcacctcgaccattagaatttgactgataggtagcgagagatcactacaaccgactagtcgacaaccaggagtagacatatttcaatcacctgaaggcaactgataggtggcgagagatcgctacaatagactgttggataaccagtagtaggcatctcttgatctcctgaaggcaattcggagagatatatggatgacgtactcatgacctgcgaggaccgccacctgacgacaatgaagacgatgagggattatcttagttgggagcacgactcctggatctacggcctcatcctcagtccctattgaagtctgggaatctcaagtttcgtcgtcaccgggtgttgttgtgatgtcgttaacctcgtccgttgtcaccctgatctcgtcagtcctagacattgtcgtcctggtgactacggtgatcctatcggtctcggttgtcattatcatgaccacatcggttgttgtgttaggtggcaagagattactacaacagactagtcgagaaccaggagtaggtatctcttgatcacctgaaggcaactgataggtaacgagagatcgcaaaaattgactggttcgacaacaaggagtaggcatctcttgatcacctgatggcaactgataggtggtgagagatcgctacaatcgactggtcgagaaccaagagtaggcatatctcgatcacctggagaggcgctagagttggttattacatgtgcatctcatgtggccagcatgactcacatacccaacctatagcatatccggaggtccgttcgtaatcatgccgggtgatcaagctgatgacgttcgtgaggaattatccattaacaacctattctctttgttgtggccggctctatacgtgagataactagtcgtcgttctttgttggtaggtttcgtccgacaactcggcctttgtcgagaacattctcaataatggggtgtacttgaccacaacctactcgagtactcaattgttcctgaaaaatattttctagaagaaagacatatagcagagaatatcgagtatgtactaaaaaactacaagaatcttctagtattatcaggatatcatgagtagattaaatatcgtgtattacataaatcataaacaagcatgatttatataacgaaacagagcgagcctctagtattagaccgtagtcggcctaatatagaaaacactcacacaacagatatcgtataaaaagcatgctctaggtaaacataataaattacagatatgataatatcatatagatctgaaaaataggtatgttaaattacatataaaatattgcatacctttgtagatacatgccggatgtatctatgaaattagtagattaatttaaaaaaccaatctaccaattaccataacgcgtactcgttcgatatcatatatatatatgtatatatatatatata

SEQ ID NO: 92981 - DNA, 519 bp, Oryza sativa
cataataggcaagccgtgtaggcggaggcaccactcggcggtgacggaggcaagccggcggtgaagtcgtagacgcccaacagcggcggcataataggccagccgtgtaggcggaggcaccaatctgtggcgactgaggcaggccggcggtgaagtcgccaatcggcggctacggaggcaggccggcggtgaagtcgtagactcccaacagcggcggcataataggccagccgtgtaggcggaggcaccactttgcggtgaccgatgcacgccggcggtgaagtcgtagacgcccaacagcggcggcataataggccagccgtgtaggcggaggcaccaatcggcggcgactgaggcatgccggcggtgaagttgtagacgcccaacaccggcggcataataggccagccgtgtaggcggaggcaccaatcggcggggacggaggcaggccggcggtgaagtcgtagacgcgcaacagcggcggcataataggtcaatcgtgtaggcggaagcaccact

SEQ ID NO: 92982 - DNA, 5355 bp, Oryza sativa
  unsure (1)..(5355): unsure at all n locations
aggcggaaatcgccggccgacgtggggaagtgggaaaggagagaaaggcgggattcgaaaatcgaatcccggccatctcgggcgcgggcgcgagcggtagagagaggggagtgggcgcggaagaagcggcgcacgcgcggggtggtcgacgtggcccgtagaaggcggaggcgtggactcggcggcggttgcgggcgcggcggttgcggcgcggcatcggctagaggtgggggaaggacccgacaggtgggccccacctgtcggcgaccccggtaaaggagggcggcggggcggcctggctgggcctcggcctgcggccggcccagcagggaggagggggaggaaggagagaatgggccggcggcccattcgaaaaaaaagaggaaaaagggaggaaaaagaaaaagaaaaaggaaaaaggatttttcctggaattaaaatattgcttgctcaattttaattggttaaaattatttctagagctctgaaaattccactaaaaatcctgttaatgaatttcggcatgtagaactcaagaaaaattccacatgtcaaatccgattattatttgcattactatcctagggttttctcttgatttgcacctgcattttcttgggggtcgtttaaaaattaaattttaggcttgggaggagaacttcggggtgtgacagccatgccgggggaacctcatctcgcccccgaggtggtcgtttagccgacctccccgcaggttcgtccccgcgcccaccgcggccgcattcattctcccatctcccaaggcgagttttcactcacccgtttcttcttgtccactggtttttcttctgcctcagcaagatcccgtcgcgcccccctcgccattccaagtccggccggtccgaggccgaggagacggctaccgcggaggcccggaggcgggaagctgaccggcgagaagccgcggaccgcctccggaaagccgaggaggctgcccaggaggccgtccgggtttgccaagctgaggaggccgctcgggaggaggccagacttcgccgggccagggagtccgtccgggaggcagaggcggcgcgcgcacgccaggcggtttgccaagcccccgacccgacttccgccgaggcgacgacgacttccgaggccacccacgacgaggccgcgggcgcgccgctcgggcccgacccctcgggcgacgcttgggacgagccagcttcggngggcgcccccgagtccggcatgtcgatcggcgggccgagccgcgcggcacccacaccgaggcagctctcccttttgccttccgctgccccactgagcgcggagcccctcctgcaggccttggccgccgcgaacaccacggtgctggacgggttaagtgcccaaatggaggtcctgcaggcagagcgggcggagctcgacgcggcgtgggcgcgcgtcgaggaggggcggcgctcggtggaggccatggtggaggcgggccgcaaggcacaccgccggcacgcctcagagctcgaggcccgtcgtagggacctggcggagatcgccagggaggtggaggaggagcgggagactgccctcatcgccaccgccgtgctcgacgaggcgcgggacgacctccgcctccaatacgggagccgggcggcggagctagagaagaagctcgacgccgcccggggagtccttgacgccgccgctgcccgggaacggcgggcggcggagaatgaggcggcgtcccggcagcgcgaagaggcccttgaggctcgcgccacggcgctggaggagcgcgcccgcgccctggacgcgaaggagagagacctgacgaaccgcgaggccgccgtcgccaccagggaggcaacactggcggcgcacgaggctgcctgcgccgaagaggagtccgcactccgcctccgcgaggacgagctcaccgagcgggggcgagctctcaaggaggccgaggccgcggcgcagcggctggcggacagcctgttcctcagcaaggcagcgcgggaggagcaggcgctccgcaatctggaaggcgcccgtgccgagagggccgcactggatcagcgggccgctgagctcgaggcgcgggtgaaggagctggaggcgagagcgcatagcggcggggcggccgcgggcgacggcgacctagccgcccgcctcgcagccgccgaacacaccatcgccgagctgcagggcgcgctggactcgtccgccggggaggtcgaggccctccgcttggcgggcgaggtagggcccagcatgcttcgggacgccgtctcccgtctagactgcgccgggcggcaggcgtgcctctggggcggccggtgcgcgaagtacgccgccaatcaggggggcctcgcccagcgcctctcagagatggccggggtcctcaagcggctccccgaggagctcgaggagacgatcaagtcgtcctcgagggacctcgcccggggggcggtggagctcgtgctggtaagctaccaggccagggaccctgacttctccccttgggcagcgctggaagagttccctcccagaaccgaggacggcgcgcgcgcgcaggtccgggacgccgccgaccacatcgtccacagcttcgagggtacggcccctcggctcgcgttcgccctcgactccgacgaggagggcggtgacgacggtgcggacgacagcgacgacgaggccggcgacccgggcgcgtcggaatgagcccccaggcccccgccaatcttaataactttttcttctttttccgaggccttcgggcccccttcttgtatagactgatttaatctgcaatcaagtaaagaggaaatttctgtgtcagttctgtttgttgtgtgtatgatacgaggatggtctgtgccacggtccttctgtgtcttggcttgaacaagggctcgtgcccaggtcccagcctcaaacggcgcgggtcggggctagtgcctggggagatccacgtgtcgagactggccaggccgggagcgcggtgaccgagggttatggatgacccgattgtgggcctttgctgattcccccccggagttcaccacgccccggggcacggctcggttctgggccccgtttggcgattttagccggcccgggccaccgagggcagggtcgggcacgagcgtgctaattcaagccaagatccttcaaaaggaaacgatggcacaaacacagtcctcaggaaatcgaaagtgcttttattgaaatacggaagagaaaaaagagggaagtatatgcatgtggtagcccccggccaacccgcacgccccgggggggtgcggggttggcccgagcccgagaaatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgagatcgtcgacgcagagtgatcgggcccggacgtggcgctgatggtagcgccgcaggctctgctggtagcgcgtggctcggagggccgcgcgccgccttcgctcttccaaatagtcgaggtcgtctcggcgaagctgatcttgatcagcctcgaaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgctattatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcatcgttgagagccgtcggccaatagaaaccttggcgaaaggccttgccaaccaaggtgcgtgaggcggagtgggctccgcactcgccttcatggatatcggcgagaagctcgacgccttgttcccgaggaatgcacttcaggaggactccgttagccgcgcgccgatagaggatcccttccacctgcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccctagggggacgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcaccggtactccttacagacctggttaaccactaacagggagtcgcctaacaccaggaggcggcggatcccaagtccagctgccactctgagtcccgcaaggagtccctcgtactccgccatattgttggtcgcccgaaagtcgaggtggaccagatatctgaggacgtctccgctcggcgagatcaacgtgacccgtgcaccggcgccctgaagagacagggagccgtcgaactgcatcacccagtaggcggtgtgaggcagctgcgaggggcccgagctggcctcgggggcggagacgggctcaggagctggggtccactccgccacgaagtcggcgagggcctggctcttgatcgcgtggcgtggttcaaagcgcaaatcaaattcagagagttcgattgcccatctcaccacccgtccagtaccctctcggttatgcaagatttggccgagggggtaagacgtaaccaccgtgacccgatgcgcctggaa

SEQ ID NO: 92983 - DNA, 956 bp, Oryza sativa
ctttattagagtaaaccctgaaggattccagtccaggttaatttcatcggttgttggaagagttagatatcttggatcattccccccaagttgcaataggtcatgcagctcttccactgttgtgaattgccagaaagacacaatccaattgtttgacgaaatttcaaactgcacacatcgttgctttcgtttggctaaacgaaaacagagaggagcaacatcctttggacataaaccgttaacctgtctagtgttagtagtactcagcaatgttagcatgtgctgagtactactgttagtagtactcagcaatgttagcatgtgctgatgccaatgactaaaatgcaagaagctatatgcatgtagatgcatcaacgccacaggatgaaaaactgtattctttcaattgctaacagttttccttgaaacacattgttttgatgttacataatcttttaatttccagctgggccacataacaattagcactagtgctaacacgctagtggagaaaataggaagtccttaatatttgatattgcagtggcaagcatcgcaaacagaggttatacactacacatccattaaactcactgtttctaccccttgcaggtggcgaatcgatcatctagcaccgccggcaggctctctgccatagggatctaaagcgtgctactaaccggcttgccagacgcatgcatctcaatcatgcttaggccttgttcggcaggcccatttccaaacctggcctggaacagttcctggcctggattgaatggatccaggtaaattcactgaaagtctgaaaccacatgtcgattgaatccactccttttcttaatccacctcttcaaaaaactgcattcggttatttcttaatccatctggaatgaagccattcaagctgccgacgcttagtccaaagcctagcaggatcagaagttaagccgagaaaa

SEQ ID NO: 92984 - DNA, 1994 bp, Oryza sativa
caccaatcatgaagatgaagaaaatagtcggcgacgacaaacgcaaccaacagtaatgatgataagcagcaatcatagatgatcaaatataatgacgaagttgcccatcaatagcagtagagtgggctatattgaagaggcttgacaggatgttgattaagataacgatgtcggtgatccagtcgatagcaaccgtgaaagtgaaataataagtcggcgaagacatagtcatccattagcaacagagttgatgtcagggccgatgaagcagaggtgctggtgatgatgtcagtgacaataatgcatcaaattggtgttatagctgttgcagatgcttcacttggaggaaagtagatgatgttgtccaactcgtcgaaactgagctgattggttgataactctgctctaaagcaaagacgaagataatgactcctggaattgactcgttggctgataaattgattgcttcagcttgtcgaattttgagagtcttgtatttgtgtagcccccgactctttggttagttgggaaacaactgaacatagagtcgagaactgtaacttcttgtcgtcgagtagtcattgcttgagtgaagataaatattgaagactggaacaccacttgttgtaataaaataacacggcatcatatttggtgacgtatgccaaggtgtcgaaactcttgtagtcgtcatggttggtgaagtagaggcaatagagtttgctgatgccgaagataataaaaatgaagttgctccaccaaggtgacaaaattgcatagccgtgatgaagtgaacacgggtcggcggcaacagaagcaaactagtagtgaagacgcgcagttgtgaagattaaagcaccagtcggcggcggcataaccagtcggcaacggaagacgatgatgtccatcagtagtggtagctgtataaaccagacgtagaggcaagggcactagtcagcagcagaagagatgactagcgatgaagacgataaggccaatcaacactggcagaatcatgcagccatgggagtgaagaaaccagtcggtagaagacgtagacagcttgcattgaaggtgatgatgcctatttgcggtggcggcgacgtggccagccgtgaagacgatagcaccagttggggtcatacgaggtggccggtcggagaagatgtagacgtcctgcaatggcggcataataggccagccgtgcaggcgaaaacaccagtcggttgcagacgaggcggccagtcggtgaagatgtagacgcccaacaacggcggcataattggccaaccgtgcaggcggaaacaccagtcggcggcggacgagacggccggtcggtgaaaatgtagatgcctaacaacggcggcataataggccaaccgtgcaggcggaaacaccagtctgcggcggacgagacggccggtgaagaggtagacgccctacaacggcggcataataggccagccgtgcaagcggaaacaccagtcggcggcggacgagacggccggtcggtgaagatatagacgcccaacaacggcggcataataggccaaccgtgcaggcggaaacaccagtcggcagcggacgagacggccggtgaagaggtagacgcccaacaacatcggcataataggccagccgtgcaggcgaaaacaccagtcggcggcggacgagacggccagtcggtgaagaggtagacgcccaacaacggcggcataataggccaaccgtgcaggcaaaaacaccagtcggcggcgaacgaggcggccagtcagtgaagaggtagacgcccaataacagcggcataataggccagccgtgcaggcggaaacagcagtcggcggcggacgaggcggccagtcggtgaagaggtagacgcccaacaacagcggtgttgtgaccaaccaaccgtataggcgtagacaccagtcggcggcgacgacggcgagccggtggtgatgttctgactgatccattcctggagcgtaagagat

SEQ ID NO: 92985 - DNA, 898 bp, Oryza sativa
acagtagttcatgaaaatgaatttggaagagctgattacctgttatgatctttggttgaggacgagaaggcccttgcaccttatcggatgaactggacttcgggtcggtgttggtatctttttagggaaggctgcttgctcgagcctctgtttccgggatgtcctcatttgttctgtacccgactggtttccagtcgggggcacctgatcagcactggcttcagcttcggccgactggtttccagtcaggggctcattgctggcctctatattatcggtcgctggttgactactagtcaggcgattttcggcggtcggcccggtttctgtggaggtcgtaggaccagtctccatgctagtcggtttagtctttcctagaaggatcgatgtcagatggcttcctgcagatttgagatatgctattaacactacttcgatggtgtatgtttggcgatacaggggaaattgcttaatgacttgtacctggatgacttcctgatttttggtattggacgactggatgttttcttcttcgggttagcttgccttggctgttttccagtcacctttttgttgccagctttttcaacattgtcaccctcgtcgtcactcagaattaatttccttttgcgagagtccgactggttagttgctttgagatgcttggctgagcatcagaccggattttcggccctccactggcctgaccagcctgccggcggggtgagcggcgttgagcgattggaggatcagatttcattaaagaaaattcctatgcatgatatttcaagtttcagccaaccttacaaaagacaaaaggatgtcataagaaaggccgagatgtctgatacataccggtggaggagggtgaaagcattatatggcaccactggcagca

SEQ ID NO: 92986 - DNA, 1393 bp, Oryza sativa
gtacagtagttcatcaggcaagagcgttccttgatcacacacttggtttgaaacaaggtgtggtgctaattctgttcagccctttctatttgtgcgctgagcactcgctgcaccacgaggctctcatagtgctctgcagcttcagccccaatgtgtttctcatctttgtggggcgcgtcaccttcccctgcattgttagttgcaagcaaagcataggtttcttcatctaaatcactagcggaggagtacctaccatcagctctcacgatcattacacgagtgcttgggcagtccttgcacacgtgaccatagcccatgcagcgtaggcactgaatatctcttgtcctttctgatgatgccactgatgatgagctcttggaaggtgtagcaacaacccctcttgttggttcactcgggcatggtatagagtttgttgtagagggacgcagcttgttgcttgaggacgatggtgctgctgctcgatttgacggtgcagcagcgttggaaggtgtccaggagctagcacgacctgcagaaatgttagtcctgaagctagctcttcgtccgttcacttccctttcactttacaagcaagatgaaacaaacgattaattgaattatattctttgtaggctagaatgtcctgaatttctcggttcagcccacccatgaatctagccataccagcatcatcattttctaccaatccacaacgaagcattcctgtttgcaaagcttgataatactcttctacatatttgtttccctgtctaagttgttgcaatttgtgcagcaaatcacgtgcatgatatgaaggaacaaatctagctcgcatgactcttttaattgcatcccaggtttggggagtgttattatttggattggaacgaacaaattcactccaccaaatggatgcaaaatcagtgaactcactattaccagccctaacacgtttattctcaggaaaatcatggcaagcaaatttctgatcaatagctaactcccaagtaagatatgcatcagggtcatattttccatcaaagtaaggaatggtaaacttgatcgtgcctaaagaatcatcattatcacgtacctcccgtcgtggtggagcgcccatgccatggcgctgccggcactgttgtctttgtggacgaccaagtatctcctcatcatgctcggtgtcagtagcgtactccagttcttcccttgccgcgatgttgctattagcatcatggccattgtggttgcgcctagccgatccatcatgaccatcttggcccattctctccaacgtattcaagatacctgcaagagaagtgttcaaagccacaagggacctctccaatgaggaaagcttggagttggtgtcaatttgagcagcctccaattgacc

SEQ ID NO: 92987 - DNA, 749 bp, Oryza sativa
aaagtggacacgtagtaaaccaataaaatatattctcgatacaatatatatagcaggttttacatattacaatctcacaaaaaaaccagcttaattacaacaatcatgtgattcaaggttgatacaaatgcagatcgattagcaaacagacatgatcatatcaaatacgaatctataaatcgatctttttttatgcgtgcagggctgagagaaaacgaacatgtaagccattaaaattatctcgagataacaatatatataatggattttagaaagaaaaaacgacttacaacaatcaaattaaagtgattcaaggatgataaaaccgcacatcaatctgcaaacccgacaagagacttactcacggggaacaatagccaacaaccacaatagcgaacaaccacaccaaattaaactctggaatattataactgtgccgcttagcaggtgaaatcggtcggataggtcttgccacacttgttgaggatgagtccgagatcaactgggaggttgaccctaatgccaagcacattggccttcacggcggtgcaaaggcagatggcagcatcgagatcggcgatccctgacagcaacgagcagcagtcatcggggccgtacccaatcttcacatcgaccagccctttagcacgttggcgcacactctcagcttcagggcgttgatcgggcaacgcccgtgatcactgtgcccaccagggtgcaatggcgccggcactgcttgatggactact

SEQ ID NO: 92988 - DNA, 1810 bp, Oryza sativa
tgtggtcactcaagcagtaagcatgatctcagccgactggagagagcccctcatcaagtttttgaccaagaactccctcaggataaagacgaggcggagcggatctccaggcgcagcatgctttatgtcatacatgagaccgagctgtacaagaaaagtccatcagggattctgcaatgctatgtctttggaggagggaaggcaattgctaaaagatatacactcgggcatctgtggcaatcacgctgtcgcacgaaccattgttggcaaggcttatcggcagggttttttctggcctactactgtatccgacgccgattaaattgtgcgaacatgtgaaggttgtcaattttttgcccgacagactcatttaccatctcaggagttgcaaaccatcccgttatcctggccgttcgcggtttgggggctcgacatggtcggcccattcaaaagggctactggtggtttcacttatctttttgtagctattgacaagttctcaaagtggattgaagccaaactagtcgtcacgattacagcggacaaggctagagattttttcatcaacatcgtgcaccggttcggggtacccaatcgaatcattaccgataatggtactcaattcactggcgatgtgtttaaagatttttgtgaagacttcggcatcaaaatttgctatgcctccgtagcgcatcctataagcaatggataagtcgaacgtgccaatggtatggtacttcaaggaatcaaagcgtgagttttcgaccgactgcatccctatgctggcaaatgggtagatcagctgccatccgtactttggtctctgcatactacgcccagtcgggccacgggtcagtcaccgttttttctggtctatggtgcggaagcaatgttgccaagcgaggtagagttcgaatctttgcgattttgcaacttcaaggaggagcgctacggagaagaccgagttgacgatctcaaccgactggaagaagcccgtggggcagccttaattcagtcggctcggtatttacaagggttgcgacgttgtcacaaccgcaatgtttgatcgcgggttttcttagtcggagaccaggttttgaggaaaattcaaactacacgagatcggcacaagttatctccattataggagggccagttcataatttctaaagttactcggccaggttcttatcgactcaagcgtgaagacggtactcaatgtcgacaactcttgaaatattgagcatgttcatcgtttttatgctagggcattacttttgtatcttctttccctctttgattgctaacatcaagttgctccttgagttatcagtcaggggctactataataataattgagtgtgattcttatcaattcaatttgcttcccgtctgcaaagccgttgacagcgtcaatatcgatcttcgggtacaagaacttggtcattgccaatgccatgctcgcccccatgcatccagcttctttgatgttcttaaagtatgtatccgaagcagctctcagcttgtcgaagtttcgatagcgtcgaacgaactcagaccattattattaaaaaaacatggcttggatgagtggtgtatcggcgttggcaacttcatccctggctccttcaagcttcttaattttgttgaccaagatgtcgaattgagcctgagatttaattcctgcaatatgcataaatggttcacatcaatgactgggcacgaagacaagaatggttctggagttttaactacaaataccttagatgtctttcagagccgagtccctctgtttggtcaattcaccctt

SEQ ID NO: 92989 - DNA, 4237 bp, Oryza sativa
atttcacaacatcttccatatgctcagcgcaacctaaagcatcttttagttccatcttattcaaggtacatgttgaacaatccaaaacatcatgaggttgttttaactttttagcagaaatcatgttaaacatcaaactagcatgaaaaacaatttgatatttttgcaacaactttttagttaaaaacaactcatccaaagtgcgtgtgtgcaaagcaaaactacaagcaagagaagatctatttttcaaatcatgtgcagcattaacatctctaatttttgaaatctcattcattaaaacctcacaatttgagcaatcatcatcattagaaataagagattttaatctagcaatttcagatttaagagattcaatgataaattcctgttttctatacatcttctcacacttcatattttttgcactcaaaatattaatagcttcctcaaaagcacttacctcatgatcttcatactcaatatccgattcaccacgcgccatgaagcaaacaccggagatgttctttcccttatcatcatcaccactctcaccatctacatcacttgatggctcaaatgcagcatagacttgatcaaaagccctcctaagattctccttgaacttcctcgcttgagatgaaccctgcgacttgttgttgcttgtcttctcaccatctttgtcttctcttttgcctctcccaagcttaggacaatgcgaacgaagatgatcaattgaaccacattcaaagcaacgatttggacctcctcttttcctgttcctggtattattcatagctcgagcaatacggttagcaaccaaagccaaatcctcctcctcgatttgttcgagttgatcatcggatgtggcattaaaagcagcaagaaaagaaggcatagatgaagaagcatcaacatccaaggaagaagtagaagaaaccaaagcagtcgacttagaatcaacttttcaagaaagaacattcatctcatgtgttttcaattttgtctaaagtgaatccaaagtcaaagtagacatgtcaacagactcctgaatagatgtaactttcatctcccaaatagacatattaagaccattcaaaaagtgacgagaaatctcagatcgtggataattagtatcataagaagaatcaacagatctaagatcactcaaaattttattaaacctagagagatagtcatccaaagcttctccaggtttcatctcaaatttaatatactcctttttgaaaatatcacgacgaagttcttttatgttatttgttccttgatgaaagttactcaaagcattccaaatctcatgagcagttcgaagatgcgcaacacgatcataatcagaacgagaaataccactcaaaagaatgttgcgggctttgcaattttgttcaaaagcaactttttcagcagcagtattaatagcttcaggaatcaaataaggatgagaaacttttcttcaaagatcataattttcagccataatgtaagattgcatcctactacaccaatgagaaaaatccgttccattgaaaatatgaggcttagttgtaaacttagcaggagtagccatggcaaaaactctagatcaataaaaatccaaagaagaaaacaaggctctgataccacttgtaggatcgaatagcaagaactaagccaaccagaggggggggggtgaatggttggtatagccaaaaaccgaaaacttttagcggaaataaaagttaccctcgaaatcgatggagatcggtctgaccgagattgatctgccggtctgaccgagtggatgccgccagtctgaccggtatagatcacccggtctgaccgccgatgtcgcctgccgcgcctgtcgccgccgccggtctgaccgccgtgctcccgccggtctgaccgccgccttaccgtcggtctgaccgctggtgagtcgccggttggaccgtcgaaacccggtgaaacacaaatcgaagaactcttaaagtggatgacgactttattacttctctctatgtttacaaagtgcaccaacagcactccttacaaaaatttcgactaaactcaaaaccctaacttaaaactcaagtcaattgctctcaaaagcgataccgggaagcctcacactccccctctatttatacatgaggtaggcagcctaaagccacgaaccaaactcatactaggagttctaaacaccttaggaaaccctctagtacaagaaacaaactttacataaccaatcgtaccaaattcggactccttccaaattcgactccgcatacgcacacaataactccatcgtatgccatatggaatctccatcaaccacgtacatcaactctagcctaagtatcccgcatgatctctgaccaccacggacgtcgtcttatccccaagccgactcccggtccatcaccgcaaatactctcccgagacatcgagtcacctacacatgaaacaaacaaagaaaccatattccgagaccaagctatctccaacttgacttattagtagcaaacaacagtattacatacgtatagtatccatatagaagtcataatcatgaaataatcacggatatccaaataaacaacccgaaactgaaaccgacacagcgtcggccggtcagaccgcgggctggccggtccgaccgctcgatcaccgccggtctgaccggcaacacctgcccggtttgaccggtcacatgaaataacagcgatgtcctgtatattcacctgtgaaatccaatcatctccaaaaccactttgaaaataaattccaaataacaaaaccaataatctccaatacccaatgttcatcacagaataataataaaaacacctttgattttacaatgtcccccttgatgaacacattggcaaacccttaaaaatgttttgatgtttggaaaaataaaaacaaaagtggtaaaaagcacacttcgtacaaacaacatctcctttctcaacatgatccctcaaaaagtgaaagcgaatgtcaatgtgctttgtgcgtgagtgttgaacatgattcttagcaatattaatagcacttgtattgtcacaaaagagaggtactttctcaaaagtaagaccataatctttcaaagtaaataaaagccaaagaatctgtgaacaacaactagcagcagcaatatattcagattcagcagttgattgagcaacactagattgtttcctagaagaccatgcaatcaatgatgtaccaagaaaatgacatgttccactagtacttttcctatcaattctacaaccaccaaaatcagcatcggaatatccacttaagcatatagaagatgaagtagaataccaaattccaaactcaagtgtatgatttaaatacctcattattcgcttgaccgcttgacgatgtgaagcacgaggagaagcttgaaaacatgcacacaaacacacagcaaattgtatgtctggcctagaagcagttagatacaacaaagatccaatcatacttctatattccttttgatcaacagcttcaccatcttcatcaggatccaacacagctgtagaactaattggtgttgaaattggcttgcaactctccatcttgaatcgtctcaaaagatccttcgtatacttcatttgatgcacaaaagtaccttaaggtgtttgcttaatttgcaatcccaaaaagtacgataactcacacatcatgctcatctcaaattccctgtgcatagtctcagcaaaatctacaaccaaagcgtgagttgaacaaccaaagatgatatcatccacataaatctgaacgaacagttgattatcaccatgtttaagaacaaaaagcgttttgtcaacctttcccattgtaaaacctttcgcaagaaaaaagttcttaagcctatcataccatgccctaggagcttgtttcaaaccatacaaagctttagacaatctaaaaacatggttaggaaaatcaggattttcaaaacctgatggttgtttgacataaacttcctcctgtataaaaccatttagaaaagcatttttcacatccatttgatataatttaaaaccttttgaagcagcaaaagccaacaaaagtctaattgcttcaattctagcaacatgagccaaagtttcatcaaaatccaaaccctccacctgggtaaaaccttgaggaacaattcagctttatttctcacaatccaaccatcctcaatttgtttatttttgaaaacccaattgggtcc

SEQ ID NO: 92990 - DNA, 3657 bp, Oryza sativa
ggaatttgtactttttccttttacagattaggttttttatatatgcaattccatctattaaaacgcacccagctgtcaaaacaatgacaataagtagcgctgatagatgaatttacacacaacccggatagtgtttttttttttgaatacgagagatattttatcatttgttatttgaaactctattgtgtatttcacggtatagatattccttccatgaatataaatagtgaaatatgacatcttttagtttttttaaaaaataataaataagtagaccgtgggacttcttcctagttgtaagaaaatgagcaaattattctcacggcatatgaactggcaaggtggatacaaatagataaaacaagttgtgttccgtcacaataacttatctggtccatgctaacctaaaccaaaatagagaaaattatgtgagggcgtgaggcagtggcagggtaagctccctaagcaggccgggcggctgcccgggcttcacaccgtgtagctgttaattcctagcgacctattatactccaaattagtgtttaaacatctgatgtgatagagaataaagtttagtccctgtatacaaactacctttgagctggattcccgagcaacttagttgtgggtgcatggcaccaagccttatgaggttgtgtcctaccgcttgaagacagtgaatttattttgaaaatattattattttagtggaaaatcgaaaaaatggtggttgcccagataatttttccaaaatagggtcatgtcgatctgttgtagtttgaccggaccctatcgaatggtggttgttcgacaggtggaggctatcgaacaatgggagtagcgggcagggcctgtcaaactgcggctgttcaacatgtcccagccaccgtccctgtcaaacaatgggcgttcaatagggcccgtttataccccccacccccccccccacacacccttcgcctgggtttattttcggagtaggcgaggaccacatcgccacttccgtcgccggggcaccatgtccgttgcatgggagagagctgcgcggccggaaagaaaggtgggtgcaggaaagagcaccacccagaaaattacaacgatagtgatttaataatcatttctcattgttgaatgctaaatttttagcacgttgaagttagtattaggttagtacgtattactttgaggtgagtagcaatgcattttcaagtagtgaactagtgatcactaagtagaaataaaaatagagtattagtagaaattcataaggagtgacgaattaagttattttatgttagagtaagaacgtaaccaaagggtgaagttattgggtagtaacatagtaagataatttgtcatgttttattaggtgtcatgtgatgtggtcgttcgtatatattatagcaatgctcctatacaaatttgtgatagcagggtggattgaccgtatatgcctttgtttatactagcctaaatgtacactggagcagttggttttgaacgacatgtttgggttgttgtataatatgttactagcgtgaatacactggagcagttggtgtcgaaagacatgttagggtggttgtataatatgttccaggtagatgcagcgttggaaaaaattatcataaaagttgtgtgctagtaagaggagaatatggatggcaggggagagtagtagatcttgcatctaccagaagttggagaaaatttgtggctaaagtaaggagaatgggtatagtctggtaatatggtgtagaagaaaacatatgtttttggaatcagatagacaaacatatggaggtgaaacaaactccaatggaggttgcgcaacacaataatgtttgctggagcagtcaaagtgaagctccagaagaggttattgtgacgataaaggtcattgcgtgtgacagtaattatttagaacgacgatgaaatggaatcacctttggtaactgaatatgtacaatagaaacacataattcatgttaatttgctaggtcctgaccaactaaaaccctacttaaaaaatatttagcggaacagatctcataacattagcaattgaagagcttttccttcgatcattaagcttttcccgtgcatagaatagtctagtagtaaaagttaaaagtatttttgggttaccacccgtacgtccctaacgtacagatgaattattgtgtggtagcatgcaggtgtgcagtacgtagctagtggggtcattgagtatatatgacctaagtgttgagaaagctctccagctcaaccgagaacctccccatgacgagcgatggcaatgaaacaacggtacccacgacattgctgctgcccttgacgttgaccagcaagctcaccgtgggaagcgcccgagctgggccgccgtacaccgggtcgccccacccaaaatccacgcggtcgaaccccacgcgtcggacgtcggtaacgacgaagaggttggtcctggctaaacgcgggcgccgccgcagaaccagacattcggccgtggatcgcacgtactcggcggtgacggccgccttcgcctcctgcaccagcctcaccacgtcttccagcgtgcaaccgcggagcagctccccggcggtcatcaccaccgtggggtacgcgcatgtgttgccgtagtagccggatggtaggcccagcgcggcgatcctgctgaagccaacgacggcgacgaggcgcacctcctcgtccgccgggacctccagcgccgcattgcgagcgcgccagaggaacgccgcgaggacctcgaagctcgtcgccgtgctgctgccgccgcggaggcggtgctcggggtgtggcagtagtgcttcctccttaagcgcggcgatgtcggtggagctgaacaggaaggatcgaacgatgttgtcggcctccctgccgcctccagggaggatgtcgatcatgtcgtactcgcgatgtgggaacgccggcgccggagggctgcgtgcatcgagcagctcacgcgaccatgtcgcgtggacggccggcgcagggaggccaccggcgatgtcggcgacggcgttgaggaactggacgatacccatagcatcgcacacgctgtggttgacggcggtccccacgatgaagccaccacagaggaggcgtgtcacctggattcccaccagcgggcagctgagcacgctgcctcctcggcctgatgatcgcacgtcggggacgagctgatccacgcaggggaatgacggcctgagcccgtgaccaccagcggcggcggcctccatctcttccagccggacgtccgcgtccgcctccacgaacaccaccccctcgccgctgcagtcgatcaccagcttccgtccttccacctctctcagcctgccggcgagcgggtagtagtgcaccagcgcccgcgacagcgccgcgcggatgatgcccgacgggtcattgtcgcggacacatggcgccggaggctgaccaccacggtatacgaggaggccgggaacgtggtagcgcagggactcttggtcgtcgatatcggagaggcgcttggtttcgcacggtgtcgaaaccgatgggccgacgagtaccgcctcgcggcggtgcacggtgaaggacagttccatggccatcgaccgtcgttacggtagtgcgttactcaactcacaacacatgcat

SEQ ID NO: 92991 - DNA, 558 bp, Oryza sativa
ttctatgggttggctatggcaccgtaggctagcccatgttggaatgaggaatttggcatctcttctaaaaggggaacacattcttggtctatctaatgtttcttttgagaaagatcgtgtgtgtagtgcttgccaagccgggaagcaagttgggagtccacatgccataaaaaacatcatgactacaacaagaccactcgagcttgttcatatggatttatttgggcccatggcgtacataagcattggaggtagcaagtatggcttcgttattggtgatgatttttcacgcttcacttgggtgtactttctccatgacaaaagcgaagctcaagatgtcttcaagcgcttcgcaaagcaagctcaaaacctctatgatctcactatcaagaaggtgcgaagcgacaatggaggagaattctagaacactcaagtggaggaatttcttgatgaagaaggaatcaagcacgagttctccgccccctatgatcctccccagaacggcattgttgagaggaagaaccaaaccctcattgaagccgcaagggcaatgcttga

SEQ ID NO: 92992 - DNA, 1601 bp, Oryza sativa
aaataaacaaccggaagttgaaaccgacacagggtcggccggtcagaccgcggacggccgggtccgaccgctcgatcaccgccggtctgaccggcaacacctgcccggtttgaccggtcacatgaaataacagcgatgtcctgtatattcacctgtgaaatccaatcatctccaaaaccactttgaaaataaattccaaataacaaaaccaataatctccaatacccaatgttcatcacagaataataataaaaaacacctttgattttacagaggaaaaagtacgaattacacccccgaactatcgcggtcgaccgaattacccccctgaaccacaaaaccggacattgctcaccctaaactttgaataccggacgaaataccccctcgaccaaatccagagcggttttggcctacgtggcgtacgcgtgggcatccagtcagcattttctcttttttttaatggtggggccctcctgtcatctaactctctcatctcccctctcccctcttcccctctctgttctctctctctcgctattcctctatccgtcgcgggtcttgcggcgacatccgttaggcgatgatggcaggctcacgtgcggcagcgttggcgcggtcttgcgtgcgcgcggcggcctcgcaacggcagcggctgtgtttgcaccacggcgtgcgcgtcctcccccagatgtgttctggcgtggcgggcttatccttggacagggccgtccacaccgtccgcgccgctgttcgcggtgccatgcacgccgtccgcggcgaccacctccttccgttgggggcttcttgctccctcctccactacctgcagctacggcggagatggacagaagaatttgttttttagagatttaattaaggacggaaaaaatcatttgaaaaatcaatcagatagtagggttaatatatatcacaggatattctcctagctactactactacatatatttgttcatcatgcatatatatgatcgggcgcacatatcataagcaaataaatgatcatgcggtgcaagtgcaagtgcaatataggacgtttaaacgaatgcaaggaagcagagagatgcattaacaaatttaaacgaacgcacgaaccgcaggagcgagagctccgtggcgagctcgaacgcgcgcgcgaacggcgtgcacaggggagggggggtgcacaccgagcggcggcgggcgcgctggcccggctgggtagatcaagtcggcggcagacgcgggcgcgggagagggaaccggctggcagcggggaggtggcgaccacgatgacggcggatcaagcggcgccggtgacgggagtttccggattgaggtcacgacggaccggacagctgccatcgcgagtctcccttacatccttctcgtcaggtccaacattgagccgcctcctggccgtccccctccgcggtagccgtccacctcgacctcctcagcgccggccgccgtctgccgtcgcccacgccaaggccaccgccaacgccgccttctcccccggcgccaagcccgtttaccgcgccagcgcgctgtcttcccgcgtcccctcccgaccgccgccacgcgctgctgtgcacgcc

SEQ ID NO: 92993 - DNA, 1036 bp, Oryza sativa
ggaggttttcccaaccccagttttggcaccacaggtttttgcgtggcgtcagtgcccaatccaaaggatatgtcattcttgtgccagagaattacaagatcgaccgcaaccccaagtacggatacaccatctgtagtcgggaagtcaatgtcgtaggactcaaacccttcgtggaccacttgcggctgcaccttggcatacgcatcgggtatgaaatcttcgttgtatgttctcccagggatagcaatggctgtagcggcctcaagagttttcccggagcgtccaatgggaacgtgcaatctgcagggtgtattctccttgaggtcatcgaaggggtaatctggctcaggttctttggtttcggggcgaggcaaaatcatgtgcttgacgcagaaatccatcatttgcctttcaaactctacagcccctttatctctaagtttatccttgtacgcttcacgcttcttgtgggggtcatgtttgaacccttccttccaactcatcttgctcgacacacctcgaacccttcccccatgctcaggagtacccagcgccgtacttagcacatctttcttcctcttaggcttgaaaaatcctttcttctgtgaacttgataaattctccattttattggcaacgctctgcagctccggatcttcaaacgatacttttccttcatccgtgattttaggagttctagctcttacccagttacttgatctctgtgtccattcctccattggtaccgattgccccttcttcctcatttcctcctcctcttttgtccaccgctccacctttggtgcgtatcctgcggagcctaagcgatgaggaaatttgttcttcttgaccaactctgcatacttttggctcctttgaatttcttccgaggagttcttcaacgttagaaagtcgtcccgctgattcggggttatgttggcatacatcgaaaacggtgtgcgtcccatcttcacaaatcccatgttcaaggcggctttccaaccacgccaagacttggccattgtttgcagtgcac

SEQ ID NO: 92994 - DNA, 2293 bp, Oryza sativa
gaactattttctggtgggaccgttggttccggagcaaccacaacagcaagggactgctcttgctcccctaaacccttatcttcagtccctttagtactatcggccatcgtatcaaacctttaacataaaataaaatgttatcctccacattttaaattactcaaattagtacaaacaactttaaattgcgaaaattaattactactccctccgtcccataatataagggattttgagtttttgtttgcactctttgattactcgtcttattcaaaaaaaattttgaattattatttatttttttgtgacttgctttattatccaaagtactttaagcacaacttttcgatttttatatttgcacaaattttttgaataagacgagtggtcaaacagtgcaatcaaaacctcaaaattccttatattatgggacggagggagtacttactattatgctagaatagatatgttattaattagtacttatgctattaattagtacttactattatgctaaattaattagtaaaaacaaaattaacttgcggaatgaataaagtatacttactattatgctaaattaatgagtacaaacgaaatgaaaatgcgagaatgtatgaattatacttactactatgctaaatgaattaggacgaacaaatttgaattgcgaacatgtgttaattagtacttactattatgctcaatgaagtagtacaaacaaaattaaattgcgaaattaattactacttactattatgctaaattaagtagtataaacaaatttgtacaaaatttgaaaagttattatcaagtagtgcactaattcacaattacatttcctcgacatgttgtttaaaaaaaattaaaaaggcaaacatatcctccacatttttttaaaaaaaaatgttaacataccctcctacatgctatttaaaaaatttgacaaattcacatatcctgcaaaattgaacataccctcccaatttcattcacatatcacccacattcccaaattcacattcacaatcacatataacccctcattcacatatcacccacccctcattcccattcatacccacatgcacacacatatataccccctcacacccacatgcacacacatataaaaaggaacacccacatgcacacacgtctgtggacgacgaacggccgatgacgagcttcggtcgtggacgacgaaggaaggaccgacgacgaggttcggccgtggacgacgaaccggccgacgaagccgttcggccgaggacgtcttcgctcgtggacgatgaaaggccgataatgaagccgctcatggacgactgcgagagagggagagagatggcggcggcggctgtggagcggccggcagcggtggagaggtcggcggcgcggtggaggggccggcggggtagcggtcagtggcagcggagcggtggagcggccctcgtgtcggggcacaggtactccaattgcatattcatctttgaggtaatcgatacagcactcgacaacctcttcagtactataaccctcaaccattgatccctctggatgtgcacgatttcggacgtaacccttcaaaaccgtcatgtaacgctcgtatgaccacatttgatggaggtacaatgggccaagcgcaaccatctacggcactatgtgaacaatgaggtgctccatcgtatcaaaaaatgacggagggaaacacatctcaagttggcactgtgtctcatgtgcgaatgtagggagatttcctaactcttcgagactaatgaccttctgtgacactgcgttgaaaaagtagcacaaccttgtgatagcaacctttaaatgctctgattttatggcccttattgaaattgcaagaaacacggtgagcaagacatgacagtcgtgtgaattataaccagataccaaaatctttcattgaaactagtcgactgatgtttgatgagaaacctatgggcactctgacatcacggagtgagttgcaaaatgacttcttctcctcaggtgtcagtgtgaaacaggctggtggaagatatactttgccattcttctctccttcttgagggtgtaactcttccctgattcccatctcgactaggtccatccttgattgcagaccatctttagtcttgtttggcatgtccaacaatgttccaactatgttgccaaacacattcttctctacatgcaagacgtctatggcaagccgaacctccagatttttccaggacgggaggactttaaaaaatatggaaggcttcttgaatggggaagggagtta

SEQ ID NO: 92995 - DNA, 844 bp, Oryza sativa
aggctctcacttaattgtgtgcttcgcatgcccaatgtaaaaacatctctcatgtagcattctgcccacttctcccttactttatatatactatcaagccatgtttgtttttgtactttctttctcatagcatcaaaagcttcttcaaacttcactttatcatcatggtcatacatgcaagaactgaattctgtaagcatatttgtttcactgttcctattactaggtaaatgcttggtggcattttgcattatatgaaaagtgcataatccatgccatgcttctgtaaatacatgctcaattgcctttcccattgcaatatcttggtctgtgtatatagttctatgttgcttttgattatgtgttgccagaaaagtatcaaaaagccatttgaatgactcaaatgtctcatcatataagagggcagcaccaaaaatagcagtttctctaaaattattgaatccagtgaatacaccaaatggcctatactccctgtttgtttcaaaagtagtgtcaaaagttataacatcaccaaaatgagcatagtcaacaatcattttagcatcagcccaaaatatatttgtgatttggtcttcacaatccagttgtacagcataatggaaagatggattttcagtgactttgtcctgaaagtattttaacatacttacttgctttccaacccccggttaaacccacaaatttttttttttaaaaaaagacgccccctctccctttggtgcttagtatgcaaataattttgtgatcctaacgagtataactgagaattgcaagatcccaccaacatgtctactagctaattcatgagcagctttgggtccaa

SEQ ID NO: 92996 - DNA, 3193 bp, Oryza sativa
gggcgcgggcgcgtcgcctcccgtcggctgtgccggtgaggcgcttcgggcgcgccccgcggctgccatgtggggcccgggcgtcagtcgcctgcgccctcgggtgcggctgacgcgtgggacccacggcgccggccggcgtaagccgcgtgcacccggtccaccgtggaccgagaggctgccgcgtgggccccactcccgtggacccggtccgcgcgctcctctctcccggctgacgcaataaatatgtttttaaattaaaaatttaaatgaagaaattcgtaaatatccatttaaagagcatataaagttcaaatggccatatcttggccatttgaactcggaattggaccgttcaagtctctaatttttccttaagaagccaagaacccatttttgtgctttgtttctgcttgttatatggagtttagtagagtaaaagccgtttcttttccattggtcgtgtagacgctgcagcttcggaagatccgctcttcgtggaggttgaagccggcatttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttatgaccttattattgttgttattgttactatttccttgttcaccctagaataaacaaaaccctaactagtggacactctactcatggtatcactagtatgattttaggtagatgcttcgctgtttaattaggtaacattaggtggttttacaactctagactttgggaatattcatatcacctggacactatggaatggtttggttattgtggaattggcttcacaccgctccttctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacctagggtcgggttgccagttcggtctgaatcatcgtaggacttgggttaaggcaggttcgtatgggttcacggccttgataaataatattgtatagtactagaatcgtgtttgcaaaatagccctgagcaactaatgtctttaaatgctgtttactgcaaccctaaccctttatagtataactcatttgtactcccttgcatttattctgcacttgtgggtgtgtcttgttgagtacggtgggtgtactcagtcttgctcatttttcccaaacccagaagaggagttcctggaggatgaaggctttggtgtctagctcgtgcctgccgtcaagtgcctgtggtcgtcgccctagtcttccgctatttctcgtttgtctttgtgtgtgctgggccttcgttgcccatgtaataaattatctatttacgcttccgcttgttaaactctgaattgtatcaacttttggtgtaccttgcctcctgggacaaggattaatgcacgcacgtaaggaacgcccgttgggttatttccggtcgtgacagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtatgtgccgtaattattgtgtacatgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggttaaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttattacagccaaaaataatttttcgaagtaattgtcattaatctttgtactataaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgaaactaaagat

SEQ ID NO: 92997 - DNA, 3216 bp, Oryza sativa
cgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtatagaagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatgcacgccatgcaatcacaggacgaatcgacctgtcccgttgatgacatcactcagcggacaccatgtgagctgcatattccttttcaagaacttatcaataaaggtaagatttagccattccgctagttgctgcttatatatgttgattactaataaataatctctcacaacatgaaggtggcgtcgggcatggccatcccaacggacccttcaggaacttaccactgcaggccaattccagcaagatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggttcggccatctcctcttcaggatcatgcacagtctcctcctcatgctccgcaagcacggtctccacctcaggctccagcatcgactcctcctcaggatcgtgcaccgactcctcgtgctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagacccaagtgtcaggaacttctttaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagatttaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccacttggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattaaatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatatctatatacatatgcatttgcataacatatatatgtataaatacatatatattatgcatgtatatacatataatataatataatatatatatatatatacatatatatatgtatgcatatatatgcattgaaacatatatatgcatgggttatatatatatatatatatatatatatatatataaaccatgccgcaacaggggcatgcaaaaaaaaaaaaaggtcagctcgatctttagtcccg

SEQ ID NO: 92998 - DNA, 740 bp, Oryza sativa
aatactcaagcttccctttcgtctgaaacctgtgtacacctcgcaatggcgtgactcgaagatacacaaaatcatccactgcgaattccaggtcacggcgacggttatctgcataacttttctgccgtgactgtgccacctttagattatcccgaatgattctgactttagcttcagcttctctcaggatatcagtcccgaacacttggctttccccaacttggtcccacaggagcggtgttcggcatttgcgcccgtacaacgcttcatatggtgccatttgtatgctggcttgatagctgttattgtaggagaactcggcataggggagactcttatcccaggtcttcccgaaatctagtacacatgcgcggagcatatcttctaggatttgatttagacgctcggtctgtccatctgtctgcgggtgataggcggtgctgaaattcaatcgagtacccaactcttcttggagcttcttccaaaagtgagaggtgaattggcttcccctatcagatacgattttcttgggaacgccgtggagactcacgatcctagcgaagtagagctccgctagtttgttccctccataggtggtcttcacaggaataaatcgagctaccttggttaatcgatccacaactacccatatagaatcatatccgccttgggtctttggaagtccagtgatgaaatccatcccaatttcatcccatttccattcgggtacttggagtggt

SEQ ID NO: 92999 - DNA, 886 bp, Oryza sativa
tacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctacgccgtttatttattttccgctgcttagaactttattgattgagaggaactatctacctctgtaatgacattctattcgcttattaattagagtaatatttgtactctattatcaatttgttattgtgtgcctcggctgattcctggacgagggttcacacacatgtaagcgtttggaattttggatagaaattccgggcgtgacagacatccttcccgccgttgttggagcggggaggcgcttggccttgctgacgccttggctttgggcatttatccgcaaagtgcccgggctcgaagcagttgaagcacagacgctgctgaccttgagcgtccctgcggccttgaacgggctgcacagctggcgtaggaggacggggcgcacgagtcccttgctgattctgctgctgctgcggctgtgggacgcgcaccacgaattgaggtcggggcgctgggcgaggttgctgctgctgctgctgctgctgctgcgaggaggatccccctgggtagggattggtgtagcgaaccctctggttagcaccctgttgattgcggaaattcgccaagcggcgcttgtgcgatttcaacttcctgtgcttggcttccaaacggatgctcttgtccaccagtcgtggaaaatcaagatagtc

SEQ ID NO: 93000 - DNA, 5668 bp, Oryza sativa
gtagggggttctgcgtgtgtttttctaagctctcatactctttcgtgtgcgccaagcttttcctgttcagcccaatggctaaacaagcaaaagcgcacaagctctctccgagtgttagcggtgacgacggggagccgaacccacgccgtcgagctcgtactccaccgccccctccacgccaaagtcctaggcgggaggaggcgctcgagagggtcgaaggatccgcgacttcgacatccacgggtgatggagaagggcgccgagatggggagcgtcgcctcctcgtctacggcgacggtagcacgccccagggcgcgctccaagctgcgggcgcgctcctacgtcacccgcccgtcgtccctgacccggagtctccagcccaacgttggctggatgacgtagccaacttggtcatgacggcacggcagcacctaggtgttggtgggcggtcctccgccaccaagacctctggcgctgctaccaccggctccgtgtcgtcaaggcggagggcgcggcgagcggcggctgttgctcgccgttcggctgccactccctcgtcagcacctctgacccgggaagatcagcgtggggggccagatgcccgcatcggtatcgagcgccggcgtaatggtcgacgtgctacccacgcaacggagggtgcctcctcgtccggagtgtcacctcaacacggacgcggggatcagccctccgtgcccccggttggtggtgtcggctgtagagcctttgtagcgagccttcggaacgtccgttggcccccaaggttccggcccaccatcgccgaaaaatatgacgggagcgtcaaccccgccgagtttctccaggtctacacgaccgggatcgaggccgccgggggtgatgacagggtcatggcgaatttctttcccatggccctgaaggacaggcgcggggttggctaatgaacttgccacccgcgtcggtccactcttgggaggatttgtgccaacagtttaccatgaactttcaaggcacatatccgcgcccaggtgaagaagcggacttacacgcagtacagcgaagggatgatgagtcacttcgctcatacattcagcggttctgtcaagtccgcaacaccataccatgcatccctgcacacgcggtgatctacgcgttcaggggggtgtgcggcacaaccgcatgctcgaaaagatcgcctccaaggagccccagactaccgcggagctttttcagctcgcggaccgagtggctcgtaaggaggaggcctggacctggaacccctccggttccggtgtggcaacttcggccgcccccgggtccgctgctcagacagggcgacgtgacaggaggaggaagaagaggtcggcccattccgacgacgagggtcatgtcctcgctgtcgagggcgcttcgcgggccacccgaaaggggaggcctgcgagcgacaaaaagaaggaggccggcgctcccagcagggagcgcccaaccggcaagtggtgcatcgtccacaacacctccttccacgacctcgcggactgccgcgcagtcaaaagtttggctgagcggacgagaaagtgggaggaggagaggaggcaggagcgccgagagggtaagtccccggcggtaccctccggcaatcggcgaagtgaggccaagcagaaggcccccgtcgaggacatcgatggcggcgatgatgacctaggctttcaggagcctggggccaccattgccactgtcgatgggggagcgtgtgctcacgtttctcgccggagccttaaggccatgaagcgagagcttctggccgcggcccccactcatgaggcgacgcgtcgggcgcggtggtcggaggttgccctcaccttcgaccagaccgaccacccaccgtgtgttgcccggggaggacagatcgcgatggtggtttcccccaccgtttgcaacgtgaagttggggcgtgtcctcatagacggggggggggggggggggcagccctcaacatcctttcccccgcggcctttgacgccatcaaggccccggggatggtgctctggccgtcccagccgattatcggtgtgacgccggggcacacatggccgttaggtcatatcgacctaccggtcaccttcggtggatccgtcaacttccgcacggagcgggtaaacttcgatgtggcggacctaagtctgccctacaacgcggtcctagggaggcccgcgttggtgaagttcatggcggcggtccattacgcttaccttcaagatgaagatgcggggccccggtggccccatctctgtccatggcgacctcaaagtcgcgcttgcttgtatggagcagcgcgcggatcacctcgccgctgcgtccaagcccgagggtggcgacgagaggcttggcacctccgttcccgccgccccgaggcagcggatgatcacatgcgacgaggtcccggtcaaggaggttgccctgggtgacggcccgtccaagactacacgaatcggtggtcttctggatggcaaataggaagacgcgctcgtctccttcctgcgggcaaacgctgacgtcttcgcatggagaccggcggatatgcccggggtccccagggaggtgattgagcaccgtctcgccgtacggccgggcgcaaggccgatccggcagaaagtgcggcggcaggccccggaacgtcaagccttcatccgcgaggaggtggcgcgacttctggaggccggattcatccgcgaggtcatccatccggagtggctggcaaacccggtggtcgttcccaaggcgaatggcaaacttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactacattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtgaagacgcgcgaccaagaaactttactttcagatctggcggaaactttcgagagtctccgctccgcccgcataaagctgaaccccgataagtgcgtgtacggtgtacctgcgggcaagcttctcgggttcttggtctctgcccgaggcatcgaggccaaccccgagaagatacgagctatagagcggatgcgcccccagcaagcttagggatgtgcaatgcgtcaccggttgcatggccgccctaagtcggttcatatcgaggctgggagagaaggcgctacccttatttaagctcctcaaacgctccgggccgttcacttggacggaggaagctgaacgtgccctcactcagttgaaggcgtatctcagctctcccccagttttgatcgccccggagccagatgaacccttgctactctacttagcggcgaccccgcaagtagttagtgcggcgttggttgtggagcgcgatgaggacaatcctcattccgcgcatccccaccctgtgctggcttggcccgggagagagcagggaggagaggcccccgagccgaacggtggcccaaggcccccgacgaccggagctggccctctgcccgcttgtcagacggtgccaggtgcccccgacccccaggatggcccgggggccactgcgggaaggccgcacctatcgccctctgacctcgaggttaaccctgtgccgactcgacccgggagagagcagggagaagaggcccccgagccgaacggtggcctaaggcccccgacgaccagagttggccctttgcccgcttgtccgacgatgccaggagcccccgacccccaggacggccccgagcccactgtgggaaggccgcgcctgtcgtcctccgaccccgaggtcgtcggcacagaagacgagtgcgccccgcgaggccgcttggacgaagagcgccccagggatgcggcccctggcgaagaggatcggccccaccgaaaggtgcagcggcccgtctactttgttagtgaggccctccgggacgccaagacccgataccctcaggcccagaagatgctttatgctattctgatggcttcgaggaaactgcgccattatttccaggcgcatcgggtcacggtggttacgtcttaccccctcggccaaatcttgcataatcgagagggtataggacgggtggtgaaatgggcaattgaactttctgagttcgatttgcactttgaaccacgtcacgctatcaagagccaagctctcgccgattttgtggcagagtggaccccggctcccgaacccgtctcactccccgaggccagctcgggcccctcgcagctgcctcacaccgcccgctgggtgatgcagttcgacggctccctgtctcttcagggcgccggtgcgggggtcacgttgacctcgccgagcggagaaatcctcagatacctggttcgcctcgattttcgggcgaccaataatatggcagagtacgagggactccttgcgggacttagggtggcagctggactggggatccgccgcctcctggtgttaaccaggtctgtatggagtaccggtgctctgacccgcagatggatgcttacgtacgccaagtacggcgtatggagcgccatttcgacgggatagagcttcggcacgtgcccagacgggataacacgattgccgacgaactctcacggctcgcttcctcgcgagcccagaccccaccgagcgcctttgaagaaaggcttgcccagccgtcggcgcgacccgaccccttagggagacggacgcgcctgaccggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccgacagctctcaatgatgcggtcgacctggtccggcgatgcagagcgtgtcaattccacgccaagcaaatccatcaaccggcccaggccctgcagatcataccactttcatggccatttgctgtctgggggctcgatatcctgggaccgttgtcgcgtcccaaaacgactctaaaattcatcctcaaaattgtgccgagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgagaagaaataaacaaagttgaaaaggtttataaaaagaaaaccctaaaagaagtccttttcctccccttttccctt

SEQ ID NO: 93001 - DNA, 1441 bp, Oryza sativa
aacctttgaagattcctgaatggaaatgggaagaaataggtatggattttatcactggtttgcccagaacgtcatcgggccatgactctatttgggtgatagtcgacagacttaccaaagtggctcatttcattccggtaaagacaacctattctggaagtcgcttggcggaattgtatatggcaaggattgtgtgtttgcatggcgtccctaagaagattgtgtctgattgaggcagtcagtttacttcaaatttttggaagaaacttcaggaagagatgggttctaagttgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtctacagatggctccttacgaagcactgtatggtcggaagtgccgcactccgcttttgtgggatcaaacgggagaacgtcaggttttcgggacggatatcctaagggaagcagaagaaaaggtaaagatcattcaagaaagattgcgagtggctcaatctcgtcataagagttatgccgacaatcgccgcagagatttgagttttgaagaaggagattatgtgtatcttcgtgtcacgcctcttcgaggagttcatcgttttcagaccaaaggaaaattggcaccgcgttttgtgggaccttataagattgtcagcagaagaggagaggttgcttatcagttggagttacctcaatccttggcaggagtccataatgtgttccatgtgtcgcaattgaaaaagtgtttaagggtacctaccgaagaagctaatattgaccagatagaagtccaagaggatttgacttatgttgagaaaccaatccgtatactggaaacaaatgagagaagaaccaggaatcgagttatccgtttctgcaaagttcaatggagtaatcactcggaagaagaatcaacttgggaacgagaagatgaattaaagtcagctcatccgcttctgttcgccagttcttccgaatctcgaggacgagattctgtttaaggggggtaggtttgtcacaccctgaaaattcaaaatatataaattgttgtttaaatggaatttttagaaataattttaaaagtcttgaaaagaaaatctatgtttaattaataaattccaatataaaattgggccagataaaatttcattaaatactttgcttaattctataattcctagatttttctgggatttatttgagctaagaaagtatttttaataaatggaattgcatttaagaaataattttaattgaaaaaaggttttaaaaagtcttcttttggctttgggccgaaagtcgaaccaaaacctctcttttttctctc

SEQ ID NO: 93002 - DNA, 4091 bp, Oryza sativa
tacaccacaagcacttcggcaacttacaacaaaaagttcgacccacggagctgagcctggtcatctcgtcctaaggaagaaggcgaacccagtagcggttggcaagcttgaatcaaagtgggaaggatcatacctcatcaaacacaagtccaggacgggatcttttcgcctagcgacactcgaaggcgaggagttcgaccattcctggaacgccacctctctaaagcgcttctatgtctagaatgggtggcacccaaatcgccaacttgtaaaaatgtacatactgttatgtaagcccttcggcactatgtaagccctttggcactatgaaagcctttcagcaagaaaaaaaaagaagaaagagagaaaaaagaaaaaaaactggatgtagggctattatccaccatggaggcccgaaccagtataaaatctatgtgtcctccgccttctttttatttttttcgtgtgattgataatttgtggaaaaaccccaaggcaaacgcctgatcagcgaaaaaggccaggggggcgaaacgaatcggccgaagcatcgctcgccgaacgttgaaaccgcaacagcttgtctcggaaaataaatagccgaacgatgttacgttcgatcagcataaaagcaaaagcgtttctttcaacacagaatgctacagatcgaaaacgaacgacgaaaagctaaaaagtcagtacacctatttcgctaatatatgcaaaggggccggcatgttccgacctaacaaaagcacaaaatgtgacgatgcaaacaatagcgaaaaggaaataaaacacgtctttattaacttcgaaaaaaaataatcgaagaatagaagtttcacaacacgatacaattcaccttacatgtaaattacatcttcgtccccataatcactatcactccctaaggaatgatcaggcgaactaggttcatcatcactactaatataatacacaaccttaagaggagtagggggcgaaacacagactaaactgtaacgacgttgaaagatcgtttcctgacgtttagtcttctgatggtttcgccgaaagcgagccatatcctccaaacgtcttgaatgaacaagatcgtaatcttctaaggttcgcccggggtgcgcccgcagccagtcggcaaccatgaaaaccttatagctgcgaccgtttatctccatttcgcgataaataggccgaaatggacatcgcaccttcggcagacccttcactgccacaaatttcttgttttgacttcgccagctcccgaaagggggccggatgcatgacttttggcgaaccccctgatggacagtgcagaaaaagcaaaacacagcttacatagtaagaataggaggaagaagggggaggtatggcataatgcgagatgagcgaaataataatatgccaaagacttcgatcatcaaaaagtaattaagattgtgtcatatattccaattgtacaaaaaagccttttttaaggtttggcggcagcctgccgaatgtacatcattcgcctctccaggcaaacgcagaagagggaggaaaacctctgggtgatcctgggcatcgcctccaacctcttcgcctgtcgtgccctttccttcaccctgatctgccgcctccgccttcgctagttgctctagaaggcgcactttggcagcggaccggccatctttctgccagaactgttttcgccacgcgcgaagagcgggcgaaatgttctgcgcactaatctcccagtcccccttcgcataggtagggaactcggcgacgtgctcgcagccgaactgttgcaaaagtcctaaggtgaaggccgccgatacatgctcacagcaatcgccgtacgcggtggcgcagtccgaaaccgatcctcagcagagaccccccgcactttcgcgcccatgtcagtaagggcgaggcggagcgtttggcaagccgttctcgcggattcggtggtcttcgccatctcctggaaccgctgcgactcctccgcggcgctcgcttcggccctactagccttcaggcaaagaacctccatcttcggctcagtaaggttgtagtagtcaatcagcactgctgaatgggccttcttcttctccatttcggccttgaggggatcaacctcggccctggccttaaactgaaggcgtttgacttcagttttcgcttccttgagggtattggccagggcctccacctccaggttcttgcggcttatttcgtcgtccttggcccgaagacggctcttaaaaccgtcaaaacgggcccgtacggttcgctccgtcgaacagtgagccacaagaatctagatgaaagataggagcgggtgaaaagaacaaaaggttaattgtcagacgtaaaaaaaaaagggacgaagaggaaaacgaagaaggaagaaaaggcatacccgaaccgccaggcttttaatggcggaacacccctcgtcgaactcattaagttcggtgaataagctcggggtgccggcgggcaagacaaggttgctcaccccctccataaagggaataaggtccacccgagtctcgaaatcaccaggggcgaagtggggcgccgcaagggaatactccggtggaagatgcttcggtggccgcacacttccccatcgccttgactagcggcgaaatagctggctcacgcagagggctcccgaaaaccctcgccacagccgacacaatccgttcggtggaggctgaagccccggcggcattaccgcctgccccagcaacgccgagcggagcgaggggagcagtcgaaaggtctaaactgcggccagcgggcgaagttggagtcccgtcagaagattcgtcgtcgctgaaaacgcgggcgatgtcgacgagtcctttctttttagagatcttctgcaccggacctcccttcgccgccttgcccgaggagaacgcaactagggccttggccccttccaaatccttccgtcgaaggtgggagctgttaaactccaccccggtctcgttgtgaccaggacttggggtaggagtgtagccgagggtgtcgacgcggtcttcgatcgcctcgttcgcggccttatcagccacggcctcctcctcttcctcctctcctaggggcaagcttcacttcctaggggcaagcttcacttgtccgcacattcacattcgcgaaggccctgcatcgtcgtcagctttgtgggggtttgcccgaggaggcaattcgccgttgtaaacccggttcgcccgcccagccgcttgtcgtgttagcaactggctatactcgacgaccgacacgtcgccgatcatcctgcgggcctcgttttcagcctggtcgagggtcaacgctgcaaaagtaaagtgtgtagctatgttaacagttagacaaggcaagataacaaagcacagcagtgtatggcaagagaacagtcttactgtctgtcccttcaggaagaatcaggttcggcaaaccgtcaacctcttcgccttgatcaactgtaacttgccatgactgggagaggggaaagatgcgaagcatacagaattcctccaccaagtcacggcagctaaggcgggagcaaaccttccgcagtagaacgaaccgcgcctccatagcgccgtccacggcgatcttgggtttccagttaggcgcgatcgccctatgccggcaacggagggctttcgccgagtaagtgccagcctcgaaggggatggtgtgatagaaccacctagccatccaatggtggtcccactttgacatggcagcgttcaccggccagagatcggaccactcgggacgaacgttaaagttcatgctcccgaacactgtcttcttcgttctagccggggtaatcaccgtcttcgagttcacggtggcgaaaaatatggcgccgaagagctcggcgttaggctcaaacccggaagtccggcacgcccagtagaagatagcgatccgaacaagcgccaacgggctcagctatggaagttccacctggaagaggcgaaggatctccggcaacaacacgttgcagggaaaccgtagccctgcttcaaaaaagacggcgaataccaccgtccgattgttgataggtttcggcaccacggcct

SEQ ID NO: 93003 - DNA, 4353 bp, Oryza sativa
cggcgcggggaaccggctggtggtggactgcacggccgaaggggtggtgttcgtggaggccgacgccgacgtgcggctggaggacttcggccagccgctgctgccgccgtacccgtgcgtcggcgagctgctctgcgacgccggcgacaccagggctgtcgttggcaaaccattgctcctcatgcaggtaacacccacgacgacgtacgtttgtttctttcatttttgtttacaatccaccactcagttaatgtttaactaacctgtctactatatatccgtcctaagatataaccaactaaataaaacatattttaatattacagatctgaactgtggtatatttaaatttatatttattgtgatgtctctaatccagtattatatcgctatattttatggtggaggggtagctaaatactttatttgtgttttagtgacatgattaatttacagtccatcttatttaccctatggattggttgtaggcatggatcaagattcattcattcgacaacaatattactttggttgggtttaggttcactggtactagggaccgtgatcttaataaggattcgtaaggacgccacattgttacgagaacagtgatggtagcttcgtgcatggttggtagggattgtacctactattaattacagcaacccactgatcttcatttacgcaagaaataatccaactttagatttgcagatttgattatgcacaaattagttctggagttaacaaatctcttttctgggcaattggttttatagttttcagttgccaaactgcttttcttttgaacactgccacaaacatgagaaatacaatgaatgtggcatcatattttgataacaaaaacttaaaatacaaatacaacagccacattaactaagatttagtctgaagtagtggtgaatgggattggaccagaaaagcattgaaatggttattcaacacaacgattagttggactggctttgggcccatcaagaggggttccaactggagtgtgatgttgcagttggatgatatatatatgggccggcaatattaagattgcgaattaagaatgtggtaatgttgtgttgtattattttcaatattataaaacgttttagcttctccatccctcatttaaattcactagcatccatatgaatttgtacagatatataaacacatatacatatgggatcaagttgcatggtccgactatatattcatactaacataaaaggtcggattttcacataatactgacaatactcgagcacggaagaattcttttaatgttttataagaatatatactgcctctgtttcttatttctgattgagctgaccaatgtcatatagaagtgtttaggatggaggtaccatacttaccatgtctaattaattaattaatttgactgttactgatttctatatgtggcggtttcattaggtgacgcaacttaaatgcggcggattcgtcctgggcttccacatctgtcacaacatcgctgacggcttcggcatggcgcagctgatcatggccatagccgacctcgcacgtggtgagccagccccgaccattctgcccgtatggaggagggacctactcacggcagcacgcctaggtagcggcgcggtggcacgcacgccctttgcatcggcggcggcggcgtcggcctcggcgtcgagcccggcactacagaacggtgctcgccgcgccgccgccgcggctgacgcgatgctgtcgaccccgccggaccggatggtggtggagtacttcctgttcgggccacgggaggtgtcctacctgcgtggccagctgccggcgcacctggcggactccaccacggtgttcgagctgctcaccgccgtcatgtggcggtgccgcacggcggcgctcgggtacgggcccgacctccgcgtccggctaatgatcaccatgaacgcgcgcgggaggtggaacgcgcacaccccgctcccgcgcggcttctacggcaacgcgcacgtctcccccgtcgccgaggccgccgccggcgacctcctcgggcggccgctcgccgacacggtggagctcgtgcggaggaccaagcgcgggatgacgcgggagcggatgagcgccatggtggagacggtggcgcagctgcgggagtggccgccgtcgagcatggacagggtgtacgaggtctccgacatcaagtggaccaccgtgaacttgctcaagttcgggtgggctgagttcgccggcggcggcataccgctcgcaggcgatctcacctccaagctcggaagcgaccacacgaggtgcaagaactcggccggcgaggtgtcgacggtggtgtcgatgctgctgcccagggtggccatggcgaggttcaagaaggagatggccgttttgttgaacaaagatgacaagaagagcttgacaattatgagttcgctgtagttgttgccacacatttcaagcaaaggttcttaaacagctaatggtcaccaaagcacatttttatcactgtcacttcatcatttctgatcgatctagttgtgcacatctaatttagtgggacaatcggtttacttagtggagtactacaatatatgtaattgtattcagttgtgtctacctgttcatctgcacaggctattggattttcatcagttctttaattgtaaaatacacccctccctttaatgtatgcgcacatacttttaacttgtaaagttacctcgctcattatagtttgtaatgtgagctttttataaatttgtttctattacttatgacggaaaagataaaagaaaataattaaattaaactcctcttgtaaccttggagcggcctacgttacatatctattattccctccgtttcatatatactactataaaaagtacgagttcatcaaacacctgtctctcctaacccttagatctattcatccaacggtttatatcaagagttggatcacccctgcaattagctatcccgcctccactaatctgcggttacgaaaaggaagagaggaatagaataattcatattatctaaaaatattcaatgttacatttaatgaaactaatttagtatagtagattttgataatttttttataaacttggttaaacctaaacgacctaaagtagtaaaatagtcaaatgacctataatatgaatcagagcgagtatatattaatattatttatcaatcaatctatctatctatctattatgtctttatctttatctattataaaaataaagatgattcgttacacacagttggttcgtttagtctgtcatctacaagtctggcttgggaatgcacatatagcgtgaagtccgtccatggttgttatcgcgggagaagcaaaaaaggaaacataatcgtatctagaagtccatatgccaccttcaaatgtactgtcctcctctctcctaccacaaaattttcatcgttgttcctcgggcccactcaatttgtccctttgaatgatgaatcactctttccaaggcgtgattttcttctccccttccccccttcacatctgctgcagtttcgccaagatcatttcctcggttcccctactcctaggacaacgaggatgagcaatccatgcatccagtaggtttgtctctaattggataatgacgaggaaaagccatatcattagcttgagaccttcaacgcattagactagtaggagaaacaaagtcatagtgctaggtcctcaccgatgtgtcaccgcctaggcgcctatagttagccagaaggtttgcagcccaatagcctgactcacagcatggagatttggcttggcacatgcgcagcacagcccaacagttgggccgtgcctactgcctaggcctctttgtcagcccgacgtgtcggccaagcatggcacgccccaacgatcaacatgcccaaagagataaggaaaacgaaatagacttattccagccccataagacagtaacttgaggccttcgacgcattcgactagaggagaaacggagccatagtgctaggtcctcaccaatgtatggctgcctaggtatggcctgaccgttggaccatgcctaggcctttttctcagcatgacgtgctggcctggcacggcacggcccaacgatcagcaggccaaagagataagggagaaaaatatacttattccagccatataaggtactgtccaaagagatgagggaggtaaaataaacttattccagccatatgaggcatggaccaaagaaatgagtgaggtacaatagactttattgaaggacgagcacagtgggctgatcgtgcctttgtgctggcatggcacaacctgtgctttattgggccgcgcct

SEQ ID NO: 93004 - DNA, 1861 bp, Oryza sativa
aagccactcggcgtcaactgtcgcagtatctagtgctgtaagttctgcttccattgttgacctcgttaagatgatctgcttgcaagacttccaagaaacagcaccacctccaagtgtgaacacatatccacttgtggcctttatctcatcagcatcatatatccagtttgagtcactatacccttccagtacttttgggtacccggtagtgtgaattccatagcttatagtgtcatttagatagcgcattactctttccagagcctgtcaatgatcatctcccggatttgagacaaaccggctcagcttgcttacagcaaatgatatgtcaggcctcgttgcactagccaagtacatcaatgaaccaatgatttgggagtatctcagttaatcccttgctattcttcggtttttccttaatagcacgctaggatcataaggagtagcagctggcttgcagtcactgtagccaaagcgacttaaaatcttgtccatatagtaggatttcacaagtgtaatcataccctcatctcctcttagtagcttaatgttaagaataacatcagcctctcccaaatccttcatttcaaagctcttggataaaaagtccttgacctcctcaatcacattgaggctggtcccaaagatcaatatgtcatcgacatataaacacaagatcacttcttctccccccccatagcgatagtacacacatttgtcagcttcattcacgacataaccagcagatataagtgtggtgtctaacatgtcatgccattgcttagatgcgttgcttaaggccacacaaggatttcaacagtttacgcacgtattccctcctgaccttatagtacatattcagtgctagttgatccatatagatctcctcctgcagctctctgtttaggatacctgtctttacgtccatctgacggccgagcagaccatgagaggctgccaaagcaagtagtacacgaatcgtggtcaaacgggcaactggtgagtaggtgtcaaaaaattcctcgccttctttttgggtataacccttggccacaagccttgccttgtacttttcaattgtaccatcaggcctaagctttttcttaaaaacccatttgcatcctacaggctagcacccatatggacactcaacgacttcccaagtaccattagacataattgagtccatctcactgcgtactgcttccttctagtagtcagcgtgaggagatgaatatgcctcttctatgtttcttggagtgttgtccacgaggtatacaatgtagtcatctccaaaggattttgcaaccctttgtctcttactcttacgagtatctacaatcttatcctcctcaggatttccctcaggcgtttgatcattgtgttttatcggtgcaaagtgctgatggggtatgacaatttcttgactagaagtgctaggcgtatttttcatgggaaattcattctcaaagaatgtggcatctctggactcaataattgtaccaattcacatgtcgtgtactccagagtttactattaagaatctataacccacgctgtgaatagcataaccaaggaacacacaatcaacagtattcggtccaagtttacgctttttggctataggtacatttaccttggccaaacagtcccaggttcgtaggtatgagagatttaatttcttcatttcccattcctcgaatggtgttacttccttatgcttcattggaattttattcaggacatgacaaagcagtcaaaactgcctcaccccaccattccttggaaagtcctgtagtgtctaacatggcattcaccagcttagctagagtatgattctttctttcagctaccccatttg

SEQ ID NO: 93005 - DNA, 897 bp, Oryza sativa
  unsure (1)..(897): unsure at all n locations
cctcgttggggccttcgactcgggacgatcagcgtggagagccggatgcccgcctcgacatcgagcgccggcgtaatgaccggcgtgctccccacgcgacggagggcgcctcttcgtccagagtgtcgcctcgacatggacacgaggaccagccctccgtgcccccggctggtggtgtcgcctgtagagcctttgtggcgagtcttcggaatgtccgttggcccccaaggttccgacccaccatcgttaaaagttatgcgggaacgtccacccccacgaagttcttcaggtttatacacttgggattaagccccttgggggtgatgacagggtcatggcgatnttctttccccatggccctgaaaggagataggcgcggggttggcttaatgaacttgccacccgcgtcggtccactcctgggaggatttgtgccaacagttcaccatgaactttcaaggcacatatccgcgcccaggcgaagaagcggacttgcacgcagtacagcgaggggatgatgaatcacttcgctcgtacattcagcggttttgccaagtccgaacaccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacctggaacccctccggttccggagtggcagcttctgccgcccccggatccgccgctcagacagggcagcgtgacaggaggaagaagaagaggtcggtccattccggcgacgagggtcatgtcctcgccgtctagggcgctccgcgggccacccgaaaggggaggcctgcgagcgacaa

SEQ ID NO: 93006 - DNA, 1097 bp, Oryza sativa
acgtctgggtccgatcactctgcgtcgacgacctcgtcatacaccgcgtccaaacgcgtgctggactgagcaaactctcaccaatgtgggagggtccgtatcgagtgatcggcgtcccccgcccgggctccgttcggctggccacggccgacggcacagagctgcctaacccgtggaacatcgaacaccttcgtcgcttctacccctagtgggggtcgggtatcaggtcttgggctcgggccaaccccacaccccccgggcgtgcagggttggccgggggcttatcttttttctcttccgtatttcaataaaagcattttcgatttcttaaaggctgtatctgtgctgttatttccttttgaagaatcttggcttgaaataggtcactcgtgctcaatcctaccctcgggggctcgggtcggctaaaatcgccaaacggggcccagaaccgagctgtgccccggggcgtggtgaactccggggggaatcggcaaaaacccacaatcgggtcacccataaccctcggtcaccacgctcccggcctggccagtctcgacatgtggatctccccaggcactagccttgacccgcgccgtttgaggctgggacctgggcacgagcccttgttcaagccaagacacagaaggactatggcacagaccatcctcgtctcatacacagaacaaatgaaattgacacaaaaatttcctctttatttgattgcagattaaatcagcctataacaagaagggggcccgaaggcctcggaagaagaatgaaaagctattaagattggcggaggcctgggggctcactccgacgcgcctgggtagccggcctcgccgtcgctgtcgtccgcaccgtcgtcaccgcactcctcgttggagttgaaggcaaacgcgagccgaggggccgctccttattgtcggtcggttttcccttgctgatgcgcgcgatttgcgaccgcggggattctgcccgaagagagagagagagcagggaggagaggcccccgagccgaacggcgggccaaggcccccgacggccggagctggccctccgcctgcttgtccgacggtgccaggcgcccccgaccc

SEQ ID NO: 93007 - DNA, 1527 bp, Oryza sativa
cctttgtgatcttggtcttgaatgttaatttcatccattcattctagtcaagacttatgagcagaggcgggacctagcctattttgtgttgcgctggatttactatgataaagaggtacggtgtccaagctcatggacttattagagccctagtgcttattcaaatgcaagtactccagtattgttcattctaaaaaaaaaatgcaagtaactacattcggaagcaacaaattgagaggaaatttgtcttgtttttcctcctacttttgttgaacggttaaacggtgttctttttcaaaatttgttataaaacagttgctttaacaaaatcatattaatatattttgaaatttaaaagaaataatgcttaattaattatcatgtgctaatgacttatctcgttttacatgtcttttcaatcttctcctaacccatagtgtcgaaacaatatttcagcaatataaaggggtagcgcacgagacttaaaagtggatggatgcggagacaaaggatttagacaggttcaggccctctcaatgagaggtgataccctactcctgtttggggatttaaatctgccgggtgtattatagatctgacgatctagttgtgtctcatgcctctagagggtctcctgcccaccttatataggatgggggggacatgattacaagatagaaatcttaaccaatacggtatcggttttctaaatctactctacaatattatcaaaccaggactttatgccattccataatatagaaggaaacgtaatacctaagacattatccgctacatattctataaatataagttagagaaaattcgatccatagcacaggaaaaaaagcggtaccaaaaaatagcacaaaaaatttccactttcgatccatagcataggccaccgatttttcttcgccctatagtacttccgtcacattttgaagtaacggtgttagatcggagtggagaaaatttttgtcggacacatttgcccttcgttccccacgttccccaccaggtctcctcttccgccccctcgtggatggcggcgtggcggccatcggcgtgcctggcgaccgccgaccgcctcgtctccccgccaccgtcgagcgagctacacacgctcttcaacgacgtgggtgcgtggctcgccgtcgccgccgacggcgaggtggaccccgtctggcactcggcgttgctgatagagggcgagcctcccgcgccggcggcagcttgacgacgaggacaacgacgatgacgtgggcggccctagcttcggcgtggatggatgtggcccgtggtggccgtactcggtgccgcagaacagcatctcccttgccacgacgccacgccgcgctggcttgccgctgcttgcacgtgacaacgacaacaacaacggggacgccggcgatgacgacaacggcgacagggacgatgacctgccgcttatgcaggcgggctgcggcgcgcgctggcggatgttgggatgattcgcgagcgggcgggcggcgggctttgtcagct

SEQ ID NO: 93008 - DNA, 1198 bp, Oryza sativa
attgaacttaattaattaccttggttaggtccctggtattgcacctccttttagggctcaattccagctgtgtcaaagcactgacctgaaagatgcaaatcaaacaggcaaatcaacaccaactagctagtaatctctaatttttcttttctttatttcttttttaaaaaaaaaacaaagactctctagctttaagccttcatagcaacaaaaatatatagggaattaagctagctgtaactaccttagggctatttactggagagcttgcggtatcctccagggaatcatcatgatccagggccttgaagaccttcttcttgagcttcttcaactccttgtacctatcaggcaacgccgcagccgcgggagcgcaagacgcggcgtcggagatcatagaatcttcctctccttcctcctcctccagctccttctgatcactgcaatcgccatagacgccatctccgccatgggagcagtatgaagaagcaccatgatcttcttgactcttcttctcctcctcggacatcatgaaatccacaaagtagtcggtccaggtgctctcctccggctgagcttgagcagcagcagcagcttgctgatcttcactagtactactgcagctaattatggcactcctcatcacagatgagccactaactaaatcctccatgcttttgatgttacaagcaaaggtggtgatagctaaagctgatcaacttaatcgtacaagcttctatgcttgtgttgtacccaatgatcgaatggatgaattaatggatggctttgcaaagatgcatacagcctggctctctatatatataacaggagagagagagagaaagagaagagagaggtgtgaatctgcatgacatcaccttgagggaggagaaaaggaagattcaagtggatggggtgttaaaatcaacaaacaaggggcactggtgccggaacaataacaggttagaaaagaagctagaaatccatggctcctttgccgacgctgagtaaattttaggtgactggtggtgacaatgagtccgtgtcgagcgctgattttttcggcctttagagcgagatttatacaatacaatttggcatgagattggattgcttttagtcagcctcttatagcctaaagtctttgagtgactacatgacatatcatgtaagttgctgataggtttccagttttccc

SEQ ID NO: 93009 - DNA, 868 bp, Oryza sativa
tcagctataatcctaaagaacacatccagaaaaaatgaaaaccacacgattatagaagaacaatgtaccaaccttattccatttccttgccctctcataccaatctataacactgcatcaagcaaaagataatataatcaccaataagtactacagatattgaaagttctaattactcaaaatctgatccaagattatgatgctgtgagactgataggaacactaacttagtaagcgtgcaccggctcgtgagatcgaacatgtacaagatcgccacggcgtccttacacgcgatcgggacgtggtcgaggaactggctgtctcctgcattccatcacacaacaaaaactcatcaaacaaagcaagtttaggcacaccaaaaaaaaaatctgattcttcaaccaatgcaagtataaagggggaaacaaatcctgcatttgtagttcatatgcttgtgcaaattacctgccacatcccaaatgctgaaggcaattcgagctccccgaactgccaaggtcttgtccatcagattcaggcccgtcatctgcaagccgttctgctcctcgtcgtccccaacatacttaacctgcagaatcaattacccaatagattaatttactttttactatctggattgactattctgaattcaagaagaaatgattcttgtgttcgattgctgactcgagtttcagaatttgattgcttcttggttgaaagaggaggaggagatgggagaagttaccatgaagctggtcttgccgatctggcaatcgccgagcaggctgaccttgaggctgacgacgttctcgacatcggccgcgtcgcggtcggcggcggcagcgtcgtcgtcggcgtccctggggag

SEQ ID NO: 93010 - DNA, 667 bp, Oryza sativa
gagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgatgggtaccgagctcgaattcgcctatagta

SEQ ID NO: 93011 - DNA, 2262 bp, Oryza sativa
gccaaaaaaggaaatcacgtcaggaggggtgatcacgcggggcgatcaatcgcccattagaaatttcgcaaaccacacgcattgctattgcaagtctcatatttatataaggacaaaattctctatgttaaataacagaaatttatgacccctccaatttatgacacaaatttaacatacactatacactggtggagaaaccctttgtagtcccggttcgtaaccccctttagtcccggtttccaaaccgggagtaccaatccgggactaaagatcgctatctttagtcccgggtgaaataaccgggagtaaagatcgatctttagtcccggttggtaacaccaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaagattcatgccatccgtactcaaaccaaaccgtatgtttcgtgcgtcctttccaaattctttaaattttctgtcgatgtttcgccactgcgaaccatcggcggggtgtctcagcatcccgtcctgttgacgtttttcagcgtgccatcgcaacattctagcattccccttgttcttgaacaaacgcttaccgtggtattataggaaaataccacatcaccttagcaggaattctcttctttgttagctgcccgtcaacttcttttggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgtaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctcgatttgtatgtaatcaccaaaataaattcaatagaaattttggcatgacctcacctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatctttagccccggttgg

SEQ ID NO: 93012 - DNA, 3761 bp, Oryza sativa
agcaaatttgctgctccaaggaagaaaaccaccagcataggtggctccaagtagattgttcagatcattcacggactctctgtacatataggaaagaattcaaatgatcagctaagaggcaatagagttgtgtcactgtgaaactacattcagtgaaatggttgcaataagaataggcgaatgggtagaatttgaatataaattagaacaagaagaaggaacatacatattctttcccctccgccaaaagacagtaccaaacacaagaccatagagaagcgtcataacataacgcatagcattgtagggtggatccttccaataagattgaaattgcttccatgtatttgccacacactgatttaggaaattctgggaatatttggtaggaaatgagagatcctggaagcctggaggtggaacactcagctgcttaataagttcttgattgctcctgaacacattgacggaaataatgtaagagctatagaaaagatacttattttgtctgtttgaccattggaagaaattaatcacaactgtcaaagcaacaaaaattgtactactaaatatttgaataatattgcgcacatatttaccggtaaagtgcagaattggcataaacttcagcaaagtctatgtccagacgagcctcagctagagaagagctaacttcaagcatccatgttgctgggttatatccttctgtgatttttgggacccctggaattgcctgcaggagaacgatatacattagaagcaagtagcctttctttctttcttatttagtctcggattgaatacggttacccaagttctcttaattccatgcatgttccccatgctcttttaataaacatttgttctaggcattgagatagtctccactaaacatttgaacgttacttttctaattatatgttagcaaataaaaaaacacaacggtatataaatactgtcgatgagaaatacactaatattgttttccgtgcgatagatccaagcacttatattggtattcaagttttattaattattgctcaaaacaatagattacaggttacacatattctgaaatagcatttgtaaaaagagggactacagaattgtatatcttttagttttacaattacaaattacttttatctgagatattagtttttgaggtggtatagttgccctttgcctcaatgtcattaaaaagagtttgttgcacaattgtacaagcagttttgaagaatcaaccttagtactatagaaaaaatatttatgagttccaacaataatgtgttctactccctccattattttttacttctgcattcagagtctccaatgcacatgtttgatagttgcattttgtaatcatataaaaatcattaaaaagatgtaactatatgaaagtagttctcgtgaaaagtctatttgcatatgctattgatttaagatggaaggttttaactgcacatgttctaaaatgatacagtcatggacaatgaaatttatgcctgaacatttgtgcatcactagaaagggcctaaacgaccttcaatagttgatagattaccaactagtattcatacattcactaattaaaaaaaatgcatgtcttcgggctactaattccatccaagtttgcccaatggaatttcatgggtcacaatagatgagaagtattaactgattttagcaatacagatgggtaacatattgcaaattggttatcatagagactgaaatatagtatcaaagacagttcacctcgaaatattcgactagtatttgtgaatggagaccaagctggccagcatatataacccgtcctccctcttttagcaacagaagctgaaaaaacacaatccatttttcagtataaccttacagcgctgaaaggagaactaacggacaaacaaacaagagcaaagtagcaaggacctcatcaaaagactcaaagatatcaatgctaggttgatggattgtgcaaaccacagttcgtcatgtgttaactgtatttctcacagtacgcataacaattgctgcagctctagcatcaagacctgaagttggttcatccatgaagataattgaaggatttgccactagttctactgcgattgtcagcctcttcctttgttcagttgacaacccactaacaccagggagaccaaccagagcatcacgcaatacatcaagctcaactagtgacatcacttcctccacaaacacctacacagtggaattaatttcatcagaaataattagtattttcaacttcacaagataaaaaaatgttgcatctattcttcaatatcatgattgtcaaaaatgccttgtatatgtatactccttaaaagtctctattggtggtggcaccccaccgctgtttacagtttttacaaattggcccctgatattttctgatatttggaaatagtctacatatttggttgaaacaagtgaatactaacatattcaataaatatttttatctattacatatgataatatattttattttatccatagcaaagcagagtcattttgttgttactcataaaaaatggcaaatgacagtttagtgtgctgtcaggttcctaggaactcaacgaataagtgtgtcttgcatgtggacgagattcgggtaatatacaagcctacacaatcgtgtggcctcttttggtaggtgtaatatataattagtgaccaataagtggattaaattaatggacagtacacacaatcaactacaattaacacgattttctgatttccccccaagaaacatcatgagttattgagtttactaaatggcatccaccacaaaaataataggaacacataccttcctggtgttcttatcaacttctgaggaaaggcgcagccaagcagaataaacaatggattcatatacagtaagatttggtgaatgtatatcagtttgttcacaatagccactgatgcgagcaaaggtttcttgttttttagggtaaccagaaagcttgatatctccctcaatcgttccactagtctttcttcctgccagtacatccattagagtggtttttccagctccactgacaccaactagtgctgttagaacacctggtcggaatgcaccactaatatcagatagtagttggaggcggctttctgtgaatccttgtgctttcatttcctacaaggtagaatttaaattttcaagttcatacttgaaatgcaccccttgattcaagattaaatcactactaacttagttcaataaatggttaatgaatgacaactagtaatttatcagctagataaaatacacatatttaatccttaacaaagttaaatatctaagtgcaacaggggacacaagagaaccccgtgccatcacaatcactatgtacagtatgataccaatccaatgatataataaggaaaacagtcagacaatctagattatatgataaaggacattgttaatttcaacaaggtatagctactacatatttctgtagaccaatagaactaagtaaagcaagtagaattacaaactttctatgttgaattgcaaaaagaaatcactgcaagaactagtagtaatctataagaagaataaagtgaaattaattccaatattgaggtatgttttgtcccgtaagctttgcaaacttcctatgttgaattgcaaaaagaaatcactgcaagaactagtagtaatctataagaagaataaagtgaaattaattacgatattgaggtatgttttgtcccgt

SEQ ID NO: 93013 - DNA, 885 bp, Oryza sativa
gatggcaattggcaagcgctaagacaaatccgttgattttttttaatccgatggacaggcggcaagatgattaattagcatgtttgtttgtgtcttcgatgatatctttccctattcaatttttgttgttgcagggtaccccgcgctcgccgtttcatccggtgagcatttcgtcgagcagttggtacgcggggggagttccgggtttcttgattcatggggaggagctttgccgttgatttcctgcgctgaagcagttcatcgtccagtttcttgggcaatcgtttctagggaagcaaatgagatgtctctgctgctagacgcgagctctgttcctcgtttttaccattctcagaacttgacgattgagcatggcagattagggtcgtagagaaaacggtgttcgtgtcagcttcttgaggtcagagagccaagaagccatttgggtttttcttggttcatggaggaaatgggctctgctcagctttctgccctagctgtgtgtgtctgcattttcggatgcctagccatggctgatggccagaacgtcactggaggtgatggttcaaggccagctgagctgcgcatcggtgcattattcacatttgattcggttatcggtagagcagtgatgccggctattgagcttgctgttgcagatgtcaatgccgatccaggtgttcttcttgggacaaagttgagcgttataacgcaggataccaattgcagtggctttcttggaaccatggaaggttagggcttccttcttttccatcaatttttcttttatggaattgtcctaaccaatttagttgtaatttacacattattctctcgctttcagtgtgcatttgcaattagcatatttcccttttatcctctgag

SEQ ID NO: 93014 - DNA, 547 bp, Oryza sativa
tgactcttctctcttttttttcacttcttcaagattcaaaagttatggtttattggtttataatttaatttggttagagtttggtaccatttcaggtttagtttttctaccatgtttttcgcgcacagtaagtgtaaacatgaaactagccaaaagttttttttgggatctcatagtccagattcatatccttctatcggttgttttacacaggagagaacacagttagtgcacttggtagatttgtgcggcttgtcgggctgtttgttgtgctcattataaactcaagctacacggcaagcttgacatcacttcttacagttcaggaactcacatcagggatacaggggctcgatagcttgatatcgagtccaagttcaattgggtatcaagttggatcttttgcgagaagctaccttgtacaggagctcaatattgccgagacccgatgggtaccactaaacagcccgtcagattatgcaagagcgctagagttaggatcaggaaatggtggtgttgatgcaataattgatgaacttccatacgt

SEQ ID NO: 93015 - DNA, 716 bp, Oryza sativa
tactatatggccaattcgagctcggtacccatcgccaataaatcgcggctttttaccaacttgatggtaagaaatcccgggacctagaaattcatttcgtacaattgaaccttttcaaactgtttctttttgagaaccaaaaaaacttgtgccaaaataacggatgcgaagaagaacaaaaggccttgaacgcgtaatggatcctgaagcactatttctgcatccccctgaccaaaccctcccacatttagggaatttaacctttttgggttttttaaaaaatttgggggggtttttttggggaaaattttcccaaaaaaaagcttgatcgattccccctctgaaacaagaagttctggaccgggaggtataagatcaatcacttggcgtccatccgatgcatcgactatggatatttcatatccccccttttctttacgcagtatttttcttactacacctgttgacgttgcattatagaccgtattgttactcttgctaccatcaggatagatctgtccccttcctcggtttccccccacatatatgggatattttaagaaatgaacgtctttcttcatagcagggtcgggggaaagaatgggaaagacgatttcactatatttcttaccgggaacagggcctatcacaagaatattttttttattgggacgataactctgaaaagagagatttcctatcttttctttcaactc

SEQ ID NO: 93016 - DNA, 523 bp, Oryza sativa
tcggtacccatcctggacttgaaccagagacctcgcccgtgaagtaaatcatcgcccctaccatccaaccaatttttatataatcaatagactccttttcgggagcgattcatccttcccgaacgcagcatacaactctccgttgtactgcgctcttcaagtgtgcttcttccccttctcccccttaccatggcaagtccttgggaaataactccgatgggcagaaaaaggaaggcgttaagagaccctcctggcccaaccctagacactctaaaatcctttttcaaacctgctctgctcccatttcgagtcaagagatagataaatagccacatcccattgcactgatcgagggcgctcgtagtgacttaaggagtccaaaaccaagaagtggcttatttataccaagcattcctcttatggctagatccaacctcctggtccctgcggaaaagaaaaagaatttcacgttcttcctttcaagaagggaggattaaggaagtcctattgattgctgctttct

SEQ ID NO: 93017 - DNA, 1089 bp, Oryza sativa
ctcacgttgtcagaaaccttctcaataaggtcattgtagctgggattcttcaaaccatctccaaataaaataaaatcgaatgaaacggggtagggcaacaagcctactgcagctttgaaaacatcaactgaaaacccctttactccatcaggtcctttatctggcatcacaaactctttgtagctcgtgcggagaggaaccccaatcctcaacggcttcccgtgatatggaaacacccagccacgaggtttctcagacgtctgaccaggccagataacaccatgaagctctatattgtttgttgaagagtccagtggttctgaatgcaacttttctggagcaacaactgaaagatcagaaatgtttgaccaatacccaatggttctgaaacctgtaccaccaatattcaagatatcaaaagctgggtggatcagatctcgttctgcagtaaattgtaccaggccagaaacccctgtgaaatttgtgtgccaaactttctccagtaatctttctccattgttcaaacttctgagggaatctaactgaaggttacttccttttatatcttgcaaatttggatcagcagaaaaagataccgcattcccctcactcaaaaaatcttcaacagcacgagcaactaaccatacagaatcataagtacgcatactgtaagaactaaagcttgaatgacctccattcctggtcagattgttccatcttgaaaccaacgaatgctgaatgcagaatcagaaacatgttgccgaagcataataaccccctgagtaagttccattctgtcagtgctaatatgatcagatgaatctaacactgcaaagagccagtctgttgctatccatgcatagccaggactcatcattcccaaagattttgcagcagcaaaaactgcctggccagagtcagggtttacatggacaacatagacgcgagactgcatttcattcacatgcatcaacatatccccgagggtagtccctgaagcaccaggtggcaatttggctttgtaggctatcttaaacttttttttgctagagcatcacctaatgctgtgatgccacctctaccataggc

SEQ ID NO: 93018 - DNA, 8965 bp, Oryza sativa
gcgcgggaggtcggccggcatcaatggcgccggcgagatttgcggggcaaatacgcccgtttgaacgcgggagagagagggaaaaatggggggaaagagagaggggatcgcggggaatatttccccccactttattgcgcgcggggacggcgggaggcggcgggattcgcggtggcggcagcgctagggcgcgggcggcgcggcgggagcagcgggaggacagggatgacaggtgggccccacccgtcagcgagggtggcgggcgggcccgcccgtaagcggcacgcgcgcggggaggaggccgattgggccgcgggggaaaggagagagagggagggaggtgggccgagccggcccaagagggggaagggggaaaaagactttttagggtttttctttttataaaattattttaactttgtttatttcttaataattattatttgtgctctgaaaattccactaaaatttgagggctcctttttgaccaaggagaatttaacaaaaattctccgggccacatttgaatttttcttgtacgtattttaatgtttgccaatttcttttcgaattttaattaattctattattccttttagaaagtgatttttatttcgggatgaatttatcaggacgtgacagcctaccaccatgattgtccgccagcatcgccctttcaacccaagcagcttccacagggcgctagtgtcagccagaaccattagggaggtcagcccaaccgcagtgcagctccgcgcccaccaatggcaccagcacagccagctccatcagcccaagccaagaaggagactggagcaaaaccagggtcctcctacaactgtggcgagctcggccactttgctgacaagtgcccgaagccaaggcgtgccgggccaaggtttgcccaagctcgtgtcaaccacgcgtccgcagaagaggcgcaagcaacaccagaggtcgtactgggtacgtttcctgttaactcaatccctgcaacagtacttttcgattctagtgcaacgcattctttaatttccaagcggtttgttgggatgcatgggttaagaaatgaggagctttgtacaccaatgagggttcataccccgggaaatagttcaacctcggtcagttatagccgttccgtgctaatagaaatccaaagatcaccatttctagccaacctcatccttctcgaatccgaagacctggatatcattcttgggatggattggctgaccaagttcaagggtgtcattgattgtgcgaatcgcacagtcacctttaccaaggagaaaggggaaacagtggtgtacaagtcaccagtctcaccgaatcagggaatccccttgaatcagattgaggtggaaaatccggtggtcacctaggagaagagttcgaggaaattggaagatatccccatagtctgcgagtatccagaggtgttccccgaggacctcactaccatgccacccaagagagagatcgaattccggattgatttggcaccggggactgctccaatttacaagagaccgtacagaatggcagacaacgagctagcagaggtcaagaagtaggttgatgagtagctgcagaaagggtacattcgaccgagtacttcaccttggggtgctccggccatttttgtggagaagaaggacaacacgaagagaatgtgtgtcgattatcgcgcactcaatgaggtcacaatcaagaacaaatatcctttgccatggattgatgatctgtttgatcagttgaaaggagccaaggtgttttctaagacatacctacgatcaggctatcaccaattgagaattcgggaagaggatattcccaagacagccttcaccactcggtatgggttgtatgagtgcacggttatgtcttttggactcaccaatgcacctgcattcttcatgaacctgatgaacaaagtgttcatggaatttctggttaagtttgtgtggtattcattgatgacattcttatctattccaagtcggaagaagagcatgagcaacatcttcgtctggtactcgagaagttgcaggagcatcagctttatgccaagttcagcaaatgcgacttttgggtatcagaggtcaaattcttgggtcacgtcattacagctcagggtgtggcagttgatccatcgaatgtggagtcagttaccaagtggaccccacctaagacagtgtcacagattcggagtttccttggattcgcgggctattaccgtcggttcattgaaaatttctccaggattgccagacctatgacttagttgcttaagaaagacgagaaattcaagtggacagccaagtgtgacaagagttttaaggagctcaagaagaaattagtgtctgctccagttctgattttgcccgatcagacgaaagacttccaagtatattgtgacgcgacccgtcacgggcttggatgtgttctaatgcaagagggcagagtggtcgcttgtgcctcacgacagttgcgtccacatgaaggaaactatccaacacatgacctggaagtggcagcggtggttcacgctttgaaaatctggaggcactatctgattggcaaccgctgcgaagtctatacggatcataagagtttgaaatatatcttcacctagcctgatctgaatctccgacaacgaagatggttggagttaatcaaggattatggcatgagcattcactaccatccaggcaaagccaatgtggtggcagatgcattaagcaggaagagctactacaatgctttgtgcaccggcggcatgtgtaaagaattgcagcaggagcttgaacatctcaacttggggattgtagaacacgggtacgtggctgccctagaggcacggcctacgctcgtggatcaagtccgagcagctctggtaaatgatcctgaaatagcaaagctgaaaaacaatatgagggtcggaaaagcccgagatttacttgaagatgagcacggcacaatctggttgggagaaagattgtgcgtacctgatgacaaagagctgaaagatctgatactcactgaggcttattagactcaatactccaccatcttcaggccttccaagaacttctcctgcctttccttgttagtaagcacatcttctgaagcatagcaagctagactgttgaactcatgtagatactctgtcaacagccacaaggtcaagtcaacaatatcgttctcacaggagcaaatgcagtgccggttgcatcttcaaggaagctcagcaaccagtttcaaagcagtagtggttttctttaatgccttagaacatttaccagagttatggaataaaaagatagactgtagtttacctatgcccttttctttctagccgttccgaatctcgggacgagattctttgtaaggggggtcgatttgtcacaccctgattttcgtttcaggatttataaattatttaataaattaccattagaatttatattaaatgttcattaatttacaagtgaagttagatgtgggaaatcaaatttcctaaatataaagcatggctggatttaattttattaaattctccatggttaattatactcaattttcggagctcaattcttaattttaataatacaaagaatatttcagtaattattcacatattaaattaatcattaaatgagctggtttcaattttgtaaatacttagagtgtccaagtatgttcaagaattttcttggaattatttgagcattggaagtatttttaacaattgaaatatcatctcattggttaatttatttggaaaagtaataataatcctcttcctagtcttgggcccttttcagcccattccctccttcttcagcccagccgatccagcagctcctctttctgtctctgtcaagtctgctttgtgtccctcctttaagcagtccttggaagaagaaccccagccagaagtctgctttgtgtccctattgctacagtaccatcttcaacctccaggcagagccgagccagccgtcccgtgcacagttgccgtcgatttcccctctaaatccggtctcctttctcgtgttatttcaaaattagtggaggggaaatattcctcttatcctcctctatctctttccccaaaaatccggttttatccctttgaattcgacgcaaatttggattcattttcgagtttatctctccaccaaaccctaggttttcccggcgcgattccttgcgttccaagcccgatctctctcttccatggctataaatagagtcccctccctctcctcttttggccgccacctctccgtctctccgccgtagcttgtagcgccgtcgccgcgttcgtcttctctgtccaccaccggcagccgctccagccgcctgtagcagccgcctcggccatcgacgacctgcgccgccgcctctctcggctccgcaaggtcaagctccaccccgtccaccccttcccccaagccaaaatccaccggagctttatcgtcgccgtcaacccgaagttcgctgtcgcgttttgatctccggcgaggcccttttgcacctcccgtggtcgccgaacctcgccgtttcctccggtggcatcacagcgccaagccgaaggccgtccaccccttcttctccgccggtgttcgccgtaaagccaccgtcacagtcgtcccgatctcgccgccgctcgaagctcgtcgccggctgccgttcatcgtcgctcgtcgtcgtgtaagtgtgggtaaggactgtcttgttctcctcttcgctttagtgctctcgctttccattgttgtgccatcgtttgtcgtcaccggctgtctcccgttgctgtttctcgtcgtcgccgccattggtgagttcgtcgtcgcctccactctctcccggagctgtcccttgtcgccggagcatcgtcgttcagttctcgttgctatcctgagccatccgccggtgaagatgttatcgctgacatcaataccatctcaagccattgcaaaatcaatataaattatgtaatctctttttattatatattattcttttttaatatatgtcatctaccaaatatgatctaatctattttcgaatgatggtttaatcttttatgtcagtgataaatcatttgtaaattgtttaattaatttggaatagtcttttctttaatatgtttaattggaattaaatattgtaaaattcgtaactaattcatatgaagtcagaatgaggccgttcaagtctctaaattcatctaaaaacatggtctacatgtttgtttacttttatgtactgtttatttggtttttatcagtctttttctccgttttgcgtgttagcctgtcgtttccgtcgttgcgaaggtctgtgtgtgcgtcggaagtgttcaagaaggctaattgaagaccaattattgcaaggcaagtcacacagctaaacaaccctttgagcatgttgaacctatttattagctattgttttatttcaacttatgcattcgaatgtcatcgggtggtgtgcctttcccaattaattatggccgaagatgactttatttttctatgggtaataaattgattagcttggaccttatatattggattggttcagctaaatgctatatatataattgcttagccatgcctagaaacattagttcattaatgggatgaatcgtactatattattatttatggttatatttaatggtagctcacgatggttaatcgtgttatgataattaattgataattaaaacttgataatggtgggttgtgagcacatggttttgaaggtcgtgctcatgacaattaaggaccgttcgcgagctactgttgtgagacattaaccgtaccaaccacaagccagcgtaggcaacggttttaccttttgtatagcatggttcattgcggggcaccagactgagaagcggtgagaagcccgtggtggtcgctggggagtccatgcctctggttattgagggggtgattatgatccaggaacggtgcgctgtggtggattgtgttgtatgaggggtactgtcacagtcccgtttcgaggtaccgtggtggtactgagagcatggtgacttgttttggggctatgtcttgtgggtacagtggtacacctctggccagagtaaaactattcgaatagccgtgcccgcggttatgggcgggttgagcaatgtttttcgtgattagtctcacacctctcacaataattattgatgctataattggtaataatttgcttagctcctggaatggagttagatctgtacagccgggtatggttgttctggatggttaggcctgtgtagcatgggtgtgctgtttagtgttgattaaaattgatgattaattactctgatgtttaactattcttaaatatttgctaaatgctgcttttgcaaatgagcttatattatgccatcctttggtatccttgtgcacttacatatttgctgtatgacttgcggagtatgtcatatgctcatcttgcaataatcaatcaaacctcaggtgaaaaaaaatgatccagaaggagaagacatttggcttataccccagttgagttgcctgtgggagtggagctgaaagccatcgctagaccattaattccgctgctgttttcttttcttttgtaagtatgtaacgttattattatgatggatttgtatattaaattatcagtttgtgtacctcggctgattcctagacgagggttttatacacaaataagttcggaaattattagtgaattttcgggcgtgacaatgccttaagcaggaaaagctactgcaacgcttcttgcactggcggcatgtgtaaagaaatgcagcaggagcttgaacatctcaacttggggattatagaacacgagtacgtggctgccccagaggcacggtctacgctcgtggatcaagtccgagcagctcaggtaaatgatcctgaaatagcagagctgaaaaagaatatgagggttggaaaagcccgagatttccttgaagatgagtacggcacaatctggttaggagaaagattatgcgtacctgatgacaaagagctgagagaactgatactcaccgaggctcatcagactcagtactccattcatccaggcaataccaagatgtaccaagatctcaaagaaaaattttggtgggccattatgagaagggaaatagctaaattcgtcgcactcttcaatgactgtcagcgagttaaagcagaacaccagagacccgcaggattactacaacctctttagatcccggaatggaaatgggaagagattggaatggatttcataacaggtctgcccaggacatcatccggccacgattcaatctgggtagtcgtggatcgacataccaaagttgcttatttcattccagtgcatactacttatacaggcaaaaggttggtagagctctatctctcaagaatcatttgtttgcatggagtacccaaaaagataatatctgatcgagggagtcagttcacctaaaaattttggcagaagttgcaagaagaattggggacccatttgaatttcagcacagcttaccatccgcagacagatggccagaccgagagggtcaatcaaatattggaggatatgttgcgagcctatgcgctcgattttggtggagcttgggataaaagtctgccttatgctgaattctcttacaacaacagctatcagaccaatctacaaatggcaccgttcgaagtattgtatggccggaagtgccgcacacctctcttctgggatcaaataggcgaacgtcaactgttcggaacagaagtgctaacagaagcagaggagaaagtcagaaccatcagagagaggttgagaattgcacaatctcgacagaagagctacgcagacaaccaccgaagggagctcacttttgaagcaggggattatgtgtaccttcgtgtcactccgctccggggagtgcactgtttccagacgaaaggcaagttggcaccatgtttcgtgggaccatacaagatcttggaacgaagaggagaagttgcatataagctagaacttccatccaacatggccggcatccatgatgtgttccatgtgtctcagttaaataagtgcttgagggtaccggaagaacaagctgattcagagcacatcgatcttcaagaagatctgacttatgtggagaagccaattcgcatccttgagaccagtgaaaggaggactagaaacaaggtcaccaggttctgcagggttcagtggagccaccactcagaggaagaagcaacctgggaaagggaagatgagttgaaggccgcccatctgcacctcttcactagctcttccgaatctcgggatcgagattctgtttaaggggggtaggtttgtcacaccctgaagttcttctcccaagcctaaatttaatttataaataaccttcagaaaatatcggtgtaaaagcaaaagagaaaccctaaaggaactaatgcaaataataatcggaaatggcatgtgggatttttcttgagttctacatgtcgaaatatgctaacaagatttttagtggaattttcagagctctagaaataattttaaccaattgaaaatgagcataagcattatttaatccctggaaatttatttctttccttttctttttctttttccctcccttttctttttgaatgggccgccgacccattctctttccctccccctccccgctgggtcagccgaaggccaaggcccagcagccggccggcttctccctcctaccctcggatcgccgacaggtggggcccacctatcgggcccgtatcccacctatggatgacgccaccacgccgtaaccgtcgcttgcgtctataccgtacgtgcgcgcccacgttgtccgacttgtccacctattccacacaccccggaaccaccggcccacttcctcgctagcgcccgcgttccgagatggccgggttttgaa

SEQ ID NO: 93019 - DNA, 535 bp, Oryza sativa
atattagagttctcacaatttaatttactatctttcatatgctacttatatatgactattcgaatttttaaaaggtttaaatcatgcatgtggcatttacatatgttaattagagttgttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctgttttataaacacatatgtaagcgaaaatcatatgcagtgctataatctttagtcccggttcttaaccctaaccgggtttaaaaagaatttcgaaatagcgggaaaagatatttactcccggttg

SEQ ID NO: 93020 - DNA, 815 bp, Oryza sativa
actttgaaaaagattcctatagtccgggagtatcccgatgtgttcccagatgatttacctggtatgccgcctaaaagtgatatagagttcagaatagatttggtcccaggaacaaccccgatccataagagaccttatcgaatggcagccaatgagttggcagaagtcaagaggcaagtagacgatttgcttcagaaaggatacatcagaccgagttcatctccgtggggagctccggttatttttgtgaaaaagaaagatcatacccagaggatgtgtgtggactatcgtgccttaaatgatgtgactatcaagaataagtatccgctacccagaattgatgatttgtttgatcagcttaaaggtgccaccgttttctccaagatagatcttcgatcagggtatcaccagttgagaatcaaagaggaggatatacctaagacagcttttaccactaggtatggattgttcgaatgtactgttatgtcttttggacttaccaatgcccccgctttcttcatgaacttgatgaataaggtgtttatggaatacctagacaagttcgtggtggtctttattgatgacattcttatctactcccgaaccaaagaagagcatgaagaacatcttcgccttgcactagagaagctacgagaacatcaactgtatgctaagtttagcaagtgtgaattttggttgtcggaagtgaagttccttggtcacgtcatctcagcaggaggagttgccgtcgatcctagtaatgtggaatccgtaaccaattggaagcaaccaaagacagtttcggagattcgcag

SEQ ID NO: 93021 - DNA, 2145 bp, Oryza sativa
tgttgtatgttaagctgtgatcttcctgtatatgcagtgtactagcatgtaatcagtactgatatatgtcatggaggctatctgaaccagcatgtttctcaatttggatggtcatgttttgtgcaataaagtgtgtgtgcagttagtataaatcaatcacaaaggctatttggaatagcacaaggcaacatatgcttcaatgaacattttcaaccagggaatgtttttcaacttaattaaatcacttagccataactttggcattaccaccaaaataagcatcactagccaatagccacaagtttggttttacaaccaaaagaaactggtcatcagagtcacaaatctgacattacaaccaaaatatctatatatgttatcaggccacagtcagcctcctaacttgaagttttttccttggggggccttgagttgctgttgttactggaatagcatggccaaacttaggagaatgctacaagaagagatgtgttagcaatcaagaaagcataggaggctattctaatagtaattacatggtaaaaacttacaatcttatgtgcaacagcagcttgaacttgaactaagtggtctgtggtaaatgcccttttcttcacttttgaggagctcttcttgtcaataggcctagattgtgcacttgacgaagcctgagtagtgcctgtatttctctttgcacaagttgtcttgttgtgtccaattcccttgcatcttctacacataatgatagtgcccacttttgacaccctggttgctttgggtttttcatgtggctcccttctcctctccttctttggtctacctggcattttaacataggaaggtgcagcaggcttgggtctcttagatactggccagctatgaatgccttccacaggctcaaggcaatgttcatatgttgacatgaatgctttcactgagtagcaggaggcaatatattcatcaaggctattggttttgtagtggatgcaagcaatagcatgacagcaagggagccctgctaactgccaatatctacaagagcaagttatgctttgaagattgactgtgaacctttattcatgatgtttcacttcaaatttgtcatttccatttgaaattgcatggcaaaatccagattctgtaacataagcattgagtttcttaagtatgtttggacaaattggtcctatccacttctccattttggtcctatgctcatgtatcctaaccatgacttttcttctgatagcttcaagcatactgattataggcagaaacctagcctcaacaatccatttgttgaaggattcacacatattgttgtcaaccgagtcacaatttgatcctaacttgaaccatgcccggctccagtgacgaggatcggttttcatgatagcctcggctccttcccttgtgcactgtgctagctttgcttttgctaacataaatagaggcctacatggagctttggcacacctccaaaaatttttttgccattccctattcttgaacttcttcctccaattggcataaatgtgcctagaataatttctatgctcagctttaggtatctaggtctcaacaacattaataattcccttttgttgatctgatatgaccacccaaccatcaccatcaccagcaacaagatctttgaatagcaaagcacaaaaccagtcccatgagtcattggtctctttctccactactgcccaagcaattgggtacatctggttatttgcatccctccctaatgcaaccatctagtccaacaactcttctacaattggttgatcccttgaaaaagcaaccatctagtccaacaactcttctacaaccagcaaggaatcctttcttacaagcattaagacatacatagattctttggaacacaggagttggactatcactatcaagagtgactactactgtactgcctgggttacttcttagtagctcaagttggtagttaaatatccttgaatactcacaccttgttgcatcataaagtttcttcagaacatgtgcctttgctctcttacactgaggaacgctgacatttgcaaacatttcttcagaaacagtagaaatcatattcttgatactccatgttgggttatctctaatcatctgctcatacttctc

SEQ ID NO: 93022 - DNA, 2311 bp, Oryza sativa
  unsure (1)..(2311): unsure at all n locations
cccccccccccaaaaaaaaaaaatcattctatgcttttgcacactatgaacgatcccttgacacttgcatcggcgtaattatactatttcttgcagaaataaaaggataaccgtaaggtctgtagtttacacaaacgagtggttattttttgacaggtcacacggtccattggcgatgatgatcttaagccagcagtcacagcacaacctgaggttatagaaaccattttatcacctgatgatgagttcctggtatgtccattttgtttctctcatctgtgcggtttctttcattctcatacatcaatttgttatatcttagaataccaaagctaacaccagtgtggcataaaaattattatgtcattattgttcgatcgctgttaatctgttcagttgaatgattggcatcagcttcggaagtttggctgtgaatgcttgtcttatttcagccaagcaatacctttatttctcccttgtagaacactgagcaattactgccaccaaaatatagtagtaaatccaagcctatgtatgaaaattcttaagttctgagaaatagaccaatggcccttttctttattttgctttcatatcttataatgatatcagagatccagtattatttacttctccaaaatttctattatctgcattgaatgggcaaattactttttctaattatttgttagggaagtaactaaactacgtttctttgagaaacccctcaacatgcctggctctgcttggctgcaatgaaactctttcaacgttattgggcattatgcttctaatatgtatatttgtgttgttcctaatttaatgtaaacaccaccattcaaaaaagagaggtcattgcaaagtttcgacttcatacataatactctagagatgaacctcaaaacagggtatctagttttggtgcttctgcgaacacccaagagatgcactgaaacatggcatcaaagataagaaacctcattatagattcacaccacttcatttggttacctgtaggtgatggcaagtgatggattgtgggacgtgatgagcaacgaggatgtcctgtccatcatcaaggacacagtaaaagagcctggatgtgctccaagcggctgnccacgaagcccgcagcgcgtgcagcaaaggacaacatcactgtcatcgttgtgttccttcgccccgtctccactgctgagcgaatatactaaccacaaagccttgttggtaacttcatcatttgtcagaatttttagatactattatcaccactgtaaaggaaagaagccaccgattcgttcttgtacacaaattggatttgctgattaccctgtctagggcagaaagatgattaatctttctgataggagatatagcattctttcattggtcaatgtttatgcaactctgattcatctcatttgtgcaccttccaggccaaaagaacaaaacatatttattcaatacttatctcaataaaattttgtggaattgtcgatggtccaactttaaatgtttcccccatatttattcaatacttatctcaataaaattttgtgaaattgtcgatggtccaagtttaaatgtttccagttcctcgtatcaacacctgctagaaatcgttgaatgattcatacaggtaccgaaattttgttcgtcaaatacggataatccggaggcaacctgtcgttgccaagccgtgaggcacgtgaaaaataattattggtcccaagtgcacttatcttaataaatacagtaactgtcacgagatatctcatgcattcatgcaaggtcaaataacccgacttaaaatattttttttctatcattgtcttcacattaatgttgtgtacaaaccacaatcgtggattaagtctacgcaacaatgatgctgtacacttaaggaacctggtacctatattcaaatataaaaacttgatcacattacagcgaagctgacctgttacctgtacaacaaacgatcactccatctcaaaaaaatagaaaaagatcacttgcctagttgtgccgctgtgtacgaataggagaaatcatgaatcagctatctttcttacagaaacttgaactaaatcggataaccacggcacttgttatatcttcagaaatttctgataacctcaatctggtgccaaacagagatatcaacatcaggtcaactttctcctctgaattcaagcttcctggttgtaatttcgtccaattaaggcaatgtagctgacatttggatgaagaaagcaactgaattgatcaaggaccagttgcaatttaatattatcaactgctctgtact

SEQ ID NO: 93023 - DNA, 3740 bp, Oryza sativa
cgctcatcaagaacatagagagtgacaaatagaagggcatgtactccacgctcttcgtcctgatcaccagattctgttgaagacaaaaaatgcataaaagaaaaggatcaatacactgttgctaagaatatttcaagaacatgaaaagattagtcaaggctaactgtatcaaaatgcacaatgtttacttgaaactacaatttattgtggattataaaaactaagaagtgcaattcattagaactcacaatgatggacaagggggacgcaaacatgaatatgagggacgcaacgctgaggtaaccgacgaacaattgccgtgtttggtgatcaaacaacgccagactaacatacacaattagagcgaacacgccgaacaccataaccagcaggctggacaccttcacctgcagcaacacaccatttcgttagagaacttttatggtacaatatactactagtataatactgtcagtataaatgatataattgtgtagattgatttgatcttatactcaattcaatttcaattgcagtataaaatttgaaagggtaaatttgtctcctttttttttcgttattctatcgtcaaacagtgttgccgctaagtgtgtcatcatcaaatggcgctcaggacagtcctccactaataaacgaggagatctaggaccgggtacttacaattagattaaatccgaaccacaaattactaaaacatctttttcaattttctatcaaattcctaacatatgcacttctttacactgccagtatatactgataatataattgtaatggaaaaaaaagaagaagtcaatggtcagaagagcatatgctgggaatctgatgaaggtggcaggtaaggtaaggtaagttaagttaccctgttcttggcgtcggcgaatgcgatgaaggtggcggtgtaggcgagctggaagagggcgccgatggagttgacggtggcgacgaggacgacgccgtaggagacgaaggggaggccgtaccagagacagatgaggcagttgagtagcgagtaaatgtacggcatcgccgagaactgctccgtcgatccgttccggacgatcctcttgaacgtcggcctgaaatcaaatccaacaacagccattctcagttgtcggcattattgcagcgatccgaccaatccggaccaagaaatcagaagatcacaagtggggggaaatcagagaggggccgggggcttacagcggggagatgaagagcacaagagcgaagatgttccctgcagtaatgggtgacagacagcaaacatgaatcaaataggcacaatcaactgccaagaacatctgaaacctctccccaatccaaccaagattaccaagaagcaagaaaggaaagagcatcgaagcaccccaaaaatgggaagagagagatagagagaatgggaagaagacgaagaagaagcaatggtagtacctgcaatcccagcgccatagcaccagacgtcgtggaagggggagccggtgctggtggccgccaccgataaaccgagagcgttcatcatcaaggaagctagaaacaagaaagccggcggcggcggcggctcggcggtgggaggctttggcccttgggggagggaggaatccgtaatccggggtttctttctctctctagctgtatctttggttgctggtttgggcggctggctatggctgccgtcgtacgtgtcccgtccgcaagatataaccatgcggcggttcggtggatatgtcgccgtgaacagtggcggagccaggattagaaagttgggtattcccgtctaacaaaaaaattcataagaaaaaaaatcaatggttcacagtatgtcaataccgaatatctaagaaataaaattacaaattattacatggtatctctaattttctatttcggttccttcgtggcttggaagagtagctttaattctgcgttccttcatggcttgaaagcggtttataatatcacactccttgactttcaaaaacatctcacgctcaataaatgtgaccaagcaatcattcaagtattgatcccccatcctgtttctcaatttattcttcacataattcatggcagaaaatattctttcaacactagctgttgctactggaagtaccagaaccaatttgagaagcttggaaataatctcatgtctattgtgcaattttgtttcaacaatcataatggaaagattagcaagattttttacttttctaaacctttcatctatacgcatctcagtgaggaagagcttcaatgctgatggaagatggttcatctctgtgcttgagaaatcattaggataaaaccgtgcaagcttaatcaacttatctttgtcccaactagcaaagttatctataggactaaatgcagccatacaaaggagcaaatctgtgtttacctcatcaaaccgttcattaagctcttgtagttgtctatcaatgacacttagaaacatgtcaacatggaagcgatgcatattcttgattttaataaagaacctcctatctcttccaaccggccgatagaaagagtccatatcagggatcttgatcttatgcttcacacaaaaagattgcacttcttgaagaaaatcatcccatccaggatcctcgcgtaattgctgcaattgaaactttgtcaataaaatcagtcctactgcattaacaatgtcttgatccctcttctgcaaagcatgattcaagtcagatgtgaacccaagtactgtttgcatcaagtgtgccataaaaacaaactcaaatgattggaatattgtcaacactgtttgtgcatttgcacattctgcaccaaaagagcgatccttgccaaccattataagaactttttgaattgaaggatacaaagataggacatgcataacagttttatagtgagatccccaacgagtatctgctggcctgcccaaacccatttcttgattcaaaccctttccagtttcaatgtcacccaaatctagttcttctacaattctttgagcttgtgcaactctaagcatttctgtcttcttacaagaattcccaagaagatttaacaaaaatctaagttgctcaaagaaccacacacaatctgggttttctttagcaacagccacaagtgttaattggagttgatgtgcaaagcaatggacataataggcagaagggcactcatccataatcaatttctttagtccattagcatgacccttcatgttactagcaccgtcatagccttgcccacggaccttagacaagctcaaggaatgctccataagcaatgattcaattgcagctttaagtgtcaaggaagtagtattttcaacatgaacaacaccaaggaacctctcaactacccttccttttttatcaacatatctcaaacaaagagccaactgttctttttggtacacatcactagattcatcggcaagtattgcaaaatattcatcaccaaggtcttccatgataagcttagtagtttctttggcacaacaattagctatctgtttttgtatttcgggagcagtcaacttacaattctttggagcattattcaaaaccaccttaccaacttcttcaaagttttctgctagcatactcaacatctcaagaaatttcctttattaagtgacttttcactttcataatgtccacgggcagccaaaccttgcattaaaagaaacttcaagcacttcattgaataggttaaacgagccatatatc

SEQ ID NO: 93024 - DNA, 1233 bp, Oryza sativa
tttggaatcctttttttcatgtgccaattcctaaatcccctatttacaaatgcatctccaccagaattattaattttatgcttggataagtaccaaataaaccagaatgcagcatcttgttccacactatattcaagccatttaaattcgtcataccaactaggaaggaagcgccgaggcttacctccaattttccttataggaaaattgtggctgcgtggttggcatggccctaatgcaatatatccccttatcacagaattccgttcattgacatcataatttttgattgcaattcgccttccaggatcatgacaaagtaaatcaatgtcataaatagcttcatcacttgagtcatactctgtctcttcatcatcaccatctctgatgggagaccaatctctgataggagaccaagtggaaggttgctcctgctgtgtcactgctgttgctatgtctggatcattgctagctacctctgtttcaggttctgtcacatctcttgctgcatcactggctgctacctcaggcacaacctcaactgcagtaatctgaatctgaactggactctcatttgcatctgtaatcggctgaacagaaggaacagcaacttcactgtcaattctaactggctgtgttgttgatccagaaccagaacctaaccctaccttcctagactttgaatgtctatcccacaaagtcttcaaatcaatcgatttcttcttcattttgagagttcttcaatctacagaactacaaaagtacaggaaaaagaaactactcagagactaaggtaaaaaaacatcagacatggacacatagtgagtggatttaggactgattgaatcttgaactcttgatttgtcacctgaaattgcgcctgccgcagtgccgctgggcgctgtcccgctgagctgcagctgttggccggccgtcgccgcgcccctgcccctcggcctcgtggcctcgctcccgccgtcaccggtcgcccgtcggttgccgtctcgcggcctcgccgcgccgccgccgaatgcctcgccacggcgtcgcgccgctgccgaatgcctcgccgcgccaccgctggtctagctccctgctcccgtcgccggtcgccggacgccttgccgttccgttggtcgccgcgccgccgtgccgccgccgaacgccgccacctagggtttggaatcaaatggggaattgggaagcgggagagcagcgcatttgcgcgtgagg

SEQ ID NO: 93025 - DNA, 967 bp, Oryza sativa
  unsure (1)..(967): unsure at all n locations
tgttgggcgtctaagacttcaccgccggcctgcctccgtcgccgccgactggtgcctccgcctacacggctggcctattatgccgctgctgttgggcgtctacgtcttcaccgccggcctgcctccgtcgccgccgactggtgcctccgcctacacggctggcctattatgccgctgctgttgggcgtctacgacttcaccgccggcttgcctccgtcgccgccgagtggtgcctcggcctacacggctggcctattatgccgctgctgttgggcgtctacgacttcaccgccggcttgcctccgtcgccgccgagtggtgcctccgcctacacggctggcctattatgccgctgctgttgggcgtctacgtcttcaccgccggcctgcctccgtcgccgccgattggtgcctccgtctacacggctggcctatatggttggttggtcacaccaccgtttttgggcgtctacgtcttcaccaccggcctgcctccgtcgccgccgactggtgcctccgcctacacggctggcctattatgccgctgctgttgggcgtctacgacttcgccgccgactggtgcctccgcctatatggttggttggtcacaccaccgttgttgggcgtctacgtcttcaccaccggcctgcctccgtcgccgccgactggtgcctccgcctacacggctggcctattattccgctgctgttgggcgtctacgtcttcaccgccggcctgcctccgtcgccgccgagtggatcctccgcctacacggctggcctacgacttcaccgccggcctgcctccgtnccgccgagtggtgcctccgcctacacggctggcctattatgccgctgctgttgggcgtctacgtcttcaccgccggcctgcctccgtcgccgccgagtggatcctccgcctacacggctggcctattatgccgccgctgttgggcgtctacgacttca

SEQ ID NO: 93026 - DNA, 4098 bp, Oryza sativa
taattaacatatgtaaatatgacaggcatgatttaaaacttttaaaaattctaataatcatatatacctagcatatgcatgatttaaatttgttaataatcatatataactatcatattcaatacatacaaaatagtttacatcgtgtacacaacaattacggcaatacatcggcggtgacggttgtccgcacgtactttctcctcactactgttccttccttgtgatcgctacgtgagtaaggggtgtcttcatttgataggaggatgctagggtcaatcgtcaccgtgaaagtgggttgcccatcaaactgatcgtaatcctcgtcagtcttgtcctctactccgacgatttttcttttgcctgggagaaccacgtggcgcttcggctcgttaggccctttgcccttctttcctttgctagacatgtccttcacgtaaaaaacttgcgttacatcattggcaaggataaaagattcgtccgagtatccaaccttgttaaggtcaaccgttgtcatcccactgtcatcaatcgttacgcctctaccagtcaacctaacccattggcaccggaatagagggaccttgagaggtccatagtcaagttcccatatctcctcgatggcaccgtaatacgtgccagttgtaccatcgtgtcccatggcatcgatacaaataacactgttctggttcgtgctcttcatgtcttgggctctcgtgtagaatgtgtacccattgatctcatatccctggaatgtcacaatcaagccagatggacccctcgccaggaaggccagttgctggttaatcgcctcgttacccatgagatgttgtcgcagccacgcgggaaaagtatcaatgtgatgccatgtaatccatgcatcggacttatcgatgtttgtggcgcggactagagccaagtgctcctcgatgtaagaagccaccaatgaagattgttgcagaaccgtgaaatgggctttaggaataaattgttgtccaccgtcattattgctttccttccgagagtcccctttccccgtagtctttccccgtagtctcccttcatggcgtgattcaggtacaccgattgggcgaaggtcttcaataaattctatgtagaattcaatgacctcctctgttccataccccttggcgatgcttgcctctgaacgagcacggttacaaacatacttcttcagaacgcccatgtacctctcgaaaggaaacatgttgtgtaggtacacaggcccgagaataccgatctcttagacaaggtgacaaagcagattcgtcattatattgaaaaatgaaggtggaaatatcaactcaaagctgacaagacattgcaccacattattctgaagggcttctaatctatccggatcgatgaccttctgcggaattgcgttcatgaaagaacatagctttgttattgttgcccggacattgtctgggaggataccccttattataactggtagcagttgtgtcatcaacacgtgacagtcatgagactttaggtttgtgaacttcttctccttcgtgcttattattcgctttatattcgtggagtatccagacggtaccttgatgctctccaagcattcaaacatactttccttctctgccttgctaagagtgtagctggctggactcaagtaatggttgcctttctcctttggttccgggtgaaggtcgccgcgttgttccatatgcctcagatcattacgtgcttccagtgtatctttcgactttccatatacacctaggaaaccaagaaggtttatgcaaagtttcttagtgaggtgcatcacgtcgattgcgtggcgaacgtccaagaattcccaatagggtaactcccaaaatatggagtttttttccacatcgccgcgtgaccatcttcgctctctataggctggctgccaggcccctttccaaacactactttaagatctttcaccatagcaaacaccgttttcccgctgcaatgtttaggcttcgtacggtggtctgccttatattcaaagtgcttgcctttcttccgtactaggtggtttgcagcaagaaatcgacgatgacccatggacacaaccttcctacagtgcttaagatacatactttctatttcatccatacagtgagtgcaagccttgtaacccttgttggactgcccggataggttgctaagtgcaggccaatcgttgatggttacgaacagcagcgctcataggttaaacttctcctgtttgtcctcgtcccacacggggacaccttcctttttccacaacagtttaagatctttgaccagtggtcttaggaacacatcgatgtcgttaccaggttgcttggggccttgaataataatcggcatcattatgtacttcctcttcatgcatagccaaggggggaggttgtagatacacatcgtaacgggccaagtgctatagccgctgctcatctctccaaaaggattcatgccatccgtacttaaaccaaaccgtatgtttcgtgcgtcctttccaaagtctttaaattttctgtcgatgtttcaccactgcgaaccatcggcggggtgtctcagcatcccgtcctgttgacgctcttcagcgtgccatcgcatcattctagcatttcccttgttcctgaacaaacaccttagtcgtggtattatagggaaataccacatcaccttagcaggaattctcttctttgttagctgcccgtcaacttctcctggatcgtctcgtctaatcttgtatcgtagtgctttgcaaatagggcatgcttctaggttctcgtactcctcaccgcgatataggatacaatcattcggacatgcgtgaatcttctgaacttctagtcatagagggcagactatcttcttagcctcgtacgttgtctcgggcaatttgtttccctccggaagaatgttcttgacgagtttcaataaatcgccaaatgccttgtcactaacaccattttttgccttctattgcaagaactccagaatggtatccaactttttgtgcccctgctcgcaacctgggtacaacgacgttctgtggtcctctaacatcttgtccaatttatgggcccccttttaactttcgcagtcctccttggcgtcctgcaacatctgaccatggtcacccgcaacgtcgttaccatcagcatccctttcctcctcgcccgtttaattttcttcaaatccagcgtactgagcaaagtccggaatattgtcgtcttccagttcatcttcttccatttcaaccccttgctctccatgggatgtccaacagttatagcttggcatgaaccccgactcaaacaagtggaaatgaatagtcatggatgcagaatactccttctgattcttacacttattgcatggacaacaaataaaactcttatgcctgttagcttcggccactctcaaaaaataatgcacgccgtcaataaactctttggaccaccggtcagcgtacatccattgccgatccatctacatgatatgaaaaaaaatcgtacacaaataattattcgtacaataatgacagtcatacaataattataaaataattacaaactctttcaacagtcatacaataatgacatatcattattcatacaaaaattataaaatattacaccaaataattcttatttactatttctaaagttttaactaatattaatgtgttgtacttcttttaattttcattttagtttgttttctattatttaagattaactttcactatattttccttctcaactattttataaaaccttctttagcaaataaacaaaatttctatatattctttcttccccacacaaattttctctctcatcaacttacaactaaattttggagacaaaaaagtgtgcaaaacatagctccaaatgtaatatgacaaaaaaaacattggaggatgaagttgctaaccttttaggcacctccgatttgtatataatcaccaaaataaattcactagaaattttggcatgacctcccctcttttttgaagaaattttgaagctgctcgggcagctggaggaggaagaagacatatatataggggtgggactttagtcc

SEQ ID NO: 93027 - DNA, 7635 bp, Oryza sativa
atgaagtcatctaggcatatcaaaagaccgctgaaatatgttagaaagcagaaaaactccggagtgatagcattggactatgtccacatggctaaaaatctagcaaatcagtttaccaaggggctatcacataatgtgatagacagtgcatcgaaggaaatgagcttgatacccacctaaggttgtacaatagtggaaacatgtccattgtgattggagatcccgtgaatttggatggcgaatcaaactattgtgtggctgagagaagagacccttgaaaagggctcattttcatgatgtacttctcttctactctgcatggtaggatgacttatgccttaatgtgatccgagtggtttttctaagcagagatgttgacctgtagaacatctcaaaaggaacacacctatatgagttcgactgctagtcacagtctatgagatttgggcgatctctagatactcatgaaagggcctagagtttgacttatatgctccaaagaaagcggatgcaaacggcagcccaataacactcaagggtttgagtgaaacctgatcacacaagactaacaattcaaggcatagtccattgttcagttgtggtctgatgtagctcatttcctaggtggaagttcaacttaacagtctccaccaaaacactggtatatcaaacaggcacaactttgagaacatttcttatgagccatgaaatttggtggggattgttagaataaatgggctaggcccgatttttctattaaatctcaaaggcccataataaatgttaaggataataataccaccctgggaattaaacgaggagtatctcaacttaaatagggagttattggaggctccttgttgaccggttgaggtgaggatcggaaagccacacgcgcacgcgcgcgccgagccgagggcgtgggcgaggcggtgcgtgcgtgcgtgcgatgcgatgcgatgtacctgtctctatccttttgcaacggatcagaatccaaccccgagattgcctccgtaacgggcaggcgattcaatacccattgatcgcgttgttactgcggcaacgggcagatctctctcctgcgccataaggaaagggggaacccgattagatccgcccggttactttccaaacactggtgttctttctcctccgttgttaacagtgaaatttggtaagcccggagtagtcatcggcttagagtcagcatcggttttgaagtcctgagattagccgatgagagttgtcaagccgtcagttatcagattcttgctatattcggttaaggaaattgatctactaaaggaagcttatccagaagagaccgagttcaaagagaatgcggcatggcaagttatctattaattaggaataatttgttagtttcctttttatctttaggaaagtttctttcttgtccggcaaggacttgtatcaacacatgggtataaatatgtacacccggggtctatgtaatgtatcttcacgatcaatacaattcggcccatcgccacccttttttacttctacttttgtttttacgttccggcggaacatggcacccgacgcggggctgcatcgtctttgatctccggcgaatggataagtccaatgttccgtcggtccaggcaattgtatcatctacatcggcgtcgttcaaggttgtatcaatacatttgacctcttggattgctctagtttagatgatatatttgcctacctatttatcatatgtctctattaatctagtcttagcatatcaatttagctctatcggctgcttctcgttttagggtttctgccggtatcggttaaatcgtgttgctagattagattagcctaggcatctaccaccctaaaaatcagtcaacggcttgattgtctagatattgtgtttcttttcatacttagtgctgcatcagttaagtttgatctactaagtcgtgcttagaatcataatctctagtttgcttcttgattgccaataagggtttcatcggggtttcagccggtgagttatctggacgttgcatcggctcaataaggattgcatatacatataagttggatttagccgatgacaacaaaggtttcactgtttagtctaatcttgtggatttcataacatcggacctccagccgatgtgtgctttaaccttcggatcgatgcttatttatcatatcattatttgccgattggtttctactcggttatattgttattttattacatcattaacagccgattgtctttatatcatcatctacattggacatatagctggttgcttataccctattgctatcggctggtatcggcatcggctattatcggctatcggctggaactactccatcggcttgtcagccgatcggctgttttgatctactatttgcatatcttgtcagttgcaggatcaaactgactagcatgtctgcatctcatcaagatttggacctgcacaggagctaagcagatctcccaggctggtgtgttcgattttttcgtcaacatccgtgcgccgccgctgcttgtgttgcttctgtctgcttccccggttctaattgcttgcgcgcacgagagatcggaacgagcagggcctccagaaccacaccttcgcctgagatctgcaccgggtaggcgggtgatcaggtttttggagagtgcttccgcacgactgctcccgtcttctgttcgtcgtcgaccgtacgtctgcatcaccatgtctgcctcacctacacttggagatggcgcgccgggagccggagctggcgcaccgggagctggtgcacagaacgacaacaccaacggaggcagttctgcccacaatccagcggagggactttcacagggtataatcctctactgctatttcagtttttgatatttctgttagtcgaaatgcaattgcgttctatgtatgaagattatgcttattctaccttaagcattctcctgtttatgtttgattttatcactagatcacctcacattgttcatgccatgattattatcttaatattttagattaaaaaatgccgatatatgactatatttccaacagctactgcatcacatcccctccctcaaccagctctggcctctggcccgatggccccgcagcccgaggaactcgcgttccttcaatcgctcgccttcatgcccctcctatcacattcacatccccttctgtcgatgacacgctctctttcccgtatttatctcactgcgcagcaggtgagcagagagagcaatcagaggtggaggaggtaactgcacttttgtttattttccaatcaccggctaaattgatgtttttgtttatttctcatagttcagttataattcttgtttggggttgcttagaggaagaaaggtgctgtttgctttccctgattttgttcatgaaggtcctttttggagctttggtatctgtatatgtgataatgtgaagcaaaagttgcgggaattaatgatcttttccaatgcaaagtagatactcaatgcattcatctttatcctcataccgtaatagtatatatcagttagcactggatacaaaaataccttatattgtcgctcagttagcagtggataggaagataccttgtttctttcgatgtgtcaggattgagttttctagcccttaaaaactgaacagggctacatgctgaattttcaaacaaagataatggtcaatccctggttttagagggaggagtaaatctatcaccactgttgcattagagtttgttaattttcaatatctgaaagtttcacgtgccacggaatgttctcttctttcactccagcaagtaacttttgtgtctgtgtttatcaggtctaggaattagataagaatgaaaaaacaacaataagatcgttaggaaagagttttagcttgcatggagcaaaacccctgttagtccatctgatctcaccatttttttgagctcacagtgtgtgcttttgctctctgagccgtatgaagataaaattgatttcctttataatatccttggcctgcttcaatcctttacattgataagaggctgctactttaatcctttttccatgacagatcccctcctctctcaaacccagaaatactgtgttgttcctattttctgaatatatgcagtacactgtattattaacaaagtagactgatatttcatatttgattatctggaagaggatttgtttgtgctcacactgtgccagtgctttatgagaaatatgaagatcaagttgatttcctctagaataatccttggcctgctgggagaacatcttactatctgacaaaatcaatgaactacttcatatgcatgctaataaaataacatcataagtttcggctaataatttaatttaccacgtaataagtaggccttagaaatttgaaaaaaaaccaaaaattaaatagttcttagacttttggaggaagagagcataagtatagatagaggtacataatattagaattagatactcctacatatctatacgtgcacgataatgttctatttttaactaaaaatgcacaaacccgtctaaccaacacttactaaatcaatgaaaattaaaccagggaatgaaccagagctgttatacactcttttactaattaacatcagtggacgtccgtggtggcatgcaagggcaaggccggcggccatggaggcttgacggggaacacccacttctggaccagttcgtcgccccagtcatacacgtgctcgagctccatggtctcgaggtcgacggagaagggccacatccccgacccctccggcggagtcagcacgacggatcgtcccatcacctccaggatcttgacgccagttaacctctcgacgaggcggctgtagtcttccagctcgggcaagccacgcgtgatcaactccggcagccggagcgtcttctccaccgtccactccctgccgccgccagcgtggagcggcgtcagcacctctaggtcgctgtgctgcaccactcggacgaggcgccctcctccggcatcatcgccgacggcacgcaggttccactggcggtagtagaaccggggttgttcgctggcgcagcacttgggcaatgtcagcggcgagagctcgccggtgctctcgtcgagagcgaacacaacgccgtatattgtcccccagtagagggagccgccggcgcgtccggcgaagtgcatggcgtcggcatcgaaatgtctctgtctccttgggacgcccttgggccggataaggtcaccgaggtccatgcttcttgtgaggcgcagccgcagctcctcgtcggcgccggtgaaggtggagaagatgcaggccgtctttgctccactcccgaaggtatagagaatcagtagcacggtaaagttggacacgccggcgacatggttgttgttgttgttcttcttctcgctgccggtgccggcgccgaggagggaggcgtcgaggcaggcgacgtgtttgttctccaatggaggaatcactgtccggtagcgccgcgtccatggctcgcaaacgactatggaaaccgaagatgcgttgccccaatagtatctctcaggcaccaggaggacgaggccgccatggctgtcggcgagcacccaagaagtgttgccgggctcgggcacgaagtcgagagagaagcgtttgctgctcgtcacggcagcggccgccggcacgaaagcaaggctactcaccctgcaggaaggagaaggacgggaccagttggcgaagatgcccgtgtcagtggcgatgtagttgccgatggtgagcgcgttccgggagcggtagaggcggaggaagccggcgtcggcgacgacgcggcaccaccgcctgcacgtcgacgcggcacgcacgaggcagatgggcgatgcgaggcgtaggaagacgctctcgaggagttcgtcgggaagttcgttcaccgccattgccggctgcgagctcgtccaatacgaccggagcttgcctcgttggtccgcggcgccgtgctgcaattaatacaaaccttgtttaccttagtcgtagccgtaatagcgtgtatgtgcatgcgtgatctcttaccttagtctatggatggccttatggccggaggcccgactgcccggcccaagcacggcacccgttacaaccacgggtagggatgtaagcgagccgacccacgagtttacttataggtcaaatagatgataactcatggattcctttttatgggcctgctagccgcatctagagatacaagtggatcgatttatagacttctttataggttaaattaatcggtaacccgtgagttacctactaattttgcttataaacggcttcgcagtcaaacctgcctgcacccctacacacgggtattttttctatttatatctataacaaagcaaaaaatacgtaaaggttctggtattttttgtccatctttcttctagtttttctcgaacaaagcttccggttttttttccatccgttttctttcactggattatggcccgatcttttttgtttggttttttccgacgctgtttttcttagatctcgtccaatacattacatgtgcgcaacgcacctcccaccgcccccgggccaaattaaacctagcgccgccgccacgatgatcaatctctacatgctttttcttctccaattgactgtaaaaatcgattctctactgtttttcttcacgatttcgctattgaatttgtttttatttcgctagatttaatctcagtcatcgatgatgatggcagatcggcgagcttcctcagcttgtttttatccgagttttgcacattcgctctgattattggaaaaagtggaaagagaagatcgagtagattaaaagacctcgaccaattatgggagattgagaaaaattcggctgaactgatggggaggatcgactccggcatgcgaacatgagactctcttccggagggtgaagacagtgagagctggacctgtgtctccacatatgggcttggccgaagataggcagactagtggactggattgaggctgaagacgaataaaagaatgggatttcggcccaaaaccatgaaagaatttttaaaaactttttcaattatggaaagcaattctaatgtttcaatttattgctcagctcttaacagatgttgtttccatgagaaaacatttttatccgtttcaacgcatgggcaaattttgtagtctaataaaaaaatacataaggctttcggttttttcctgggccacctggtttattttattttgtcgacgatcaattttctttgcacgcggaatggttttctttttttgcgtccatggggcttcccctttttcttggtctttttttctttcagttagttcatttggcacgcgcggaaaggttctttttgcaagcatctgccttttttttataaccgtcgccgggccgaatcctagcgctgccgccaagctgagctctatagccgccatcgtggcgtgtgcactgccatgttcaccttttcaccaccaccggtggcagcggcagcacgcagttctcgtgggaggataaggccatcggccacatcgtcaggccattgtcaagcaagcacctcggcggctcgtggtacctgtacgccctgggtgggaagc

SEQ ID NO: 93028 - DNA, 2085 bp, Oryza sativa
ctgccaatgaaagcacgtaaaacttcattcattaatctcatgaaagtactgggtgcattagtgagaccaaagggcatgactaaccactcatataggccgaatttagttttaaaagttgttttccattcatctcctaacttcatgcgaatctggtggtaaccactacgcaaatcaattttagagaacacaagtgaaccactcaattcatcaagcatatcatctagcctagggataggatgacgatatctgattgtgatgttgttaattgctctacaatccacacacatgcgccatgagccatctttcttaggaactaaaagcacggggacagcacaaggactaagagactcacgcacataccccttgtcgagtaactcttgcacttgacgctgaatctcctttgtttcccccgagttggtcctgtatggcgcacggtttggcagagaggccccaggaatgaggtcaatttggtgctcaatccctcgaattggtggcagccccggtggaacctcctttgggaaaatatcagcatactcctgcaaaaggttagtgaccggaggaggcaaagaaataggagtatcctcaattggaaataaggtttctttgcaaaccaaagcatagcaaacaacagtgtcagtgtcaacttcatccaaatctgaaacaagatcccttcagcttaatctcatttttattattttgaatagagttggtgagtttcttcttatgcttctcaagttcattagccgcaataagatgctcactcctagtatgctcctgatttttttgtttgctagctctagcatgttcatcctttaaaataacttcaggagacataggatgtaacacaagttttttttccattatgcacaaaggagtattgattggatttgccaaagtgtaaagaatctttatcaaactgccatggcctacctaataacatagaacatgcttgcataggcacaacatcacagttgattgaatcatgataagaaccaatggcaaaatgtactcttaccaatcgtgttacctttaccttgccgctgctattaagccattgaatatagtagggctgcggatgtggctatgtgctcaatgcaagtttctccaccatttcagcactagccaaattattgcagcttcctccatctatgatcacgcggcaagagcgttccttgatcacacacttggtttgaaacaaggtgtggcgctgattctgttcagccctttccatttgtgcgcttagcactcgctgcaccacgaggctctcatagtgctctgcagcttcagccccaatgttttcctcatcttggtggggcgcgtcaccttcccctgcgttgttagttgcaagcaaagcataggtttcttcatctaaatcactagcggaggagtacccaccatcagctctcacgatcattacacgagtgcttgggcagtccttgcgcatgtgaccatagcccttgcagcgtaggcactgaatatctcttgtccttcctgatgatgctactgatgatgagctcttggaaggtgtagcagcaacccctcttgttggttcactcgggcatggtgtagagtttgttgtagaggaacgcagcttgttgcttgaggacgatggtgctgctgctcgagttgacggtgcagcagcgttggaaggtgtccaagagctagcacgacctgcagaaatgttagtcctgaagctagctcttcgtccctgtacttcccttttcagctttacaagcaagatgaaacaaacgattaattgaattatattctttgtaggctagaatgtcctgaatttctcggtttagcccacccatggatctagccataccagcatcatcattttctaccaaaccacaacaaagcattcctgtttgcaaagcttgataatactcctctacatatttgtttccctgtctaagttgttgcaatttgtgcagcaaatcacgtgcatgatatgaaggaacaaatctagctcgcatgactcttttcattgcatcccaggtttggggagtgttatttggattggaacaaacaaattcactccaccaaatggatgcaaaatcagtgaactcactagtagcagcc

SEQ ID NO: 93029 - DNA, 12764 bp, Oryza sativa
  unsure (1)..(12764): unsure at all n locations
agctgctcccgcgcctgtcgcccgaggtctaccgcccaccgccgccaccactccggcacccgcccgctgccgcctccactcgagcccccgcctgccaccggctcatgtcaaggggggagagagagagagaaataaggaagagaggaggaagaagggtagtgagagagaggtacatgtgggacccacatatcagtggggcccaaatttttttttgtgtgaatgaaaaatgggccccgtatatatttttaattttaatgccacataagcgccacgttaatggcatgtgggacgaagaccaagttaatactgccacgtgtacgccacgtcagcgaaatcgccctctaaaaccactaagggagtcaaattgtatcggttttgatagttcggggtcaagatttctggtactgcggttgagggatacgatttagattcggtggtcagttgagggagtcaaagtgatcttattccaaaacttaacaaaagtccataagcccaagtgtggcccatttactgatttacagcagaagcctctggggcgcaaattgacccagctatgcaccaacaaggaaattattgtgtcgcgccctctgtccctaagacttaggcccttctgaaatgcatgaaattttaaatatagatagagaaaaaacatgtattctcaatttctacaggaagacaaaccataagaaaacgtcaaaataggtgtttaattgcaatgttggaaaaacataggataggattgcaagagactaaaggatcgaaaaaagaagctatcacttattggttatttttcttcaaaattactataggattgcagttccataaaaatttcagaagaaatgatgtgactcaatcctttcataggaccttttttttataagattatagtcctccaaatttcttaatccttcgtctcaaagagccaacaccttaattttatattaagcgtagggtagggttcattggctctctttattacccttgttttctctaatcgttagatgcaaacatcaccaattaaagtttgaatataccagtctagccaaccattaattcctaaaaaaaagaatgcaatcataaagggcatatatttgccgtttaatatctttactaatctgtcttagactgtactatacattttcaacttctactctcccattttctgcgcacacgtttcctgacgtactacaatattttttgaaaataaattatagaaaagttgctttaaaacattatattcattcattttcaagttttttttgctactactccttcagtccccaaatatatatatatatataatcagatgggatatattctaagactatgaatctatatatgcccctgtctaaattcatagctagcatttatcctatttaatcgtaagtttctatgttttaaaaagtaggtagtatgatctggtgttccgtttcatgtgccggcaagggatctcaaacccacccacctccaaaacgaacacagagaacacagtacacaggaaggtaatccatgttccgaatctgatcctctgcgtcaaatgcaataaagatcccatgctggacacatcacgtcagcaatggcattttcactataatcttgttgtgcatctgtcatttgttacaagtaagacatgaaagaaacaacataggtggtgtttgggacaccaccatactccatccatcccaaaaaaacacttaatcttggtgtggatgggacatcacctaggacaacgaatttgtgatatcccatccaagttaaggttgttttttttttttttttggatagagtgagtatctctgtaacagtcatttagtcaactcgtacgtaaggtaatacaaatcaagaagggatctttgttaatgccagaaataaaaccatccacattttagttattactatcctcctttagtgagcttctaacaaaaatgctgcaaagctacaacaaagattcaaatggggtacacatgaacattatcatactgttttagttttttttagttcttgagatgtgaagtagtctcaccctagcaaaattactctgatttgcttgagaaaatgtgtataacagacggagttacaggttggatgagcgattggcgtattcctcaaccattgcaccaaacagggatggctgctcaatcaatcttgagggtgaatcaaattcttttaccagacctgaacataaatactttgattttaggatagcattctgtgagctaaaactagcaatagaaatacagtgctttccctcatctaatagagagagaaacaaatttcaataatgaagagcattttaaacaaagctatgtgcattttttagcaatatagcgaaaaggactgaaagacctacctgcatccagcaccagaactctatcacaatccatgactgttggtattctgtgtgcaatgctaattattgtacatgaagaaaattcttgtcgtgtgatcttctgtatcgtggcatcagtttgagaatcaactgaagcagttgcctcatccataaataatattcgagtccgcttcaatatgacgcggccaagacaaagaagctgcctttggcctacactccagttctccccactatcagccactgtgaagaatcaagaaaaaatggccggtaaattcaataaatttgagttccaaattttgatagatgtagattcgtttaacaatgtctatgttcatttcacatcaaatatggcaagaatcacctggatttaatatttagtttcgacatggaactgcatgcgttttttcttttacattgtacaaaaagttgtgcatacttctagttatttgaacattctaatgtatttaatcagttcaatattttggaatactttggtacttggattttgtaaatgatcaacgagccaacttcttcagacatattaacttctggaatactctgtcctcattatacagggaatgtacgtttggacatgatcttcagctcatgtttcatcattaatttctcatataatacattgttaatagctacaaaaccagtacggtgtgaaagctctttgaatatgagtcgtgttataaattttcatacattaaagtattaaacatctcacaatttgacgaactgttggtcaaatctacaatgtttggattttttttaaaaagcatgcgcgcactatattcagactggaaaatgaagcagcaaattcaagtaattaagactaagcagtaaatgcaacttaaagtcaacatagatacagcagaagcatataagtagcaaacctagagcatcaagtttttgaggttttgaagcaactacatctttcagttggcagccctccagagcctgcgaaattgaagtaaaattcccacaggtaattaacacaatacaagtacacattcataagggattaaggggaaggctgaatgaaacattatagttacaccatacccgccatatctcagcatctgaatactgcccaattggatcaatgttgcttcgaattgttccttcaaagagaactggttcttggggaataatgccaaagcgggacctcagatcatgcagacccaatgtgcatatgtctattccatcaatgatcattgtcccctgcacaggctctacaagtctgaacaatgcttggatcaaagttgattttccactgcctgttcttccaacaactcctatcttttcaccaccactaatgcttacagttatgcctttcaaaattagaggtgtattcggtcggtacctaacctgaaaggataaaaatgctatgctcaaatatttttttttgactgggaatactgctagggctttgcccagcagtgtaaattttataaaacgcaaaaagcatttacaaagttacagagaaagaactaaaggaaaaaagcaacaaagctacaaggtttgaattctccgctttataggatggatgtaatggagcggaatccctgtacaaatcaaaataataatagtataagaccatgcagtttaagtacttaaccttcttacctttaaatcatcgatgtcaatatcaccatgagtgggccaatttggagaaggaagatggtcttctatcttccacactgcctcagaaggaagggtactgaactgattaaccctctccacagcaaccatatcattttccaacatacagctaatggatattgcaaaatacactagagaattgagggagaggccatatgaaagagacatgccaacaaattctgcaaaagcatagtgaacattagttcatccagcctatgctaatgatcataaatcttgacagaataaaatttactaagcataagaattgaaaaaatatttttgtcagatgattaagatgcaaggagtaaaaggacaaacaaccatgttatatcttcgacctacttactaacattgagacaaataaaaagagaaggaattagctacaccgctttaaatatataatgcattaaagtattcctaaatgagtcggttttttcatgagactgctatgactaccagtctcggttcatgctaagaaaaatgatcaaatctatcatatattggtacctttcttgataaaattgctaggcagactaatcataaggaaagcagttattgccaatacgagtgtcccaatcaactccagacggaacccaagccattcatttgctgcataattgtggaagtacatgcgcaaacttgaattgattctgtccaaattttcttggaaaaattctttgtccttcttgaagcatctgatggttgtagcacctagaacagtctctgaaaagtgatcaattactggtgcctttgttactccttcaagtctagttagctcccgagaagttgcaagatagcgattctgcacatatataaggaaacaattgagtgtctcaatgaatataataatttttttggagcagaattagcaacagtatctgaggcaaattgctatagtaggagcataccctgtaccaaatgttcaatagtacaagtggaattacagctataaccgatggccaggcaacctgacaagtaacaattatggtacttaatactgaaatgtacattgaaattgtcagaccaacaaaaaaggacagcacaatatcaatggttgtttggtccgatgatgcctgaaaagtacaagaggaagtatttcatcagtagaggataaaagaaatgtggcgacaatctcttcagtattcagaaaagagaaagaaaaaactaaacttgatctatactttttataaatgtgaagagtacaagcagtgccagtttacaagaccaaactatttcatactgaanagggtggtagcattgttcatgccaatttaattaatagtaaaattaggtttgcagatgaagaaataatcaatttcaataaggtatcaatagtactgatgaagattgagcaaatcgcaagttaacgttatcagcaaatgaaccataagtagagaattacccgactgagaatcctccctgaaggtgtggtatcaaaaaatgacatcggggcatgcaaaatactgtcaaacatcttcttgaaaaagatctgagcagtctgaagtcccaatattgtctcaagaagactcttgattacttgaaggataattgaaacagcagctatagcaacatacactccaataaatagagatggattaaatggaatgctgcctgatgtttcatatgacagccaatagtcactagccatttcagtaacttgccatacaattgcaaaagcaagcatgccgacaaccccccaccaaccccaagcctctgtcatatataacttgtacacacgccaacttacttgaccactttctctttcctcttctcgtataattttagaagtagctgcttctatatcaggtgcaacaagtaccttctcaccctttccaatggatctagagcgaagagaaggaattctggctaccgccttaggctgagaatattcagttttgacaacttgtcgactttgatccaccagttccattgaactatcatgagcagcaacaagagctaagaaatctgagccagcatctagtaactcatcatatttccctgactgcacaatcatgccatctctcatgacctgcacaatcacatggaaaaaatgattaaaaatcaagtcaaggacaaaagtgtatgttctactccctctgccctgtaatatgaggggtttgaccccttaaatttgtcccagaatataagggattgtgatcccaagacaatactttattccccacctacccacttttgtactagtttattcctccacccacccactttgtactagtttattccttgcccattaagttttgtactagtttattctttcaactaccaccttttgtacaatcactcatactatcgttacttccttaatctttgtaaaaaaaaaaggcataatcccttatattatggaacggatctttccacgagaagagaggagcgaaactacctccaactgttgcttacaattctcttctagaaggaagctccaataacatgattacatgatgaaaagcatgttaacatcagaaattcattggggaatcctttcaatggttgattatgtcctttttagattataggggacagattatgtggggattatttgtaccgtgcttccaaaactaggatatctcgaagaattttctacattacattgcttagatcacttgttctaaacaatgttagctttataatatagaatatttaattcatacgtatttttggaccaaacagtttcaagtatataaaaagaatatgagtatatatgccatagtttttagagatttttcaagataataatttaaaatttacttgcttgttgaaacatggtacaagagtatgctgaaaataatcatgctagaagacttacaaatatgttatccacattatgcaagaaatccacttggtgagttacaagtaagatggtctttcctttgagcatgcctctcagacattcctgcaggagaaagttcattgttgtgataccatgcaaatatgttagcataacagaaaaatacttagttcatcctcgatatatagttatcccaagaagaaacaaatatatttatttaacatataattctagcctcctatgtacatcatagcaacttttttatgggcatcatagaaacttttaaatctatttatttcttctttaggataacataaaaatattctcacaaatagactgaattaatttaactcaccacaacagtagtaaatataaatatttgtccatttcttatatgttactatattgacatgcacttgatagtgcagtggcaaggggtgtgtgatttcaacccaaggtcccgtgttcaatccccaacactctcaccatttcatcttaaaaaaaatgtttggagggacatctctccctccaaatctttttttttaatgttatatcctattttcattttttttcattaatctcctacaggtaacggtcctttattccatatacacactcatctattttctcaatttaagaaggattgagtttgctccataacaactgataatcattcttcatccttcaaacaataccaaatgcagtaaggtagggcatgcatgcatccacgcagcgaaaatcatcaaattatcagttgcatgtatcaaatggcatgtgaagctagctgagtgaaattttaccttaaaaatgcttgagccagtatgtgcatcaactgcactgaagacatcgtcaaggagatatatatcacaattttgataaactgccctggcaagctgaatacgttgtttttgtccaccactgagattgatccctcgctctccaatctctgtctggtcaccaaattccatcatttccaaatccttttccaggctgcaagaccgcagaacttctttatatctttcagcatccattggctgcccaaataagatgttctcttgaattgtgccattttgaatccaagcagtctgtgcaacatatgcagtgctcccgcatatcctaacctgtggagaatgcaaaaaaggataaagaaaacaaaaggacggtgaaaactatagagcagcttgtagtccaggtatttatttagacaatactatctatctatcttctattatatactaaaagttcatgaaacttcctacaaacgctcctaaagccgccacttggcgctctaataaattagagaaatcaaagaaattctgagaaaaaaagcaaaacattctatccttgattttcacttaatagagtggacccattattttccaccgttagatttaaaaatattccaccataccctggcgtatccaaggggtggtccgggtggtccccggtccacccaaaaaatcgccagcccaaaacctatttacggtgaaaaaagaagataagaaaactcctgtgcgtaagttggtcaattggttcgtctacagataggagtccctcacccgtttgcgttgtttcctctccctcacgcgatcgcacgcttgcatcttgcggctgctggccagggatcctggtgaatggcgacggcggagttgtggactgcaagggcgaagcccatgcatgcatatggtctccgcggcggacggcaagggtgccaggacgctagagtttgcatgctgcaggtcaggtccattaggagattaactagctgattaggtttctttcttttttaccgttctcaccttaccatgaatgcaatgtgtattgcagattaaatatgaagaaagatggacataagtatgtatctcttttaaaaaacatagagcaaataagatgaagatcgctttccaatcaccttcttccttggttgtggcagaagaacaatctcttttaagtcggattttgtgactaatatttcgtgatgaacttttctaaattatatactggcaagttctatatctactgtatttaaaaatattatataaattggaccacccatacctaaaatcctagatacgccaaccccccccccccacctcccaggcatcctctcccccttatgtacatatacgtaatgtacgtacgtaaatttgtccgtccgtccctccatctcatatcttctatcattcttttcatctttaaattttctacttagcaaaatttaatacgaaaataaaatcaaacattagataactagatgattataatctatatattatattatatactaaaagtaaaacactcttacaccatcacgtgaggctcaatgaaaatcagacaaatcctaaaaatctatctatctgttattatatactaaaagtatattaaacttcctaaaaacgctctcaagccatcacgtgggactccgatagacgttcctaagtcgccacatggcaatctaataagtcgttcataaacacaaataactaaattaggtgtacaatctcatggaacaaaataaaaactacatcctcgtgacttttctttaagtaaaaaaaatatgtatactgcaatatgaaaaaacataaattaaaagacaccaataatatacaccctacatataattaaaaacatatgactaatatatgtggcatataatctatgtatttattggtctattaaagcatatactcaataagacaaattcttgaaaattttccttatgaaggcacaacattctacgtgtaatttatcattagtcaagtggtcatgttattcgtagctatcgaattatttctacattataaattataaataagcatttagattaaaaacaataatccaagtgtgttaacaaattggaaaaatacatcaagttatatttcacaagtagtaaagaaccatcataaggtatttacggttatagccaacgaggaagaaaaaaaaaaggctatggtaccccttattagttaaaagaaacatagagagtgggaagaaggttagggtaagattgggtaaacaagaaataatagttgtttggatatgacaagtagtactactctaaaatcccttatattttgaaacaaaatttaactttctcggatttatgcgacgaagtataatccatctagctttaattatatgacatagttctattagctatatgtttaatagacaatcttaaattaatttatcctaaaatccagaaagacatagatagtataaaagcaattattacttaaagtatagaaatacccatagtacaaaatatagaaagtttcatagaaattcagaactgcacgctttcacacaattttagttaacaaatttttatgttgcaagggaaactagaagaaaatcataaccaacattcatagaaatcccaaataaatttgaatagagtataaaagatatttcaataaaaaaaccaactacacataaacatgtttataagaaaatttcaagcacattaaacaagatgcccgcgcatgtgcgcgggctaccttcctagttctttcaaaaagccaacacaagttgtctaaagttcatgatcttcacaagaaaactactcttttaagaattcatggtggggtcaaagctgaaaagcagcatatcactcaaggtttagtacagtcaacagtcaacacattgttcacagaagtccacagtttgccaaagctgtagactgacaatagaatcaaccttcgatattttatcaagcattaaacaggcatagtctaggtcaaaccaacagaggcgttgtgtcaaacatctggtgtgcattgttactatgtaaaatatgaaagcgtacctaaaatgttggttttccaactaccttgcattctccttgaatgctagtccccatccattttacaacagttgttaataatacaagcagacaagcagattaccactaccttttttggttcttccagaatccccaacccaaacaaatggcaaataccacaaataaaaaatggactcaaccttctctaggtatcaatttgctcaaatggaacatatggtcttgcactgtgggtgcacccacctacccctgatttgagccgttcagacggaaatgtctaatgtcaatgtgatataatcatctagaccaacaaatgccatcacaattaatcttgagtgaattcgcattcacctgactaactaacccctgatttggactgatcaatccaaaattatacaaaatttgtgctactgttaaaagctattttcgccgggccggagaaactattaaaaactttgactgctcataaaaatgcttggtttgaagataactgacaagaatcacagacataccttcccggagaccttgtccatctcccccatgatacatgacagcagcgacgatttgccggagccaaccgtcccgaccaccgctgcaagctcacccctccttacctcaatgttaatccccttcagcactgtctccagaacaggcgtctcctcgacatctttctcctcctcctcctcctcaccttcttcatcatcctcgttgtcgtcgccctcttcattctccttcttgcccctcacgtcccatgcaaacacgccatcgcgcacttccacgaccacaccatcagggttaatcccagcgtcatcaacacgctccaccgtggtatcatcaagctccacgtcgagcagatacctgtcaagcctccccagtgacacggtcgcctgcgtcacggaggcaatcgcctcggggaagctctgcattggtccatccagcatgtggaagaaggcggtggccgtgaacaccttgccggcgtcgagcgtgacgccggtcagcacacaggtgccgaacacgagcacggtcatggcgagcgggccgctccagagcacgacggtgttggcgcacatgaagtacatggacttggcaagccacccgagctcagcctccctgagctcgtggatcttgccgccgaacgtctcctcccacccctgcagcttgatcacgcgcatgtagttgagcagctcggtgatggccttcatgcgctcgtcgcgcttgccgaggaacttgaactggtactccaggttgcggcggttggcgagcgccacgaccacggtcaccacggcgatcgcggcgaccgcggtgagcacggcggggccgaggtgggtgtacagcagggtgagagccacggcgatctccagcggcatcagccacaggttgtggagctcgtgcgtgacgttggccacctcctcggcgtccacctccatgtagttcacgatcgcgccggcgccgtgcgcgcgccgcgcgcccgtggacagccgcagcgacttgcggtacaccgcggcgagcagcgcggcgtggatgcgcatcccgagcttctgcccctggaactcgtagtggtgcgaggccagcgcctccgccgcttgccggcgaggaggacgacgaccagctgaagcccttccgtcaactccccgccgcggcggacgaaattcacgaacctgtcgacgagggaagggccgatatacatgaccgagaggtgcgccaggccgagcatggcggtgagcaagaactgcggccagaacgaccggagaagtgcggtgaccacgggatgcccggccttagtccccggcgccggcggcgcggcccagtttgacacgaacagcgcgtaagtcgcctcggcggtatcatctggcgccacgggcgggacatcgtccgcggcgagagccgccctggagcccttggagatgagcgggttgatccagctgaacgtcgcgagcgacaaccacgacgccgtcgagtacgacgccgccgccgcggcgtgacccggaacacagcttcggtcttccccgtcgggaatcgccgcaccaccgaggccggtggagccggtgacggagaagtagagaagagggagcgacatcaccagcccagcgaacgcgactgcatcgtcggggaggatgggctcgcgagccgcgtagcgcgca

SEQ ID NO: 93030 - DNA, 8346 bp, Oryza sativa
ggttatgggcggtcaaccagattcaccgtgattagtctcaccctagtgtaatctgttgaatttggatagtttaggtgaatggttgggcctgtcgcaaagtgggtaggcgttggacagcggatgttaaatactgttaattattacaactgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttccccccaacctcagagctcgagtatgtgtccgatggcaggttctccgaggagtaggcttcgtccgtgccgtcgaggatgcctgtggagtggtgttcccgctgcagttcaagtcaaggattagctccagttatcttttgttttccgctgcatttctgtaagacctttataatgtttgtaagacgtggatctgtatgtcaacattgtcgtttgtgtaccccggctggtcctggacgggggttttaatacacattctgcttggaattctattcgggaatttctgggcgtgacaagttggtatcagagccgaccttgaccgtaggacaagccaaatggaaagacctaagagccctctgaatccttttcattgcatatgttctttgcaattggattttgttccgggaaaatggggatctgttcttgtggttcaagggaaaaatcttggtcgctcgtttaaagtgagtttttcaaaacgagtcagtctagggttttagtaaaattattgggatttattcgtcagtcagttggggtttgaggggtgaaatgcattaggtcctagctcggtaacatgggttgcaaggtgtttatgctttgttcgttattattattatgtatctaatttcccattattttatcgttatgtgagtctgtcttatttattcgcgctcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggagaaggcatgattgatttcgtggcagagttggcacgcatgaccctggtggtgggctaccccgacgcgccggagtacacgacgattccgccgctcagtggcgagcttcctcaccgtgtccgcttggaggtccatggttacgtggggacttgcctcgctaacatggcggtcgaggcatctggaggcacagcagatcacgcctgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccagatgcactcggacctgcacaaggcgaccaaggccttgaatgatgggaagctcatgaggatcgtcgctctgaaggacgagatagcgcgcctgaagaaggagaatgctcagttgaagggtcttccagcaccaggaggagtccggatccgcactacgccccgtaagaggacgactgcacccgtgcgcatccagcttgcgcccaggaacccacctccaccagcagctcccgcagcacctccagttccgcccgcagctccggcagttcccgcagttcctccagctccagctcccgcgttcactctctccttcgctccagcatcagccgccagaggtccagccagtggtaccggaggttggttgtccgctactcccagtggcagcggcgagactgatctgtcaggctccaggagtcgttcagagggaccaggtgacgagcaggaggacgctttcgactccaccggccgcaggagccgttccgagcattaggctcgttttcccattagtttatcgattgtctagtttctgcttgttagtttgtgtgtttaggttgcttgtttggggtcagtcgacggtcgatatcatgtgcctatgatatggctgtcttaataaggatttttgtttgctctttttaagtgttttaattcagatcagaacaattgcagttttaattcctatataataaagcttagttcttgagcatctgtttttcttcttctcccccgtctgcttttccctccagatggtctacaccaggactggcaaccgcacgacaggcgagggcagcaacggtgaagaacgcgctgatggtgtgcaccccaacagtgattctggcaatggtccgccaccacttcccgagaatccgacccttgcccaagttatggcacatcagactcagatgatggcagccatgatgcagcagatgcagcagcagcaccagcagatgcaccagaggatgatgcagcacgccgaacagcagcaccagcagtttggtccccctccccctcagtccaagttgccggagtttctacgtgtcaggccacccaccttctccagcaccaccaacactatggaggcaaatgactggctccatgcgatagagaagaagctgaatctcctgcagtgcaatgatcaggagaaggtcgctttcgccacacaccagcttcagggtcctgcgtcagcttggtgggacaaccacatggccacccgcccaccgggtactgaagtcacatgggcagagttctgccgtagcttcaggaaggcacaggtgccagacggggtcgtggcacaaaagaagagggaattccgggcgctccatcagggcagcaggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgccaggaggatcaacgcaacaagatggataggaagaggaaggccgcgcagttcagggcacatcagggaagtcaccagaggccgcgcttcactcccgggcagcagggtggacctaccaccatgattgttcgtcaacaccgcccattcaaccccagcaacttccaccagggctccagtggcagccagaatcaccatggaagtcagcccaaccgcggtacagctccacgcccaccgatggcaccggcacagtcaggccagcccgcacaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcatctgcggaggaggcacaagcagcaccagaggtcgtactgggtacgtttcctgttaactcaatccctgcaacagtactttttgattctggtgcaacgcattctttcatctccaagaaatttgtcgggatgcatgggttaataagagaggaacttagcacaccgatgcgggttcataccccagggaatagctccacttcggttcaattcagcccttctataacaatagaaattcaaaggtcacccggttttgccgagttcagtggagtcatcattcggaagaggaagcgacctgggaaagggaagatgagttgaaagccgcccatccgtacctcttcaccagctcctccgaatctcggggccgagattccgtttaaggggggtaggtttgtcacaccccgaagttttcctcccaagccaaattgtaaattacaaatgaccccaagaaaatgcagaggaaatcaggataaaaccctaagaaaacaatgcaaataataatcggatttgacatgtggaatttttcttgaattctacatgtcgaaattcattaacaggatttttagtggaattttcagagctctagaaataattttaaccaattaaaaatcactaaagtgcaatttttaattccagggaaaatccttttcctttttctttttcttttccctccctttttcctcctttttcttttcggatgggccgccggcccattcccctccttcctccccctcctccttgctgggccggccgcaggccgagggcccagcctggcagccgccgcccgcctcctctctcggggtcgccgacaggtggggcccacctgtcgggtccttcccccacctcccgccgatcccgccgcgccgccgcgccaaaaccgccgccgcgcccacgccttcgtctctcccgggccacgtcggccacgcccgcgcgtgcgccgcgtctcccgcgccctttcccctctccctcccgttcgcgcccgcgcccgagatggccgggattcgaaaaccgaatcccgcctctctctcctccccactcccccacgtcggccgtcgaatcccgccgctcccggccacgtccggctccctctccccctttttaagcatcgccgtcctcctctctcgctttttccccatttcgccgatctctcccgagctccccatcgcctccgcgccgtgcaaccacccgccgccgccgtttttgctactccgtccgccgctagccgccgctaggctcgtcgccgtctcgcgccgtcgccgccgttagcttcgcggggtcgagatctacctcggccgccccttccccgtcgaggttcgccgccggagacccatccccgtcgtgtgccggcaagtggcaccatggccgccgccttcggccggcgctctcgccctcccacgctctttcctctctctctaatccctctccttttgttcgttaggaggttccggagctcgtcccgccgtcgtcgtcgtcctccgtcggccgccgtcgtcgaccgttgtcggtgaggcttccccctcctctttctccttttccccgtaccgggtagccgcgtgcgcgccgcttagccgcgtagccgccgctcctcctctagccgccgctccccgccgccggtcggtcgccttcggtcgccgccttgcgccgctgccgcatgcgcgccgccgccgtgtgagcgccgcgccgccggcgccatggttgccgccgtctcgcgccgcgcccgcgcgccccggccgcgaggtcccgccgccgtccgatctacccttgggtagatcggggccgtcggttcggccgccacgtggcgccgccgcccctcctttcccccgtgccgctgacccgtgggcccgcgcgccgccaccccctttctctctctcccggtcgctgaccggtgggccccgcctgtcggcgccgcgccccctcgctgacgtcagccctggttaatattgcgcaataaattatttaaggatttcttttatagtaataaacacagtgaatcttctaaaattcataactaattcatccgagctccgtttaatcccattcaagtctcagtaaatcaagaaaaatgtgtagaatccattaaaaatggttttgttctctgtttcagtagtcttatagcctgtttgcaatgtttgcttggtatgtcgctagattccgatccctccgacgctccggtgtacttcgagatagtcgccgaggtccctccagcagcggagcaaggcaagtcatgcttgtcacttgaacatgttgatcctatattgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaactgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgcagttcaagtcaaggattagctccagttatcttttgttttccgctgcatttctgtaagacctttataatgtttgtaagacgtggatctgtatgtcaacattgtcgtttgtgtaccctggctggtcctggacgggggttttaatacacattctgcttggaattctattcgggaatttctgggcgtgacagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtctcacacctctcatcataataaaagatgcttaaactagtaataatttgattagctcctggtttggaatggtatattcctggtttggagatagaactgtgcagccggggtggttgttcagaatggttgggcctatacaacagggtatgttgtatagcgttggattaatattgcttaattaatacctaactgttttattaaattctgaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagtcgtctgcgccgtttatttattttccgctgcttagatctttattgattgagaggaactatctacctctgtaatgacattttattcgcttattaattagagtaataattgtactctattatcaatttgttattgtgtgcctcggctgattcctggacgagggtttacatacatgtaagcgtttagaattttggatagaaattccgggcgtgacaactcactggcagcacctctggccagttggccgccagcgaaaactattttttgtagtagtcacaacagttcagattggttcactagctcaggatagctcatctgtaataggcgggaagcattatctgtgtcggcgaggggtactgtcacgaaccaaaggttattaatgtgaaaagtcatatgtgtcgggtcagccaccatcacggacgaccgtcatccttatcgggcctaaataaaagacccaaactcatctatgacgggtcatagttaagacccgtcacggataagagttatccgtgatgtttcaagctcctacttccaagaactgacttttttgtccccaagagtgatgtctggcttgccgccgattcgccgggtcgctgccattgacttgtctacggctatgttccgagctttgagtgacaacatcaggtgttggcgtcagaacccgacatcgtcaaaagcctcgtgcgtcgtcttaccggtggtaagccctttttctcatttatactttgt

SEQ ID NO: 93031 - DNA, 2140 bp, Oryza sativa
cggttctcacatgggtaaggcatatgtctcctttggtctcatgatctctcaaaaagtggtagcgaatatctatttgtttggttcgtgactgttgaacgggattattggctattttgatggcactctcattgtcacataggagtgggatcttggtgaagttgtagccaaagtcttttagagtttgtttcatccaaaggagttgggcacaacaagaaccggcggcgacatattcggcttcggcggtggataatgcaatggaattttgcttcttggaggaccaagaaacaaggaactgcccaagaaattggcaagtcccagttgtgctttttctatcaaccttacacccggcataatccgaatcggaatagcccaaaagctcaaagtcacaacccttaggatatcacaagccaaggttaggagtatgaactaaatatcttagaattctcttgacggcaatcaaatggcactctttaggctccgcttgaaagcgagcacacatgcaaacactaagcatgatatcgggacgagatgcacataagtaaagcaaggatcctatcatggagcgatataccttttggtccacacatttaccattatcgtcgaggtctaggtggccattggtaggcatgggtgtcttgataggtttggcatcctccatcccaaacttcttgagtatgtctttcacgtacttggtttgagagatgaaggtgccctcttgtgcttgtttcacttgtagcccgaggaagaaggtcaactcgcccatcatagacatcttgaaacttttagtcatgatactactaaattcttcacaaaaagaggcattagtagaaccaaatattatgtcatcgataaaaatttggcaattgaataaatcattttcaagctttttagtgaagagagtagtgtccgccttcctaatttcaaaaccatttttcaaaaggaaatctcggagacattcataccaagctctaggggcttgtttgagcccgtaaagacgtcttgtggagctgtacacatggtttggcaactttggatcctcgaaccccggtggttgctccacatagaccaattctgagatgggtccattgagaaaggcactcttgacatccatttgatataacctgaaatcatggtgagcggcataggctaaaagcatttggattgactcaaggcgagcaacgggtgcgaaggtttcaccaaaatcgagaccctcgatttgggtgaacccttgcgcaactaaccgggctttgttccttacaaccactccatgttcatcttgcttgtttcggaagatccacttggtaccgatgacattttgcttgggtctctccaccaaagaccatacttggttgcgagtgaagttatttaactcctcttgcatagccatcacccaatccggatcaccaagcgcatcttccaccctggttggttccaaagaagagacaaatgagaagtgttgacaaaaacttgcgacacgagagtgagtagttaccccttttcttatgttaccaagtatgttgtcgacgggatgatctctttggacaatgtgatgtatccttggatggtgcactggggggacctgagcctgatcagtatgctctaaagtgcccggaacatcgatcccatccacttgcgccgttggcacgtcttcactaccgctggtccggaggttccggactgtagaacccggaacttctgggcctggagatgtccggaggttccggtcaataggacctggaacttccggctcagcagacacagcacttgtagggctattggatgtcgatgacggaggttgatccctatcttcttggtcatcctgcgtctcgactagtcgtatatctccaatagccttagtacctatagcttgacttggatccacatcacctacaacatgtacaacaacttgctctccttaggagccattagattcatcaaatgtaacatccctagtgacttcaacaataccggatgttttgttgaagatacgataggtatgtgcatttgattcatagccaagtaagaatccctcatccaccttaggtgagaacttagatgagcgaggcctcttactcggaataaagcatttgctccgaaagacacaaaaatatgaaacattaggtttcttaccgctcatgat

SEQ ID NO: 93032 - DNA, 765 bp, Oryza sativa
acttgcctttgaatacaacggagtcatcccttctaaagacggtcacatcctcatcggtaaacaagcaattgtaacccaacttacacaattgagaaacggattataaattgtatcttaatgaattgacaagaagaacattacagagagattgattattggagatggcaattttacctagaccaattacctttcctttaccatcatctacaaacatgatattctcacgagttccgttcttctcatcaaaacttgtaaacatactcctctctccagtcatatgattggtgcaaccactgtccacaacctaacttgaaccaccggaggagtatgcctacaaaagaaatcaagcttgggatttaggaacccaaacttgtctaagtttgggtcccttgatgttagttaccaaagcctttgtcacccacacacaagtgcggtactcatcattgtaattcccattaaaataggcaaccactttgccctctgaatttttggaaattacatatgaatcatagtaaaaaccctctggccggaacctcctggcattgtgaccggaacttccggtcatatcgtgtgcacggccattggcccggaacttcctggtgggaaattttgagagacaaagactcccacccggaagtttctcccggtttgtccggatgttccgggtccctggcagctcacaagactagtcacctcacttgcttgtggtgcttaacgtaccttttctcacaaacatcaagcattctttcccatttaccatcacac

SEQ ID NO: 93033 - DNA, 1316 bp, Oryza sativa
  unsure (1)..(1316): unsure at all n locations
gcggaccccacatgtcaacctaaaggaccgcggtagaccgggtacacagagacggtccacgggtcgacagaagcagatcccgtgtgtcaaccgaggcgagtggccgacaaacggactccactagacaccacacgggctgcacacgtggaaaccatacggctaccgagcggacacactaacacggtcaccacacgcacaagcgaacgactgccgacaccatacacgggtaccggggccgacaaccgcacaacgggcacgggcgacaccgaaaggatgaggacggtgcagcgagggatagggatccttaccaccacgcgacgaggcgtgggaatgacaacgacgaacgggcgcggcggaggcggccgggaacgacagagacgaacggcgaggggacgacttcggcggcgatccttggacgaaggcgagacgcggccggcacgaggcttgagacgcggagccgaggacgaagacgacgacgggggctgcagcgaccttgatgaaacaccgaggacggacgaggacggctcgacggagggacgaacgccacgatgaccgggaacgacgaaaggacgacgacgacgacgccggggccggcgaggaggcgacgagggcagctggcagcggctgcacggagacgaggacggcgtggaacacgccgctgcgatgacgatgacggtggcgacgcagcgagacgacgagccgggcgaccgacaggacgtcgacgacgagaacgaacggagacgacgatgatggaccgcggaggggtttggatggaggggaaacgatgccgaggacgaccttgccgctgcgatgccggaagggaaggcgacgacgtcgaccggtgcactagcgaggaacagtagccggccgggtgaggggatgtactggatgccggcgaggacttcgttccggcgagatttgggcaaggaggaggtgaggacaggggagtggacaacgtcacagtgccgagggagtggtggcgacgtcngccggcgcacgggagacgcggcagaggcggccggaggcggaacagtggcgttgccgccactgtcgccggtgggggcgcgtctccggcgatttccccacgaatcggaggcggccccggggaagaggatgcacctgcgaggcccagggagaagacggcgcggccggacggtgctcgggcgaggagggagaggcggctggaggccggccgccgccggagagagagaatgagaaggcggggagaggtggtgcggccaccggaagacgcgggaggaggctaaaatgatagaacgcaaagagtgggttccattttataggatgggggagggagc

SEQ ID NO: 93034 - DNA, 2205 bp, Oryza sativa
ttgggcactaccgcctgcagcgcatcgctcaacgcttgacgatgcgtttggccacgcaccatggtggtcgcttaccagtgttccgagcaaagtgtagttgtttgtatccattatgtcaaccagcctgtgtgcaatgttgattgcatctagagaccagtgatagtggtggagcacaggaaccattatctgtccattcagtgtttggaagtaaagaaacgaaacttacaatagcattgctgggtttaaaagatgctcgatgcaggggaaaaaagtagacatggcattagtctttatgcaaaaattaataactaaccaatgctggatgtagtcgcgcaagtttccggccaaagcatcagtggaaaatttgtatctttccattttgtttgataaaatcaatgttcaggagaaactgcaaaaaaaaaaaagtgtggccatgtgttggtgtgaaccaaaagagtcacatctcgcgaaaaaaaagaacagaaaaacaatcatgttgctgcaccgtacgaaaaaaaggaatacagtagaaattggcgttattcacgttactgatatggaagtcggaatgaaaatcctttttccataattatctagcctgtacttcatgtcatccttgaatagaatcgagctgaacacgtctatgaaaagctcctctgtcaggctcccgtcggagaacgattccagcacattgtttccatacgcaacagagctgtcgatctctagcagtttcacgctgcaagcataccagaaatattaacatgtaaacccgtaatctaagcaaggaaaaaaaaggtggtccgcgaaaaaatatgatgcaccatatgcacatcatcaaggtgatgatgaacaccaacctgtccatacgaccaccattggtcagtaagaagtgcctgagctggatgctaagcgacacgtccgatgacggcataccggggccaacaaccaccggcgaaacaaatattgccggctcttgtatgaaccgctttggcagagaccatggcgttgaatttacgtcgttggtgtcaggcatggtctcgggcaaaagctgccaaaaaaacacaataattgtgtaaggggaaaaaatgttaaccgaaagtagaggacgatcggacaaagtataattttaactgccatctacctgtgtatcgctgtatgaaccatcaaagcacagcacaatataagagttgactgctcctttgatatgtagcaaaaggacagatagttgtaaacttgggtaagaaaaggtttgcagttaaaagataactaccagctgtgtcattgtgataagtatagtacagagttttcctggtattagttaattttttcctttaatttttggtagattgtgctatagcagataaaagtttgtgatgatcctaacaaaaataatgaactaaagagtttagttcaaattttactcataatgatattttcttgatttctcatccatttccagtgaggttgtttatttgaaccactagcttagtggttccttgatcagtgaagttaataaatgactatcttactgcagtttgcaactggagaaaacacctcacatattgcctcagaattaaacttttggtgcgtactgtttgaccaagcagacaatccctaagtgctcatgctcaagttgatgacaaaaaaaaatgtgtccagaggaaacccaaactacgagaatatgatttgatgcaatgaagcacaagtgaactcgacgaatgggatgtttgagaatacaaccacggagaatgtaggagccccctcgagcctgcaaatctccttgattttctcgttcacttgtgtgtcgatcatgtccgtgtccggcggtagaacaaatgacggtgacggcgtgacggaaagaaattgcgaggctgcgaagtaatgaaatgtactacaaggatatcactttgctgatgtatgtataacgatataatgggtaactaattctccttacatcgcgtggtatcttcggcgtggggcagctcagttgtttcctccgtcgggtgagattgttggtcaccggcactagtagcatgttccatatgaatgccggttgaagcaactggatcaataccaatcgcacacacagcctcgacgcctagtgtgtcttcccggtgttctggcgccttggatcttgagcggcaatttcctcattgtgaggggtgcgctgtccgtgggggtggtgtgcgctgtgtcagaaccggt

SEQ ID NO: 93035 - DNA, 1310 bp, Oryza sativa
aaccgaacgacatcaccgtgaattcatacagttcgtatcgcgtggtgaatgcggtcttcggaatatcttcttcacggatggcaattggtgatatccggaacgaagatcaatcttggagaatacagtggcacctttaagctgatcgaacagatcatcgatccggggaagagggtacttgtttttgatagtaacttcattgagagctctgtagtcaacgcacatcctcttcgtcttgtctttcttttccacaaaaatcacaggagcaccccagggggaagtactcggccgtatataccccttttctttcaactcttccaactgtttcttaacttcggccagttcatttgctgccatacggtagggtcgtttgtacaggggagtggttcctggagcaagatctatccggaactcaatctctcgattcggcggcataccgggtagttcttccggaaacacgtcttcgaactccctgacgatggggatttctgacagtccaatctgatgaagttctgaacttctgacagaggttgggggtgcaaagaaaacaaccggttgttccggccctcggtacagagtgacagtgcgtctcgtgcaatccactactccttggaattgagccaaccaattcatcccaaggatcacatccaagttcttggtgtctagaagaatcagatccgagggaaaaggaatcccctgaatgtccatagggacggcagggctataatactttgctgtcataacccctccaggggtggtgatgagcagagggttcctaagcctttctaccccccattgatttcttcccacgaatggcatagatataaacgagtgggaagctccagagtcgaacaaaattgtagcagggatggaatgaccgaggaacgtaccaacgatgacgtctgaagttgtcagcacgtcctcggccgtcacgtgattcacacgaccccgaatgacatccttcccccgttgttgcagcgggagaagcttggccttgctgacgccttggctttgggcatttatccgcaaagtgcccgggctcgaagcagttgaagcacagacgctgctgaccttgagcgtccctgcggccttgaccagccggcacagttggcgtaggaggacggggcgcacgagtcccttgttgattctgctgttgctgcggctgtgggacacgcaccacgaattgaggtcgaggcgctgggcgaggttgctgctgctgttgttgctgctgcgaggaggatccccctggatagggattggtgtagcggaccctctggttagcaccctgttgattgcggaaattcgccaaacgg

SEQ ID NO: 93036 - DNA, 787 bp, Oryza sativa
cgatgtagccagccgtgaagaagatagcatcagttggcgttataacaggccagccgtgcaggcggtgacaccagtcagcggcggatgcggcggccggtcggtgaagacgtagacgccaaacaacggcagcataaaggccagccgtgcaggcggaaacaccagtcggcggcggcgaaggcaagccggtcggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcagacggaaacaccagtcggcagcggcggaggcaagccggtcggtaaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcggcagcggacaaggcagccggtcggtaaagacgtagacgcccaacaacggcggcataaaggccagccgtgcaggcggaaacaccagtcggcagcggcgaaggcaagccggtcggtgaagacgtagacgcccaacaacggcggcataataagtcagccgtgcaggcggaaacaccagtcggcggcggcgaaggcaagcctggtcggtgaagacgtagacgcccaacaacggcggcataataagtcagccgtgcaggcggaagcacca

SEQ ID NO: 93037 - DNA, 1737 bp, Oryza sativa
cggcgcggctcgggtggacggggtcgacggtgctccggcggtcggcgaccgaaacggataggtggacgaggtcggcgaggatgcggcgaagccgaaggaggcggctccgaggtgggaggtggtccgggtcgacgacggcggcggaccggagctcggcggtgacggtggagagagagagcgacggcgcgagctcgattccggtggggagagagggcggtgagtggcggaaacggtggtggggagctcggggagggtttatatagggttgggagtgagagagggcggccggaagagggggaacgggcgcgggagacccggccgccattaatggcgtcggcgacgttaggggaggggtttccaaacgaatccgggggagagagagagaaaaatggggggaaaggggagggaatcccggggaataattccccccactttattgcgcgcggggacggcgggaggcggcgggattcgcggcggcggcggcgctagggcgcggggaaggcggcgggagcggcgggaggaaggggatgacgggtgggccccacccgtcagcgagggtggcgggcgggcccgcccgtcagcggcgcgcgcgcggggaggaggccgaatgggccgcggggagaggagagggagggggaaggagatgggccgagccggcccaagggggagaggggcggaaaggactttttttagagcttttctttttataaaaccattttaactttgtttatttcttaatatttattatttgtgctctgaaaattccactaaaatttatttacgcattttagacttttaggaaatatacaaaaatcctccaagccttatttgacttttaactttgcacattttaattgttggaggctttcacacggattttaattattctatgcataatttagaggatgtattttagagtcgttttggaacgtgacatttatagacctttcgagtgtttttcacttgggtttctttatatattttttcttggtatattaaagctaaagcagtcggctggatgttttattaaacgtcacatctgctcagctacataatcactcggattggatgatatttgttgcttgactatatgtttagtttttaactaatcacatagtcgggggctacacctaattaagtgcatctagccgatgcacctgactttttctatttttcagcccttcccagtctttactcgggagatcaatgcagaaggaattgaagagctcggattatcatttcgtcgactgtaaaggtctcaggggctactatgaagattatggataacccatacctacacggcatgtatagtccgactggatatggggtgccatgtatagatagaatatctttaagaagacttgggttaaattctaaacttgtatatcaaggaaatacccaaaatcctagtcggttacgattgtattttatctgtaactatatattctgttagggatatggactgtattttgtaatacggaccccttcccctatataaggaggggtccgggtgcctctagaggcacgatttttctcctagatcatacaatcaataacacactcggcggatcaatccccggacaggagtagggtattacttcttgaataagaaggcctgaacatgtataaaattccttgtctcttaacacatccacttttccaacttgatagccaccccctttagtattgccgaaatcttgtttcgacagtcggtctcttttccttcgcccaagcaag

SEQ ID NO: 93038 - DNA, 782 bp, Oryza sativa
atatgcattctcattaatctttgctaacactttaaatggtccatcagctctaggcatcaatttagattttctcaaatcaggaaatcgttgttttcacaaacgcaaccaaaccaaatctccaggttcaaaattcaagccccttctacctttgtcacccgcaaacttatacttagcattcatgcgctcgatattttctttagttgtctcatacagttttaacattagctcagcacgttgcttagcatcaaaattcagtgtttcagaagttggcaaaggcatcaaatcaatcggagcacgaggcaacaaaccatacacaacctgaaatgggcacatctttgtagtagaatgcaaggaacgattataagcaaattcaatatgaggcaagcattcttcccacatcttaatatttttcttcaaaacagccccaagcatagtagacaaggttctattcaccacttcggtttgtccatcagtttggggatgacaagtagtagaaaacaaaagcttagtccccaattttgcccacaaagttctccaaaaatggctaagaaatttagtgtcacgatcagaaacaattgtgtttggcataccatgcaagcgaacaatttctcgaaagaacaaatcagtgatatgagaagcatcatcagttttatgacatggtatgaaatatgccattttagaaaatctatccacaaccacaaaaatgctatcacgccccctcttggtcctaggcaatcctaacacaaaatccgttgaaatatcttcccaaggaacagtaggaa

SEQ ID NO: 93039 - DNA, 954 bp, Oryza sativa
aggtcactgcagtgatcctcgctggctctcccgagcggatttctgtggcagtcaccgcgggtgagaattccttccccgccgcttgcaagagcgccgctctcctcgcaatgggcactcttcaccagcgctacccggacgagttgcagcactcgccctaccgctaccaccctcgtcgcggaggagcccgcgactacgccaccttccgagatgctagctcggaggatgacgctaccatcgtacacctggcgcgcatggtggaggcgtacgacgcggctcgtatcgacttccatcagatggtgtgccgtgggatggtcgagaacaatctgaagatcctggagctgcgtcaggagaacctgcagctcaagaaggacttagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttccgccctggcccgtcgcagcggtagacgagcagttagtaggcttgcgcgtgtgttctttctcgtttgtcttcttgttggagttgtgtggggcatggttatgccggtgtgtggcataactatgtcggagcccgtctttatttaatttgcctaagcaacttgaacttcaatgaaccaatttaatagcagtaataaattcaagatttatggtagtcgtgggtggttagttttaattgtcagctctctctgtttgctagtctgtgtggggttttcagatggtgacgaccaggagaaatgctaataccggtgatggcaaccaacctgaaggcag

SEQ ID NO: 93040 - DNA, 9328 bp, Oryza sativa
gtcattgtctgcagaatctagacaagtcttacaccaatccaagaaaatgacctcgtgcttaattgggaaaagtgccattttatggtctgtgaagtgatagttcttgggcatcaagtgtccgaacgaggaatcgaagttgatcgtgctaaaatcgatgttatagatcaacttcctcctcctgtgaacatcaaaataatccgcagcttcttgggtcatgctggcttttatagaaggttcaccaaggacttgtctacaatcaccagacccctgaccaatctgctagccaaggatgcaccctttcagttcgatgacgcgtgcctaaaatcttttgaagttctcaaaaaggcactcgtctccgctccaattattcaacctcctgattggactctgccctttgagattatgtgtgatacaagtgacttcgctgttggtgagtcttgggccaaaccaaagataaaaagcatcacgcaatctgttacgctagcaaaactctaaccggagcccagttgaattatgcaactactgaaaaagagctgctcgaggttgtttttgctatcgataagtttagatcttacttagtaggagccaaggtgataattgatactgatcatgctgctttgaaatacctgctcaccaagaaagatgctaaacctcgtctcttaagatggattttgctgctccaagaatttgacttagaaattaaagataaaaagggagtagaaaattccatagcagatcatttgtccaggctgcagatcactaacatggaggaacagccgatcaatgatttcttaagagatgatatgctgatgacggttcgcgactccaacccgtggtatgccaacatagtgaactacatggtatccaagtgttgatgtaaaaacacgaggcctgggagatctgcttaactccagtgcaagtccaaaacttgccttcgggtatgctagcgtgacagttgatttgatcctgcaatcaacaagaacaaggacaaagaaaccgcggttaaatccataaacgatagccgatcggccaggtgccgatgacatatcatttatcttcgagccgatgtcatatttgcatcgatcggcaggcattaataaataaaacaaaactaaatctactcgatcggctgtagatattaatgatatataatccttatatcgatatatacttaaatcaagtgattgggatagatcagtcgccatgccgagacagtataaatcacttagatcgaagtatatattaataatgagattatatatattcgtaacatagccgatcagatagatctagcatgtatcggctaatactctgatactgctttatactaagatatcaaagcaaatagaatatatcaaacaaaggcctaatatacttaaatgcaacaagatcttaacataaagggcagattcaacatatcaatgaagcacatagggtaaaaagtagttaaatcaggtaagatcggctgaaaccccaatgttaccctaatcggcaaccaagaagcaggctagaaattgagattctaatcacgacttataggatcaaactgaactgatgtagctataagtatgaaaaatagcacaatatctagacaatcaagccgttggatgtgtcatagagtggtagataccttatataatctaagccaacatcaatatttaacagaggttagccaattatagggtagatagcgatattgccagagattatgtaagatatatgataactcgacgaattacataaacaagattagagtgtcatgaagatggaagcactaatcccgagaacgcaagccgccataacaagttttacctcttgttgaagatcgaaaccgatgcagctcaacccaaaagcaagaactcgtcgaaacaaaacgaaagtaaaatgggtggcgatgtgctgagattgtattgaacgtgtgttaattcgattacatgggggctcggggtctatttatacacgagaattacaaaacatgtccatatcggacatgactcttatctctaacaaactctaagataccataagtctttgcagcagacttttgcccaaacatatctctaaggaaattacataaaatatcctaattaatagatacaattgccttcttaggactctatccatgtgtggcaatcatcttgaaacatatcaactcaacctgatgatgtataccgagttgtattgtcggaatcgactgtatcggcttacctagtctgactcggacacagccgatcctgatcgtagccgatttggactctagccgattcttactctgtttttgaaatgatcttcgtctttgattccgcctcgatctaatcttcatctccaatgctgatattaccaaatttggtcgataacaccaagtacataccaccaggggaaaatcaatgaaaactgaagtatgaaagtcgccgtcacatatgggatgagccatacctatatcgggtctgctccaatggcctactacgaagatgtgtgccaactaaagaaggactggagatcatagaacgatgccatgcctcaccttatggtggtcattacggtgcattccgcacccaggccaagatttggcaaagtggtttcttctagccaacaatgtacgaagactcaaaagaattcgtcagaagatgcaccagctgccagaggcaaggaggaatcactgctcgcgatgcaatgcccctcacatacaatctgcaagtcgagatattcgatgtttggggtatagacttcatgtggcctttccctaagtctcgcaactgcgagtacattctggtggcagtcgactatgtctccaagtgggttgaggctatgccgtgcagcgctgcggatgcgaagcatgccaagaagatgttcacaaaaatcatcttccctagttttggtacccccagaatggtcataagtgacggaggttctcacttcattgacaaaacctttcgagacctcctacaagaaatgagagccaaacacaatgtggccactccttaccatccacagaccagtggacaagcagaaacatcaaacaaacaaatcaagaatattctgcaaaagacgatcaataaaatgggaacaggatggaaggatagattgccggacgcactgtgagcatactggacagcatacaagacacccattggaatgtccccatatcagatagtttacgggaagccatgccgactacccgtaaaacttgagcgcagagcatactgggccattaggaattggaacatggattttaagcgagctggagaatggagaaaaatgcagatcgctgaacttgaggaatggagagaaaaggcttaccacaacgcaaagatatacaaagaaaggacgaagcgcaggcatgacaaaaggataaagatgaagaaatttaagccaggagacaatgtactaatgttcaactccagggttaagctttttggccacggaaaactgcgcagcaaatgggaaggaccgttcgacgtcatcgacacctctttgcatggggcaatcacacttcgcgacgaataaggtaacatatttaaggtaaacggtcaacgcctaaagattttccttgagccaaatgaaactttagatgaagaagtggatgttactgaattaatttattatgaaccatgatgatctcatctattgcatgcttaaaaccctgtatagttgtcatttttgtacttaaaataggttttagtgggcctatgaaaaatttggtggcatgtcgaacccaccattgttcagccgaacatgatggttcggccgaaccagggcggcgcccgatcagccccaattttgaacctcagtctcccccgctcgtccctagtctatttagatgcgtgtttggaggtagaacgttcggatcacaccagaacactccttcctcttttcctccacatttgcacactctcctctccaattcaacacaattcctcgaatttccactcatatccaccaatggctggcaaatccctaatcccattcatcggcccttcctctaattccacttataacctcaccggagagccgacaccagcgaatcaattgatcccgatggaagaatacaccatggaaggggtaattgcacagtgggagcagcccctcgcagcagtgctgggctcccctgcgaatctggagcccgtcggcgagctccttggttcggccgaacccttctcggccccaatcggcctcccgttcggcagcgcgatccctctcccctcgctatgttacaagaacaaaaatccggggggattcgcctgcacgacggccgactacggcagaactcagcttgttaaaggcacgatgtcttttccaagatgacgggaaggccgcaccgcctcccgccgagcgctatgtgggcgccctcttcaccaaggcaggggatgaggtgctccacaagtataccacacccaccgctactccatccaccccaaaaggggagcgtttctgcattcagggagtgtgaactcccggcggtgggtatggcaaaggtttactccggcctttgatggcatcggagaaggagagggcagcggaatcccgtagccttccacctaagaaggtgaagtatcgtttgacgccccctccaattgtgagggctctcggccaattcctagaggatgaggtgaagtcaccggagccctcgatccacaagctcgccgctcaagtgaagaaactccgcaaggagaacgtagagcttagggattgcaatgcggagctaggggtagaacttgctgaaattagaaataatttcgatatccttagtcgcggtttgtgcgctaagatcaagcgtgcgttcatagagatgggaaaggaaaataagtattatgctaattagatgtttcctttcccatgaataaaatagtagtaggtgcttagttttatttttgcaatcatgtaagcacttgctatgaataatgtggcacattggtgtttaccccaatgtttgccaaagtttgttttttgtttaataaaattcaggttttgaataagtgtgggggcgatatcccagcttctgacgtgcatatgctctgaaaattgttgaaatatctgaacacctggaagcactcaactctgcagaaaattgcagaggaatcgggcaccagagtggttcggccgaactaccaggttcgggcgaaccagtgctggccccagtccctctcatcttcacaggtaagcaggtgagcacgtcctttatctgtatatctccaccatggtatagtactagagctgcaaatttagaaacaattggttcaagcataagtgaaagataaaatttccaactattgaaattcttcatgtgattgatcttttatattcattattctcagctgaatttgtgcttgtgaacaccatccatgtttagggaaccttatacatctaggtaattgctttatgtgagatgattaagatgaaaggactccttgtaactttgttgtgactcttgggaatttgttttcaaaaataaactgttttaaaagctctatcctccaattgactttaccttatacctaccaaggccatatgcaagcggcggggaaggaatctccacccgcggtgactgccagcgaagtccgctcgggagagccagcgaggatcactgcagtgacctcccaaccagcgtggggctctgcgtcgtcaccctcctgctccggaagcggcctggcctggtagtccactccatgtggataccccaggacaacgcacataccccgcagctccaagacgaagccagtcatgtccaaaccacgacgggtgacgctgccggccatctacaaacaaaaacaaaaaggaaaacaacattttaaagatcagattttggcgataaatgaagcagcaagacagagagagactagacagttttcacaaataacaaagaatttttatttcgaaaatactgctaaggcttgggatctaaggctagtcctagggtcaagggggctctgataccaacttgtcacgaccggaactaacccaacgggcgtttccttacgtgcgtgcattaatccttgtcccaggaggcaaggtacaccaaaagttgatacaattcagagtttaacaagcggacgcgtaaatagttaacttattacatggccagcgaaggcccagcacacacagagacaaacgaaaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggagttataatataaagggttagggttgcagtaaacagcatttaaagatatttagttgctcaaagctattttgtaaacacgattctagaactatacaatgttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacctccgggacaggcaggcaggactgagcccctagcagcaggacaccggccctgtgccatgacatctcgactaccgggccgcagctcgtgtagccttcatttgccctggagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagaaggagcggtgtgaagccaattccacaataaccaaaccatttcaaagtgtccaggtgatatgaatattcccaaagtctagagttgaaaaaccacctaaagttgcctagttaaaagcgaagcatctacctaaaatcatactagggataccatgagtagagtgtccactagttggggttttgtttattctagggtgatcaaggtaataataacaataacaataataatagggtcataacaaaggtaagtaggcatggctaaataaaatagtgataacgcgggaatttaaataaagcgataatgcaataatttaaatcaacataattttacaaaccgggattcaatatgttcaaagatgatgtgacttgccttgctcgctttcccaaacgtcggcttcaacttccacgaagagcggatcttccgaagctgcaacgtctacacgaccaacggaaaagaaaaggcttttactctaataaactccatataacaagcagaaacaaagcacaaaaatgggttcttgacttcttaaggaaaaattagaaacttgaacggtccaattccgagttcaaatggccaagttatggcatttgacgtttatatgctctttaattgaatatttgcgaatttcttcatttaaattttcaatttaaaatcagatttattgcgtcagccgaggggaggggcgcgcggaccgggtccacgggagtggggcccacgcggcagcctcacggtccacggtggaccgggagcacgcggcttgcgccggccggcgccgtgggtcccacgcgtcagccgcacccgcgggcgcgggcggctgacggccgggccccacatggcagccacggggcgcgcccgaaggtgacctcgccggcacggccgacgggaggcggcgcgcccgcgccccgatggtcgccgccggcgaccaccgacgcggcggagcggcgcccgagagaggggagggaagggggaagcgaaagggtcggtccacggctcaccccgggtcgacgaggacggcggaaacgacgaccggagcggaggaaggcggcggcgcggctcgggttgacgaggacggcggtgttccggcggtcggcgggcgaaacggaggagtggacgaggtcggcgaggacgtggcgaagccgaaggaggcgatgccgaagcgggaggaggtccggggcgacgacggcggcggaccggagctcggcggcgacggcggagagagaaggcgacggcgcgagctcgaatccgacggggagagagagcggcgagtggcggaaacggtggagggaggcacggggagtttttgtatagtgttgggagggggagagagcggccggatgagggggactcggccgcggaagatccggccgccattgatgcgccggcgaagtttgcgggagtgtttccaaacgaatccgagggagagagagggaaaagtgggggggaaagagagagggaatcacggggagtgatctccccctctttattgcgcgcgggggcggcgggatgcggcggaatccgcggcggcggcggcgctagggcacgggcgaggcggcgggtgcggcgcgaggtaggggatgacgtgtgggccccacccgtcagcgagggtggcgggcgggcctgcccgtcagcggcgcgcgcgcgggggaaggccggatgggccgcgggggagaggagagaggggggggaactgggccgagccggcccaagagggggagggggggaaaaggactttttagggtttatttcttcttaattattatttgtgctctaaaaattccactaaaatttatttacgcattttaggcttttaggaaatatacaaaaatcctccaagccttatttgacttttaaatttgcaccttttaattgttggaggctttcacatggattttaattattctatgcacaatttcgaggatgtattttagagtcgttttgggacgcgacaaacctaccccccttaaacggaatctcgaccccgagattcggaaggactggcgaagagatcgggatgggctgccttcagctcgtcttcacgctcccaagtagcttcttcctcggcgtggttgctccactggaccttgcaaaaacggattacccggttcctggtcctgcgctccatggtgtccaggattttcactggcctctccacgtaggtcaagtcttcgcgaacttcaatttgctctgagtcggcctgctcggatggcactcgaagacattt

SEQ ID NO: 93041 - DNA, 647 bp, Oryza sativa
tctacaaaaatcacaggagcaccccatggggaagtactcggacgtatgtaccccttttctttcaactcttccagctgtttctttacttcggccagttcatttgctgccatacggtagggtcgcttgtacagaggagtggtcctggagcaagatctattcggaactcaatctctcgcttgggcggcataccaggtagttcttccggaaacacatctccgaactccctgacgatgggaatttctgacaatcctatctgatgaaggtctgaacttctgacagaggttgggggtgcaaagaaaacaaccggttgttctggccctcggtacagagtgacagtgcgtctcgcgcaatccactacttcttggaattgagccaaccaattcatttccaagaatcacatccaagttctttgtgtctagcagaatcagatccgagggaaaaggaatcccctgaatttctatagggacggcagggctataatactttgttgtcataccccttcagggtggtgatgagcagagggttcctaagcctttctacccccaactgattttctcccacgaatgcacagatataaacgagtgggaagctcagagtcgaacaaaatgttgcagggatggaatgaacgaggaacgtaccaacgatga

SEQ ID NO: 93042 - DNA, 1095 bp, Oryza sativa
tgttcatcctctgtgaaaccagcagctttatcctgtttcatattcttgaggagtccatgcatgtccggatcattcttctgagcctcgcggatttgatcgagcaaggtaggcttggcttccaacgcagccaagaatccacgaccaactatgcttaggttcaaggcttccatctgttgactaagttcgggtggaatgccacggacgttaagagtgttgcaatggctctttcgacttagagcgtcggcaaccacgttggccttaccaggatgatagtgaattcccacatcatagtctttgatgagttctaaccatctcctttgccgaagattcagatccgactgggtgaagatgtatttcaaactcttatggtcggtatatatttcacagcgattcccaatgagatagtgccgccagatttttagagcatgaaccactgcggctaattccaagtcatgggtagggtagttgccttcatgcggtcgaagctgacgggaggcataggctaccacatgaccatcctgcatgagcacgcaccccaatccttggcgcgaagcatcacaatacaccatgaagtccttgcgagtatccggcaagattaacaccggcgaggaaactagcttttccttgagagtttggaacgccttctcgcattacgggctccacacaaatttctcttctttcttcaacaaccgtgtcatgggtcgagcgattctggagaagttctcgatgaatctccggtggtatcctgccaaacctaagaaactgcggacttgggtaactgtcttgggttgcttccaatcggtgacggcggtcactgtttcggggtccacagcaactcctttagcagatatcacgtgccctaagaatttgacttcggacaaccagaactcacacttgctaagcttggcatacaattgatgttcccgtaactttcccaacaccagacggagatggtgctgatggtcttcctctgattgtgagtatatcagaatgtcatcaatgaaaaccacaacaaacttatccaagtattccatgaacactcttgttcattaagttcatgaagaaggcaggtgcattggtcaaaccgaacgacat

SEQ ID NO: 93043 - DNA, 779 bp, Oryza sativa
agcttcttccaaaagtgagaggtgaattggcttcccctatcagatacgattttcttgggaacgccatggagactcacgatcctagcgaagtagagttcggctagcttgttccctccataggtggtcttcacaggaataaatcgagctaccttggttaatcgatccacaactacccatatagaatcatatccaccttgggtctttggaagtccggggatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccagtatttctccttcaagtctaagtacatctttgtactgcccgggtgaatggaataaggactttcgtgagcttcctgaagtatcagctgtttaagttctctgttatctggaacgcatacccgctttccgttccatagggttccgtgttcatcctctgtgaaaccagcagctttatcctgtttcatattcttgaggagtcatgcatgtccggatcattcttttgagcctcgcggatttgatcgagcaaggtaggcttggctttccaacgcagccaagaatcacgaccaactatgcttaggttcaagcttctcatctgttgactaagttcgggtggaatgccacgacgttaagagtgttgcaatggctctttcgacttagagcgtcggcaaccacgttggcccttaccaggatga

SEQ ID NO: 93044 - DNA, 1746 bp, Oryza sativa
aagggggaaaagaggacttcttttagggtttttctttttataaaccttttcaattttgtttatttcttctcaattataatttgtgctctgaaaattccactaaaatttatttacgcattttaggcttttaggaaatatacaaaaatcctccaagccttatttgacttttatctttgcacattttaattgttggaggctttcacaggaattttaattattctttgcacaaatttcgaggatgtattttagagtcgatttgggacgtgacaaacctaccccccttaaacggaatctcgaccccgagattcggaaggactggcgaagagatcgggatgggctgccttcagctcgtcttcacgctcccaggtagcttcttcttcggcgtggttgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcggagacatttcttgagttgcgacacatggaacacatcatgcacgttgcccaaggaagcgggcagctccaattggtaagcgacttctccgcgtcgagcaacgatacggaaaggacccacataccgaggtgcgagcttccctttcgtctgaaacctgtgtacacctcgcaatggcgtgacccgaagatacacaaagtcatccactgcgaattccaggtcacggcggcggttatctgcataacttttctgccgggactgtgccacctttagattatcccgaatgattctgactttagcttcagcttctctcaggatatcagtcccgaacacttggctttctcctacttggtcccacaagagtggtgtccggcatttgcgcccgtacaacgcttcataaggtgccatttgtatgctggattgatagctgttattgtaggagaactcggcataggggagactcttatcccaggtcttcccgaaatctagtacacatgcacgaagcatgtcttctaggatctgatttagacgctcggtctgtccatctgtctgcgggtgataggcggtgctgaaattcaatcgagtacccagttcttcttggagcttcttccaaaagtgagaggtgaattggcttcccctatcagatacgattttcttgggaacgccatggagactcacgatcctagcgaagtagagttcggctagcttgttccctccataggtggtcttcacaggaataaatcgagctaccttggttaatcgatccacaactacccatatagaatcatatccaccttgggtctttggaagtccggtgatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccagtatttctccttcaagtctaagtacatctttgtactgcccgggtgaatggaataaggactttcgtgagcttcctgaagtatcagctgtttaagtctctgttatctggacgcatacccgctttccggttcataggggtccgtgttcatcctctgtgaaaccagcagctttatcctgttcatattcttgaggagtccatgcatgttcggatcattttttgagcctcggggaattgatcgagcaaggtaggct

SEQ ID NO: 93045 - DNA, 590 bp, Oryza sativa
  unsure (1)..(590): unsure at all n locations
cattcttttaaatatgaatattgttcgaatcatcaaaacgcaatgagcaaaacgcctaggagaggagagtcgcctactttgttgcgctgcacgcggcggccaccgtcttgcgccagttgagcagcacgtcgacggcgacgtaatgcgtgacggtcccgacaagcacgagcacgtggaagatctggtggctgtggccgacgacttttgagacacccggtcgccacttatacggcacgcgggtgacgtagaaccaagcgactgcggggtaagcgaggcccatggtcacctcaagctatagcgccaggtaagaggcggtgtggacccagatgagccacagagcgtgcagcgcccgtacgtacccgtggagacccatggggaggaacagcgcggtgcggagactccggaaccgttgacactagcagggtggagagagcatctcgccttctacgagcgcgctcagcgcctagatggcggagaggtatgccacgcgcgccggtcggtgtgacatgaaggcgtagtacaccggcgggactaacgaggcgacgatcatggcagagatgacacngtagtcgagctgtcagacaccacgc

SEQ ID NO: 93046 - DNA, 2673 bp, Oryza sativa
tccggttccggtgtggcagcatcggccgcccccggatccgctgctcagacagggcggcgtgacaggaggaggaagaagaggtcagcccataccgacgacgagggtcatctcctcgccgtcgagggcgcttcgcgggccacccgaaaggggaggcctgcgagcgacaaaaagaaggaagccgacgctccctgacctcggctacttggaagagcgaaggtggcgcgcggcccttcgagccgcgcgcaaccagcagagcctgcggcgctaccatcagcgccacgtccgggcccgatcactctgcgtcgacgacctcgtcctacgccgtgtccaaacgcgtgctggactgagcaaactctcaccaatgtgggagggtccgtatcgagtgatcggcgtcccccggccgggctccgttcggctggccacgggcgatggcacagagctgcctaacccatggaacatcgaacaccttcgtcgcttctacccctagtgggggtcgggtgtcaggtcttgggctcgggccaaccccgcacccccccgggtgtgcagggttggccgggggcttatcttttttctcttccgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccgggacgtggtgaactccgggggggaatcggcaaaaacccacaatcgggtcacccataaccctcggtcaccacgctcccggcctggccagtctcgacatgtggatctccccaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcctataacaagaaggaggcccgaaggcctcggaagaagaaggaaaagaagaaactatttaaagattggcgggggcctgggggctcactccgatgcacccgggtcgccagcctcgtcgccactgtcggttttcccttgctgatgcgcgcgatttgcgaccgccgggattctgcccgaagagagagagagcagggaggagaggcccccgagccgaacggcggcccaaggcccccgacggccggagctggctctccgcctgcttgtccgacggtgccaggcgcccccgacccccaggatggccccgaggccactgcgggaaggccgcgcctgtcgccctctgaccccgaggtcgtcggcacagaagccgagtgcgctccgcgtggcctctcggatggagagcgccgtggagatgtggcccctgacgaagaagatcggccccgccgaaaggtgcagcggcccgtctacttcgttagcgaggccctccgggacgccaagacccgataccctcaggcccagaagatgctttatgctatcctgatggcttcgaggaagttgcgccattatttccaggcgcatcgggtcacggtggttacgtcttatcccctcggccgaatcttgtataaccgagagggtactggacgggtggtgaaatgggcaatcgaactctctgaattcgatttgcgctttgaaccaagccacgcgatcaagagccaggccctcgccgactttgtggtggagtggaccccaactcccgagctcgtctccgtccccgaggccagctcgagcccatcgcagctgcctcacaccgccctctgggtgatctagttcgacggcacctgtaggaaccggccccacctatcaccaggccttagaagtggcgtcacgcccgaccgcttccctcggggagggcgatcgccctggcataacgccgggggctactgtcggtgacatgggaccgggagtatcatgactagaggcttgaggcagacacaatcgcccacgtggcctggcaccctcggggggcgtcaggcccgagggtgatgtgttcgccctcctctttgtctccccgagggggtcggaccgctcccgcctcggccccgagggccgaggcgccccgaccccttgtgggttttgcgccgcgtatatgaggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacattggtcccggtcagatatataccaggcttcatcctaaccattacaagcaagacattgtatgaagaggggcgaacatgcagattgataaactgacgcgtggtggacaagaatgaccgatttgtgactggtctgacactggtcatgtcgtcagcagacagccatgttcccacgtcgcgcctgcttccggcggaagtggaggtaggtatgggccgtcccatcagaaggtcattcggacggcaatcatacaaatctccgtccatttat

SEQ ID NO: 93047 - DNA, 3653 bp, Oryza sativa
gaaatagtaggggtggttgaacaaactacacaaaaatgccgcccatgtttttatgaatatatgcagaaaaatttggagacttgatggggactctcatagtctcacactgggtactactggagaaatgatctttgctgggtcggctgattttcacaatagtctcattctaataaaaaccaagactaaagattgtttttagtcccggttggtactacaaaccaggactaaaatgtttttttagtcccagttggtaactccaactgggagtaaatatttctctcccatctctgatagattaagtctcagacgaaatatttagagataagatcgtccctctccaacccccctcggatatcgctgttgatgaaaaaatcgaacacaccgacctgggagatctgcttagctcctgtgcaggtccaaagattaatgagatacgggcgtgccagtcagtttaatcctgcaactgacaagatatgcaaatagtagatcaaaacagcaaatcggctgacaagccgatggtgtagttccagccgatagccgataatagccgatgctaataccagccgatagcgatagggttaagcaatcggctatatgtccaatgtagataatgatataaaggcaatcggctgatgaccatgtaatgaaataacaatatattccagtataaaccaatcagcaaataatgatatgataaataagcatcgatccgaaggtcaaagcacacatcggctggaggtctgatgtcatgaaatccacaagattagattaaacagtgaagcctttgttgtcatcggctaaatccaacttatatgtatatgcaatccttatgagccgatgcaacgtccagataactcaccggctaaaaccccgatgaaacccttattggcaatcaagaagcaggctagagattatggttctaagcacgacttagtagatcaaacttaactgatgcagcactaagtatgaaaagaaacataatatctagacaatcaagccattgactgagttttcagggtggtagatgtctaagctaatctaatctagcaacgcgatttaaccgataccgacagaaaccctaaaacgagaagcagccaatagagctaaattgatatgctaagattagattaacagagacatatgataaataggtaggcaagtatatcatccaaaccagagcaatccaagaggtcgaatgtactgatgtagccttgaacgacgccgacgtaaacgatacaattgcctgggccggcggaacattagacttatcccttcgccggagatcgaagacgatgcagccccgcgtcgggtgccaagttctgccggaacgtaaaataaagtagaaaaggtaaaaggtggcgatgcaccgaattgtattgatcgtggagatagattacatagaccccgggtgtacatatttatacccatgggttgatacaagtccttgtcggataagaaagaaactaacctaaagataaaaggaaactaacaaactattcctaattaatagataaactgccatgccacattctctttaaactcggtcacttagggataagcttcctttagtagattgatttccttaaccgaatatagtaggaacccgactattggcgacttgataactcccattggctgatttcgagatgctgcagccgataatgattctaagccgatgacgtctttgccgattaccaaattttactgttatcaatcgcccctctctaactccctcagatccgatccaagcctcctcctcccctctactccccctcctcccctcccatccggcggccgacaggtggccagcgccgagcaggtggcctgtggccgggggggcgggcccggtggcggcgggcaggcgggcggtggtcgtgccaggcggcgccgagcaggcggctctgtaggcccgcgcggcgggggggggcgtgcccgacggcggtgagcagacagacggtggccgtgccgggcggcgccgagcaggcggcctggggccgaggtggccgcgcgtggcggcggctggaagggccgcgcccagcggcggcgggcaggcggccggcggccaacggggccgtaggcgtcggccgtggcgagcggaggcagccggctttgttttctttttatgtatataatatgtgattcattgagatgtataatttgattattcattgtacatttgtatagatctgaaatgtataatctgtgatatattagatttgtttggtattttttttaggatttgtgatgtatttgatttgtgtgtatgagtaactttaagatttgtgatgttactttgatttggggtttgatttcaggatgtgcatgccacttgattaaggagaaaaaaaaagggactatctggactgcccgctaccctctatttagtcccggttgataacaacaaccgggactaattgttgttatcaaccgggactaaagatggatctttagtcccggttatttcaaccggattaaagatggatatctttagtcccagattcctacttccggttggaaatccgggactaaggagggttaccaatcgggagtaaaaaggtttctccaccagtgagggtctcgagcccctaccgctcccatggcagatccgttaccattgtccagatcaatatactgtcatttgtgttgcatacgttaagtgaataacatcactaccgctctagatattttttagataaaggctactgtggtagatatgagtgatctgaaatattttcaccataattatttcatctgttcacaaatataagcatttatagagcctttttaaaaataagattttttctaaaaaagactataataacaaccctctccccaccccagttcaaatgaggttttatctcatagctaactctgaatgcaaatctatcacagactttaaatcgatcaacatgatatcggtagacaaatgacgaattcttcttagaagtgttgttacgaggagtgcttcatagactttgagattcttcctagatagttgtagtggtgtaacctgtcacaaggcaatataatatggtcgtgttatctagttttttagcttgatgtaaaggttgaatgttttcattgttaaatgaaattttccactatctttttgaaaaaagtattataaaatatggtgtatgatgagaatatgtgtaggctactacaaatatagataggtgtggttcgatctcataatctttatagtggtagagctaaaatgaaatggatgaagtattactggtttgctttactttgcattggatcgagtttaggctatgcgagtgcttgagtttagactaaggagatacatatatgataaaaataaacgatatgtagctagaaaaaaaaactctaggccaagttactaaacaccctcctaaaaatatgtagctgaacccctaaatccttggtctataatagttcacccagattaatttaactttacatttaaataaataaaataaaagttaatagttagttctctcaattgaagtaggcaagggggacgaggctcctttaacgtaagttagagggaagtgtgtcgctgacttgtgagcctataagtgtaggtccacctgttagggactcacgtctctctgactttatgttaaagaagctgttttcggaccaagggttacaggttaccaggggcg

SEQ ID NO: 93048 - DNA, 625 bp, Oryza sativa
tcctgcagccccggttcgtgtcggaggacggcgtgatcaacgcgcggccgcgggtgctgggcggcggcagctgcatcaacgccggcttcttcacgcgcgcggggcccggctacgtgagggccctcgggtgggaccccaaggaggtggtgagcgcgtaccagtgggtggaggacgtggtggcgttccagccggagctgggcccgtggcaggcggcgctgcggagggggttgctcgagatcggcgtcgtgccggacaacggcttcacgtacgaccacatcctcggtaccaaggtcggtggctccatctttgacgcgcagggacggcggcacacggcggcggacttgctgcgttactcgcgccccgacggcatcgacgtgtttctccgtgctagagtggccaggatcgtgttctctcgcaaaggtgaggccatgtcacccataatttataaaaaccacatttttcttgttcaaaagctcgtgttaccaacataccggtaagtttgttaattatcgacggcaagttaattgttgtggcacttgcacccacttggtgccgctgccctgtactgccatagtagttcgcgcgcactgaaaacccgcgagatttgcagggaccaagcccgtgg

SEQ ID NO: 93049 - DNA, 2353 bp, Oryza sativa
gtcgcagccgccgccgccgccttgtcgcccgccgcctactctctcgcctctccccggcatcgtctgcctcagccgccggccggcttgccgcctcgtcgccccagccgccgccccagaagagaagagaagagaagagaagagtgagagagagaggagggagagaatagggaaagagagaggctgatgtggattgtctgacatgtggggcccacgtggttcccacgctgactcagctgccacgtcggacaaaaccggtgtcaaaaccaccgagggaacggttttgttagttgagggatgccggtatctggttttgcgattgggggacgattttgtatctcgatgacaagttgagggaccttgggtgtactttttcccagttcacttgacagctcgcaaggatccatatgacaagaaggccacgttttgccatggcgggttcatctcgtttggagatgggcctctgggcctcataggccgatacccgataggccgtagcatctccgggctgtgaattattcggcccataccatgcgatacggcaatgcacactgcacgtttgttccttccacgaaccgatcccctcttcctggcaagtcgcaacgccgccgaacggcacgaagctctccaatgccgccgctgccccgcccaccgccgacaccgacctcggccgcaccagctccgtgccctcgccagatcgccgccgtcgtgctgaaccacccttcgtccgccctcacgccggcctcgacgcgctccctctcggcgtccctcctcgccgtcgcgccgtcgctcccgacccccgtggccgactccgtcctcaagctcctctggcaccacgcgccgcgcgcgctcctcttcttccactcgctcctccacctcccgccgcgcgcgcacgccgtgggtccctccacgctcgacctcgcgctcgacctctccgcgcgcctccgccgcccgcgccagctcaccaactccatcctcggcctcttcccgcgccaccgcctcgccttcaccccgcgcaccttccccatcctcttcgagcgcctcgccgtgtcgcagcgccgccccgacctcgccgtccgcctcttcctctcgctccaccgctcccaccgcgtcgcgcaggacctccccctgttcaactccctcctcgacgctctgtccaagtcgcgccacgccggcaaggccgcctccctcgtccgcgctcttgagcagcgcttcacccccgacgtggtgacgtacaacacgctcgccgacggatggtgccgcgtcaaggacacctcccgcgcgctcgacgtgctgcggctgatggtcgagtccggtattgcccccacgaagaccacctataacatcatccttaaaggcttcttccgtgctggacagctacggcacgcatgggacttcttcctccagatgaagaagagggggagtaaagacgagagctgtaagcccgacgtcgtctcgtacactaccatggttcatgggctgggtgttgccgggcagctggagaaagctcgcaaggtgtttgatgaaatggctaaagaagggtgtgctccatcggttgctacctacaatgcgcttattcaggtgatctgcaagaagggtaatgtggaggatgcagtaacggtgtttgatggtatgcgtgttaagggctatgtccctaacgtggttacatacactgtgttgatccgaggcctctgccatgctgggaagattgaccgaggtttgaagctgttggagaggatgaagaatggaggctgcgaacccatcgttcagacatacaatgttcttataaggtatttatttgaggaaggggagatggaaaagggtttggatttgtttgagaagatgagtaaaggagaggagtgcctgcccaaccaagacacatacaacatcataataagtgctatgtttatgcgcaagagggctgaggacatggtactggctgcaaggatggtggaagaaatggtggatagaggttatctgcctagaaggttcatgttcaaccgtgtgttgaacgggttgatgctgacagggaatcaggagctttcacggaaactcttgagaatgcaagagaaatatagacgtttgcaacgagaaataagactgtaattgacatttgatgttctcgaaacatttgagattatgttcatcctgaggcttagttacagaagtgaattcttgccttcagagcaccatatcagttttaaaagtactcataggtggtcctatgatgagtccaactgcaaatatcacttgattattggtatgtattctgagtctgaacatgaaattcactcaattgtttgagtataacagttagtgttcttggttttatcttttgtttcagtctttgagcggg

SEQ ID NO: 93050 - DNA, 1093 bp, Oryza sativa
ttggggggtcgtgccagtcgccctaaccggactgccgtgccattgagtgagcgaacaatacccccaaacgatatgccacacgactatgcttctagacgtcgattcccacaatgccacaccaccatgctcctagccggcgagctcctatcaacatgctagatccaggcgacttccgaagaaaagagcatcagatccacaggagctccgtcatcaccgtgttaagccttggatggatgagaaagggacccgccacgccaccgtccttgcacccacgcggaactccggcggtatgctcgggcggcagagaggtcgaggaggggtcgatgagttcggggtaaaacaactgcacgatatccctatgatctgcctgccaaccgttctctggagtagaatgttcacatggtttggaaggtgaaaaaaaatgtagagaaaacgcctgatcaatcagcgttgcattgcagtttgcaaatcaaagccggcattgtcgcgataggcgtcatgctcagcgaagtggagtacaacgatgcacccgatcaccgtttccatgcgtcaagtgagcagcacagcagcagcagcagcgttgcctgcgacccagcgagtcatgcagtgcgagtcgggacttgtcgctgggccactgcaccacgcccagacagagagcagcatccaatgcctcactctgcccgagccactgactgacaaggtcagtgcatgcaggctgcagctgctgcagagcgctctctttctctctccccccgcgcggccccaggacacgcccctcgccggggcccccccgtcgcccatgccaccaccaccgcggccaccgccaccgaggcaggcgcgctccccacaacccaaccaaagaaaattatcgccgcacctgccgcctgcgtcgtgtgtcgccggccatcacgcgacgcacgcacgcacgcacgtctacaggcgacaaccgctcaaactcaacaagtactctacctctactccaactacaagcatcgcgtgccatcgaacacggtgagaattgttttggcttcaaaagttgcgaggaaaaaaagagttacaggacatgacataatccctgcggatttgggttttc

SEQ ID NO: 93051 - DNA, 4518 bp, Oryza sativa
attagtcccattaattcatccaatcggctagttgtcgtgacctttacagaaccaatgatgcatattgttttctgtgtggaagaagaatcctcttttgcatggattgtaattctcatttgcacattgacctttgcacttatattagtctcatgtattctttcaacacctaaaagttttatcataagtatttcatttgcccatacattgacctgctaaaaacctatatatatatattctggatgagaaatccttttaaaagcttttctagctaggatgagtttaatgcatatatatgaaaccagccacacacatgatcaacctaacattgcacaatgctagcaagattataatatcgagatgtcaaattcaatcattagcaatatgaaaattagtgctgttgtggtctgaatatgatagattatctcttttatataaatcaatataaataattacctgttgaaaaccaacactgatctcataatatgatttgtaaaaaaagggtagcatatgtgtgtcccacttcatttttcatgatctatatgggcaggggctgatgctttaatttagatctcatctgtaattaaccagctagtacttttccagtagccagggctttctttctttgattatttgcttttctttcttgtttgtttcattcgcgaaaagactatggaccatgcataatgcatctttgttttcaaaaagtcactttctagatggaacctcgacctgagaaatcatggttttcttgtagagcttaaagtttggtcatgcttccttttactataggaaatagtgaagacatcccataaatcaataaataattagccagctaggcatgtcttgatctcgagaaatgttcatatttgctatgagattttgttcaaatttcctgtgaaaaatccttgcagtccaagcgatgccttaactattttgcatcggggcatagtactggtactgaaccaactaattaattaagcttagagagtggcttagctagctagcagagataccagctagctagtgatcataattaatttctaggggatttccattattaactctataggttttttttggctaaaaaagggtataccatttcgttgaaaaacaggaatcaatataacctatgctgttatcctatttttgcagcaagtccctgcatgtaattagaatattaaaattagtacctattttttttgcagggagagactacattaagtatgccttcattacgacattaatcgtgccctaactaacaaccttaaattggagctgtataaattagtcacgtgcagccagtcttgattaattcttgaaactttagttaatcatttgtcaagtgttgcttaatgttgtatccaccaggcaaaaaatagtaccacttaattattttgtagcaagctatagctttcttcagtacttcccactgattgcagtgtggaattaaattaattaattagtctgcttctgacttcgttagtttcttcccctttttttttctgaaagaacgttttcttccctttcttctgaataaaataaaggagatgaattggttttcatacaacctggcactcaattgagagaaaatactgatagagtttttttttgaaggaataatgaaagagtttcatgtgcaacaaaacttagaaattaaaggtgccaactccagaatcagaatgtgcaagaatgaatctttcttcctgacttgtgtgcgatgcagctgaaattttaggtcagaattattcctgttctaaatgtagccttacctcgtttctgagcccaagtgtgtattgggtttgaaactgatagtaatggcccaaatggcttaattacaaggaggacgctctcttggatcgctaactaattgagtccattccaccaacagcaagattcatagcaggccttcatgcgggccagagcccactttaggcccagccttctctgatgcagttcagtgctgcttcagttttcagatagtgacagatggggctgaaaaattgcagatcgagtcccttttccttcatcaccggagaccagggtttccccgacggtaggcacggtaaccacggtaaaatttaaattattttctaatttaaaatttaaattattttctaaatttatttaaatttaaggtggttaccgtggtttttttaccgtaccccacgataaaactggtaaccgcgtgattaccgacggtaatgtaaaccctgcaagagacatagagaaaagatggaacagaacacgacgaacagttgttcagagctgaaaaccgctcaagctgaagcttaattgttgatcaggtactgctggtacttaacactaatcgattgcatggacaacacaaaatgtattattccctccgttttaggttataaaacgttttgactttttgacttttactattttaaatttaactaagtttctaaaaaaaatagtaacattttcaacccaagacaaatttattataaaaatatatttaattattgatttgatgaaactaatttagtattataaatattactatatttgactataaacttagacaaacttaaaacagtttgacttatatcataaaactgagctagggagtattattcgagaattcatcacagagccaacgctatctgtgtgtgcgcgcgctcgcaaatggcttgcatcaaaattgaggaaaaaatcattcaaatctgtatattcgcttaaagcaaaccgttacaacaatcattccgtacttattcgctgtccacacatttcacacgtactccctctatcctataaaaaatcaacctagtactgaatgtgacatatcctaatattacgaatctgtacatacatccgtccaaattcattgtactagaatatgtcacatgtattagattcgttttttagggacggaggaagtagctctatttttcttacaaattacaatcatacagtacgtatacactgtctacgcatttcacccactacatggtatctctcttttccttctgtatctatactccctgctgtcatctgaatgtctagatagagtaagccataagaatttttttaaggaaaggcaggagattttgccttatgtagtaagccgtaagattacgtagtatagaggtaggaacagcacagcgagaagcatcccgataatcaccctgcagattgaattaattaagcagttaggatggtaacgtcgaaacgaggactctctccgtttctaaatgtttgataccgttgtctttttagcatatgtttgaccattcgtcttattaaaaagaattatgcaatatgtaaaactatatgtatacgtgaaagtatatttaaccatgaatcaaatgatatgaaaaaaaattaataattgcttaatttttttaaataagacgaatgatcaaacatatttaaaaaagtcaacggcgtcaaatatttagaaacagagggagtatatactttctcacttaattagtaaatcagttggaagatcttacgcggtgataataatctcaggatgcagcccgtattcttttgcaaatatgaatgatgaaatggcttgtggtacagcagcctgcaaaatgtttgcacagatcaagagatcatcagttttccttgcgtagaacaggattacaatggcgagctaacataggagagtccgaaacgttccaatttgggtaaagctaagattaactctgagtctctgaccattatgtttgaacacagaaaaaactggccattatgttcttttaaaaatctgaccattgtgaacttaactatttgagtaaatctaagctaggaagtgatcaagattaaaagttatcaatctcagggaaaaaaagattaacaattatcaatcgtcttgccatggtaaagaaaagctactttcaaccattatcaaccgcgctcgctttctgaatattcaagcaggtaattaagaagggttggatttccatcatcgaagcaagaaaagaaaaagattaaagagcgtagttggaaggtaatatggaaatgtgtcgtgagaaagttgcgtttggtctctaaacgtctgactacaaataacattgtaattagatacctgtatgatggcagcccggagtttgttgccgtgaaggccaacaattttggatgcaatggtcatcgcaatgggtccaagagcaaacttcaaaacctgtcccaggatgcagccgcacagatcacaagctatgatactttcctgactttccatggacaaacctgcagataaaatgagcatgaccccgccccaaaaacaagtgtccaagacatgcatatttgttacaaaggaaaataaaagacaatctgttactgttagtgggaaatttaaaaaggaaaaataatgtatatcccctgtacctggtgtatcatatactcctatgatatatacataggcagaacaatttatatttatgcatgtatgagcacatgtcaatgttttaatgcgagtataaatttgtacttacccgtgctgatcataggcagcgctcctatgcccagtgacaaggacgcgatattcac

SEQ ID NO: 93052 - DNA, 4674 bp, Oryza sativa
cccccacgacatgaatctattttggcaaaatatttcagattttttatctttttatgaatttaggaagatttattcaattttgatctttgttcaactttttggaatttcggaggcccccttatatagatttgggcataccgaattaataaactttgtggcttgcatatctgtgtactccgtaaatgttacccgtgttttcagagaaccacatttgttgcatggctctgccattttcgtgtcatgtgtcctgaggttataatagattgaattttccttgtctatgatgatagaaaatttctggggtcttgaaagtaaagagtaactgcaatccagctgcttggatgatggacgtaacatcaacatcaatggaggtgcaacacaacatggactttgcgattttgtatgacgaatcatcacagcataggtacatatcttgtaaatttgattaggattttatgagtgaagagaacatatggatagctgaaagaaaataaaattcaactagcaatttttttaaccaaataaaaaaaaactttcatttaaatttaagaatgactaaaagttacttttctgcagagacatcgtagagctagtggagaagctaagcatcccaataccaaattcagaaattctatctttctcccatcgtttcccacggaatggctggattcaactaaaagcttgcttgtggaaacaaaacttaacttactggagaagtcctgagtataacttgaggcgtataatgctgacagtaatatctgccctggtctacggagtattgttctggaagcgtgcaaaaatattgtaagtccactactctcttatccacaacattgcacattattttgttaactttgggtacggtgcttcgccacaaagcattgccttgaagtactcagtagaataacataactttctctgatcccttctaagaaacgacgagcaagacctgttcaatgtttttggtgcaatgtatctgggttccacaactatagggtcttataatcatcagtcaatcataccattcagtacaaccgagcgcattgtaatgtatcgtaagaagtttgcaggaatgtactcatcttggtcatattcattcgcacaggtcaaataatgatcacaagcttgtaagcaaagtaaaatctacattgttgatactaatgttcataatattcaccttctacaggctgccattgagatcccctatgtatttatccaagtggtactatacacgttaattatctatccatcaattggttattattggacaacacacaaattcatatggttcttctacactacattttgttcaagtctctcctatatttatgttgggttgcttcttgtttcattaacccccaatgttcaagttgctaccatattggcatcttttttcaacaccatgcaaacactattctcaggatttattttacctgcgcctgtaagcctttattttctcctaatatcatgattattttctggtgatttactatggcctctaatggtagtagaatcaatctagaccgttcatcttttttagtttaatatatcatatttatttatactatcaccttaactattggtacgtagtggaatatgatctcgttttttttttcttgaatactaccagcagagaatggcagtcagaaattttagacactccaggatctaactttgttcacttctttttgttagcaaaattttgctgctcacgttgaatatataccaactactaagaaaataacaacctacatgagaactgcttaacgtgattttgtagtgtaattaataaattatattgtggaactactaaggaatcactggatgacaatacactgaagcactccaacataagtttaacatcgtagtagttatgggcgtataccattttttcagtcatatcatttgtcttttccatttctattttgctaggttggaaattaacatttgtattttagaagaattgtgttttgtgcaagtgttagggaagaatcctgaaaagatcaggaaaaaagaactgaaaagatcaggaaaaaagaactaacatgcatttcaattgttcgcgttgcagcaaatcccaaagtggtgggtttggctctactatctcactcctacatcttggacactcgatgccctcttgacatcacagtatgggaacatagagaaagaggtcagagcatttggagaaactaaatcagtttcgatcttcttgaatgactatttcgggtttcataaagacaagttgagcctagtagcagctgttctcattgcctttccttttgtgttgataatcctgttctctttttcaattgagaaatttaattttcagaagaggtaaagcatgttctgctgttccaacagacatcaaaatgtaacttgggtgactatttttctccaactgcgaaatgcatgaggttgattgggtgactatttttctcaaatctgatgagtaaacatcgttaattaggaaatacatattattaacttgattgtgctaagtatgcttgtgagttataaccttttttgtttcaccgaatggaatattactcgatggtttcgtgtaacctgctttggagaggattttgctatattacgttatgccttagattattgaatgcatcaatagaaaatgagcacctgatcgactaatgcgtgtacgggtatggattactgaaaagaaaagcagaggagagcggagtatgcaggtaggtcacctggtagtaggagtcacctgcatccaccaaaacctcgctcagctaatggttcagatacatgaatcaattgatcggcttatgcgtagactccatagacatctactccctagttttcaggttataaaatgtttttgactttggtcaaagtcaatatactttaagtttgattaagtttgtagaaaaaaatagtaatattttcaaccaagacaaagtaatcatgaaaatatattcaattattgatttgataaaactgatttaatattataaatattactacatttatctataaacttagtcaaacttgaaacagtttgactttaaccaaagtcaaaacgtcttataacctgaaacggagggagtaggtagttgacgccggagtttggaatccaatgacttcatgtatgggctcaggtagcttgtcaactacataagcacgtatgtaacacattaagtgggtgtttggttggttgcctcgcattgccaagccacacttgtcatgtcataatttcttaggttatgtttatttcgctgccgcgactatgtcttgtcacattttcttagccttgtatccatatatgtcattctctcaaatttgaaacaaatcatatgtggccaactatttcttagtcacacttacgccaccatgctacaaattacctaactttattaattaatggcaaggttaagcatcaaccaaatatcttcacagtgttgaagacgaccgatctgcctagagacccattgtcgctcacttccctggagaccttggaaagaatatggggaaagagaggggagaagaggaagagaggagggagaagatagggcctatgacatgtgcctgattaggatgccatgtcaatcaaaacaattatccatattgttttaggatattacttaattcgatttagaaagatgggttcaatatttctgttattgcagtttgaggatataattcgaacttgacgtcatgatgaagaacctaattaaacaccgtgtttagatcctaaatttttcttcaaacttccaactttttctatcacatcaaacttttctactcacataaacttctaattttttcgtcacatcgttccaattttaaccaaactttcaattttggcgtgaactaaacacacccttaactcattccaaaccgttatgagtgaaaattaactgcaccaacagaccgaaattactaccgcatgtgggccaaaattaccagagtctatggacgaaaattccagccatttacaggctgaaattaccttcacttatgggccgaattgaatactgctagctagggccgaaatggaataagttcacatggtgaccctcaaaagtgattgaaatctaatccgtgactctaaaccataaaaccggataccttggcccccaaattatgaaaaccggtgcaatttgattccctcggcggttttggagagcggttttgctgacgtggcggtattgacctggtctgtgtgctgacgtagcgcttagctggcatttcaattaaaagttatacgtgggacccgtttgtcattcacacacaattgtggggcccactgacatgtgggccccacatggcatcttctccatttcttcttcttcctcccctcccttctctctttctttctccctctcccctacggccgtccgcggggagcgagcgaacggcggcggcgggagctagctggagcggcggcggccgtgggctggagctgaagcggcgggctggagtccatgtcacgccgctcgcaccaccaccacccgcaccacccagcggacggcatcgagacgtcggcggcggccgagcgacggctgtggcagcccgcgggcggcggctgtgggccgcagcgggagggcaggcaggcgggcgggcgggcaaggtcggcggcggctcacggcagtgggaggacgaggggaacggcggcgggcgggagaagcaggccacggcggtgacttc

SEQ ID NO: 93053 - DNA, 4909 bp, Oryza sativa
cgtccctcagccgccacttgcactgtcacgcccggaatttctacccaaaattccaaacgcttacatgtgtgtaaaccctcgtctaggaatcagccgaggcacacaataacaaattaataatagagtgcaattattactctaattaataagcgaatataaagtcattacagagatagatagttcctctcaaacaataaaaatctaagcagcggaaaataagataaacggcacagacgaccccatcccacaagcagcttgaccagggctacgcttaatcctccacaccttcagcatcactgtagaactcctcctctgatgaatgattgcaaggtgagtatatggcatactcaacaagcgacgcagcaaatatgcaagtgcaagggataacaaaggatggcataatatagtctcatttgcataaatagcatttaataaatacttcagaatttaggaaaaacaataaagtatttaattaatcaatattaatccatcgctatacaacatacccgttgcataggcccaaccattctgaataaccaatcccggctgcacagttctatctccaaaccaggaatataccattccaaaccaggagctaaacaaattattatcattatcatttattatggtgagagatatgaaactaatcacgaaagacattgttagacccgcccataaccgcgggcacgactattcgaatagttttactctggccagaggtgtaccactgtacccacaagacacaacctcaacatcatgtcaaccatgcgtcgcgatacttaacaagtacccgaatagagattgtgacaataccctctgcataacacaattcaaagcagtgcaccgttcctggatcataatcacccccttataaacaaggcatggactccccagcgacccccgtgggcttatctccgccacttcacagtctggtgctctacaatgaaccatactatataaaaagtaaagccgttgcctatgctggcttgtggttggcacggttaatgtttcacaaccgaaaatcgtgaaccggtccttaattgtcatgagcacgaccatcaaaaccatgtgctcacaacccaccattatcaagttttagttgacaaattaattaattaaccaatcacgattaaccatcgtgagctatcattaagccatcattaaataatagtgaatcataagttatcccatttatatgagctaatgtctctaagcatggcaaagcatcctaagcactttagctaaaaccatataatgttctagctaatctaattattaaccaaacgacaaagtataggtaatcaatatcaaagggctataacaaaggcaataggttattcccacccaatgacattcaaaaataaatgcaatagttgaatagaaacaatagctttaaatgggatcaacatgctcaaagggttgtttgggatctgtgtaacttgccttgctggccttggaactcttcaaagtcttctcctgcaaattcggactctccgggaacgtcggaatctaagcataaaagagcaaaatcaccaaaacagcacataaacaatcatgaacagtacatgtggatatttttaacatgtagatctcaattttagaaaaatttagagacttgaaccaactaaattcgagctaagatgaattagttatgaatttttaaagattaaatcggattaaatcatttatttagattttaattgaattataacgcaataaagaattatttttgaaaaggaaaaaggatttattgcgtcagcggctcgggttcacggtggaccgggtgcacggggacggtctacggaactaacggccgagatctaatctaatccaaaacggacggccgggatcgaatcgatccaccatgggtctacggatgacgcggcgctaacgtcatcaccggcggcggctcggcaactcacgctcgccggcgaacgacggcgcggcggcgcaaacagagggcacctacgcgtagagggcaacgcggcgaactcaccgagggctcagacgacggcggacggcaacggacagcgacggcgacgaggtcgaagcggcagaggcgttcgggtcgacgacgacggcggtgctccggcggtcttcggcggaaatggaggtcgggacgaggactgcgacgacttggcgatcctgacggtggccctcccgagcgacgacgacgaccggagcggcggcggcgcacggctggactcgcggcggcgacggcggcgcacgggttgtcacggaggcggcgctacaagcggcggcgaactgaggcgagggtggtggcggatagaggaggtcccgggggtccttatataggggctaggaggcggcgacggaggcccacggcggccggcgacagcgatggaaggtttagggttaggaggaaaaaacgaatccgaatcgagctcgaatccaacgatttccaaatgaaattagccgaagattgcaaaagagaaaaggaagaggagatcccgaggatcatttcccctctattgattcgatcagatcgggaaagacgcgggcgaatttggaaggggcggcggcggcttgcgcggctagggcgcggctgcggcggcgcaaggaagacgacgacccaggtaggtaggccccacctgtcagcgggagagaggagagcgagcagcggctcggctcagcgggctagctgggccaggcacacttgggccggggagagagagagaggggggttttgggccgactttcggcccaaagccaaaagaggattttaaaacctttttctttttaaagtattcatgaaatgcaattccatttattaaaaatacttccttggctcaaataaatcccagaaaaatctaggaactatagaatcaagagaagtatttaataatattttatctagcccacttttatattggaatttattatttaaaattaaatcttttcttcaaggcttttaaaatcatttctaataattccatttaaacaacaatttataaatttaggattttcagggtgtgacaaacctaccccccttaaacagaatctcgtcttggagattcggaagagctgacgaaaagatgcggatgagttgactttaattcatcttctcgttcccaggtagcttcttcttccgagtgattactccattggaccttgcaaaaacagataactcgattcctggttcttctctcatctgtctccagaatacggattggtttctcaacatatgttagatcctcttgaatttctatctattcaagattagcttcttcagtgggtacccttaaacatttctttaactgtgacacatgaaacacattatgaacacctgccaaggattgaggtaactccaactgataggcgacctcacctcttctactgacaatcttataaggtcccacaaaacacggtaccaattttcctttggtgtgaaaacgataaaatccccgaagaggcgtgacacgaaggtacacatgatctccttcctcaaaacttaaatccctgcggtgattatcagcataactcttatgacgagactgagctatacgcaatctttcttgaatgatctttaccttctcttcagcttccctcaggatatcggtcccgaaaacctgacgttctcccgtttgatcccacaacagtggagtgcggcacttccgaccatacagtgcttcataaggagccatttggagacttgcttgataactgttgttgtatgagaattccgcgtaaggcagattcttatcccaacttccaccgaagtctaaagcacaagctctcaacatgtcttccaaaatctgatttaccctttcagtttgtccgtctgtctgcggatgataagcggtactaaagttcagcttggaacccatctcttcctgaagcttcttccaaaactttgaagtaaactggctatctcgatcggatactattttcttaggaacaccatgcaaacacacaatccttgccatatacaattccgccaaacggcttccggaatatgttgtcctcaccaggatgaaatgagccactttggtaagtctgtcgactatcacccaaatagagtcatggcccgatgacgttctgggtagaccagtgatgaaatccatctctatttcctcccacttccattctggtatctttaaaggctgcagcaaacctgcgggtttctgatgttctgccttgactcgctgacaaacatcacacacagctacatactctgctatctcatgcttcatacttgcccaccaaaatttcttcttgagatcttggtacatcttggtactaccaggatgaatggagtataaagtgtcatgagcttccttcaggattgcatctttcaactccttgttctctgggacacaaattctctcgcctaaccatatggttccttgctcatcttccaaatacccgatagcctttcctcttctcatgttcttcttaatctcttgaatatcaggatcattgatttgagcttctctaacctagtcaatgagagtgggcttcgcttctaatgctgcaacgaaacctctactgacaattcccaaattcaatttttcaaattccttgcataattcccacggcaactgtcgtccttccgtagcattgcaatagcctttcctgctaagagcatctgctacaacattagcctttcctgggtgataataaattcccatgtcataatccttaatcagttccaaccatctctgctgcctcatgttcagatctggctgggtgaagatatacttcaaactcttgtgatccgtgtacacctccgtacgagtaccaaagaggtagtgacgccaaatcttcaacgcatgaaccactgcggctaactcaagatcatgagtagggtagttcttctcatgcggacgtatctgacgagatgcataggcaaccaccttcccatcttgcatcagaacacaacctaatc

SEQ ID NO: 93054 - DNA, 1423 bp, Oryza sativa
tcatttttaattggttaaaattatttccaaggctctgaaaattccactaaaatcttgttaatgcattggagcatggggaactcaagaaaaattccaccacgccgaattcaattattaattgcatttattaattagggaattagctctaggttaattaagataatttcttcggacgatttatttagccaatttttaaagcaaggagagggggaaacttcagggcgtgacatacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctccggaactctcaaacatttcttcaactgggagacgtggaacacattatggatgccaagcatgttggaggaaagctcaagctggtaagcaacttcacccctgcgttccaaaatccgatatggtcccacaaagcgtggtgccaactttcctttggtttggaagcggtgtactcccctgagcggagtgacacggagatacacataatcccctacttggaaaacgagctcccttcggcggttgtctgcatagcttttctgccgagattgcgcgattctcaatctttccctaacagctctgactttctcttctgcctcatttaaaacttctgtaccaaacaactggcgttcctctgtctgatcccagaagagcggagtacgacacctccgtccatacagtgcttcaaacggtgccatctgcagactagcttggtaactgttgttgtaagagaactcagcatacggcaagcttttgtcccatgctccaccaaagttaagcgcacaggctctcaacatatcctctagtatttggttgactcgctcggtctggccatctgtttgtggatggtaagcagtgctgaagtttagacgggttcccaattcttcttgtaatttctgccagaactttgaagtgaattggcttcctcgatcagacacgatcttcttaggtacaccatgtaaacacatgattcttgctagatagagttctgctaatttcttccctgagtaggtagtgtgcaccggaatgaagtgagccactttggtgagtcggtcaacgactacccaaatagaatcatgccccgatgatgtcctgggcaaaccggtgatgaaatccattccgatttcttcccacttccattctggaatctgaagtggctgtagcaaacctgctggcctttggtgttctgcctttactcgttgacagacgtcacatagtgctacgaa

SEQ ID NO: 93055 - DNA, 763 bp, Oryza sativa
tgattgaacacctttacctatgaattgcagcaaatgctggagcaatgatgctggacagctggaggcctggagcaaatggatgttgataaccagattgctaagctgatggtggagctctcccgcatcaagattgtgaaattggggatggtaccactgcgatggtggtcatgtttggatcacttctagaccaagctgagaaactgttagaatatggtattcttccaattaggatttctgaaggttatgagatggcgtcaaggatagtttttgattatctcgaacacatctcccaaaagttttagttcagtgctacaaatatagaacctgtttttttgtacaaacctgtacgataattgacaaccctaaccccatcattatcttcatatgctttgtttgttcaagtttttattttgggtactttcaccccatcattggtgaatctaaccaagacaccttgtgctagctgttagcagaatttatctgtaggtggtttgaacattctgcattgattttgcaggaaacgaaatgattattgaggagaccaagtgaagtattcatgatgctctgtgtggctaggaatctgattcgcaagaactctattgtttatgggaatggctcagctcagatatcatgctcaatctattatattattaaaggaatagaaaaaggagtctcacgttcgctctcatggcctagaaaatctcacattaatccgagaaaaagaaaaagcagagtccatatagaaatacaatttagaaagagc

SEQ ID NO: 93056 - DNA, 731 bp, Oryza sativa
ttgggaagcgtgcgtacggaaaacgaaacaaacaatctccctatcaccccagaacgaacgcagcctaagttacttggttggttaactaaatttggtatctggatggatgcagggagagtggcagcagcagcattagttggtgggggcgtaccactgaatccacggtacccggcgattcctgaagaaccttacataggccggagaggcgatccgtacacaggtcggggaggcgaaccttacacacgcccgggacggggatgcaccgttgcatacggatgctatggaggtcctccagctgccaaaccatgacgatcgacatactactctgctactgctactgcatgctcgcttgttatttcgatcgatcaatctcatggcctgcgtagctcaccacataaacaaataaaaactatgcatctaataattaacccctgatctatcgatcgatcagtagacgggtatgcatcaatcggcatcagcagcatatgcgatgtgaattgtgatgtatgcatggtgtatttttgtggtaaataaagtgaagcagatatctatctagtatatacacatcgttcctgcttctatgttgcctgcgaattacatccccttttgatgttgtacctgttcataggtctagttcatactacttcataggtacagacctcaccattccaatcaagatgacatacagagattatttttgatgtcctgcatattggttgtgcaagcagggc

SEQ ID NO: 93057 - DNA, 4014 bp, Oryza sativa
  unsure (1)..(4014): unsure at all n locations
tttccaaatatggtctttcagtggcaagcaactttacaaggtgtcaaaggaccacttctttcaggtatggaggttccatcctacccttttctggactctcatgtctcattgctttacaccattgtaatcctttgtcatttactttaatttactggtacagttcctgtggcgtccgagaccaccgtcgctgctgacccctgaaaaggaagacgagattgcgaagaacctgaggaagtacagcaagaagtacgagcaagaggatcaggatgccttcaaccagctgagcgagcaggaacgcaagaggcggaagcagcttcaggaggaatgggaaggatgggttgccaagtggaagcagctgcacgagggaaaggaaaggaaggaaaccccccccaaaatttttaaaccccccaaagagggggggggaaatattttgggggggggggaaaaaaggagccccccttttttttccccaaaaagggnnaaaagaaanaacggggaggccagtgacgatgaggaagagtacgacaccaaggaagttgagattgaagaggaggtagacgtccaagaagaagttccattcgagctggatcangantttgagagcttgtgctagcatctgctgagaaccttnnctgcctaagtctgtcttaagttaatttctgccccctttgcataataggctttagagatcaagaacacaatttcttgatctttctggtttctactggttgattgtacactttgtccttggattttacggaccaatgtattcgaagatgaaaatttgcggttggcatactaattttaatgtgtcgttctccaatcctgcaaaacgcgttcacgtatttcctcatccacgcctccacataccctttagcaaaagcgcactggtgaagttttttttttgtttggtcacctacggttttcttggtttttgtcctgtagaacaagatcgaattcttaaatcttgtattttttaattagatcgggctacattaaaatcagattcagatcatcagatggtaaagcctggtgctgttcatcagatcatcagacggttttcaaatccgtcttcctgccgtctcggtatcttcctctgccttggcgaattccaagttcaggcatcccggcgttgcaagatgcaatcggacgcggtggcgcggagccccaggcaaacggtgagagtcggaggccggcgccccacggccgatccctcccgcggctcatcggaggcgtacggcttcgtgggatccatcgccgcggtggccgccgccgccgcctacctcgcgtgggcttacctgccggagccgtggctgcgtttcctcggtgtcacctactaccccgccaggtcggtacagcgtagtccatactcctcacgtttcagttgtttgtttgcttcgcctggacgagtgatttgagtctcatggcgatggcgttgtgcgcaccggtgtcggtgtggttttctttcaggcattgggcactggccatgccgtcgctgctgctgaaagcggcggcgcaggggatggtgctctacatggcctccaactttctgctcgctcctgctccgactttgcttggccactatctccggtgagacttttgctgtgctcacttcggtagttccgttccaacattgttgcattagtggtacatgttcagatattttttgccttttgccagatgaatttgcccgggagcctgcggcgtgtggtactgcaacaggggaggagaaacccatcgaggacatatcagatattagcattgacaagataaacaatctcatgtttggcaatgcatcatcaagctgatgcatttactacttctgatgaagctctcaactgatcaccagttgaccacaaacatgttttttgctttctcttggtgtgttgatggctcactcgtttgcaagctagcattgtgctattcacttatgattaacatggttatatgggttcttttaatgaacatgtttctgtactggactcatgcttgcagcaactgcatgcttaacagaacttcaattccactgctcaccactagtatgaactgctgttggttgtgggtataccacaacatagatccgaatgctaagaaaaatactatacgtacgactaaacttgtccgactttggaacgaccttaacgccgtgagctcgtgacgttaatctccgtatgaccaagccatgttgccaccatactaagtcacgtattgagttgttttaccgtttgatcgtacgctgatcggacatacaggtcgtacgtatagcattgttcgaatgctaaatatcaagtaatgcgcagtgctttaatttggcgaagcttcgttttattcaaatttcaaagaacacataatgtacaacacacaattgcacgaataactacgtacaaacccgcatatcacaaacttccagcctatcttctcattcttcccctccctaagttgctggtgcacgttgtaacaacatgttcttacttctcctcaaactccacatcaataacatcaggccctgagcttcttgaactgctggctcgtccagaggacctattgtttggctgccacactatgttttggcaattcatgcaccgaatcacttggttgcggtaacccacaaacctccgtttgcacgctgggcatgtcccctggaattgaaacacattaaatcagtaactacctagtattttgaaagcatcccaggttttgcttgactacgagtagtaccccacaccaaagaacaacagattaacaagagcaagttgatgcattatgatacccttgtatcactatgtgatcagggaaattaatttcaagccagagaaagccacttcaaccataaacaaaaatatacaacaaactcaaagtaaacacaaacatcaacagagtagagcactgtgctagtggtgctgcatatcatgtggctgatagtagcagtatacttgcatacaggttaaagcctcttaaaacccatttaattttagcatacaatatacttaacaattagtcagcaaaagaacagtcttagcacacactcgccggtggctccaaggccatttcaaaactgagtacaataaacacaggataacagaccaaactcagaaagatgagtattacctcaatggcgacccgattaccaaatgtcccaaggagaagtggcgcagcaaaaggcaggacaaatgtaccaaaaatgaaaactctgaatagccatcctgacagtgcaaaccaaatgaaaaagatcgtctacataaaaaaaaagcagctagtgagcacaaaatctcttgaaagggattgattatcatttgaagcagataatactacatacagtatctacaggctgttaaaaactacggtgcatacaattttgatcttaaaaaaaaatgtatgtgctacattacatggtttcatggacgtgacaacatgcaaaggtgtatatccaaaaatgataacagagagtactaggcaaaatgtctagcatttttttctcaagcaccagaaatctagtcacaaatgaaaggattggcaatgtgaaaatagagtcatctctctcttctttctaatgtttttagctccttcaaatcatagactatatatactaaagaagcacaaatattcaggcagctataaagggcttaccttcacatttcatgttttcaaggtcttatgatcatcttgtggttagctaagcttaggcagtagaactctactaaacaatctaaatgatcatcgtgatcaccaccatggcactgagttaaaaatgcgaacattttgggacctttggtgataataaggttatcttgatcatattcctttcatttggggtatagctggtggagtcctgatcatgttatcagctttggacaacgtgtggagtatactttcaggttcacttgcctgctctctattgtgctcattccaataacatcctgaaatccttggttgtttcaagtattggtctggagcagagcagggtgtcatgtggcatagaaatggaattctttatttgaattgtgctcacgttgc

SEQ ID NO: 93058 - DNA, 991 bp, Oryza sativa
atagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagattgtcgtggtttttatcgatgacatacttatctactccaagtccgaggaagaacatgagcagcatctccggctggtacttgaaaagttaaaagagcaccagctatatgccaagttcagcaagtgcgacttctggcttaaggaagttcagtttctcggtcacatagtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattggccgcagttgttcatgctttaaagatttggcggcactatctcatcagtaaccgttgtgaggtatatacagatcacaaaagtctaaagtacatctttactcaacctgatttgaatctcagacagcgaagatggttggagctgatcaaggattatgatatgggaatacattatcatcccggcaaggctaatgtggttgcagatgccttgagcaggaagagctactgcaatgttgcatggg

SEQ ID NO: 93059 - DNA, 746 bp, Oryza sativa
tccacctcctgtgggtgtcgaagtcgcggatccttcggccctctcgagcgccttctcccgcctaggactttggcgtggagggggcgtgggagtacgagctcgacggcgtgggtttggctcccgcgcaccgtcatactggggaagaggtcgggcgcctttgctggctcggccattgggctgaacaagaaaagcttggcgcacacgaaagagtgcgagagctcagaaaatccctcgcagagccccctacctggcgcgccagatgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccactgagaagcgtaataccctactcctgtgttttgggagatctgtgtatgaaggagctacaaagtatcagccagcctctcccttgttctgggtttctaatctggaaaagtccagtcccccctctcagtgggcaagttcctccttttatatcttaaggggacaccacatgcaccatttctctcttttttgtggggacttacccccccttttcataaatggacggagatttgtatagttgccgtccgagtcaccttctgatgagacggcccacaactacctccactttcgccgggagcaggtgcgacggggaattggggctgtctggtgacaaca

SEQ ID NO: 93060 - DNA, 1612 bp, Oryza sativa
  unsure (1)..(1612): unsure at all n locations
ttatcacagcagcagtatgattctatccttttcagagtctgtttttttaaatagtgcactatttctcggtaatgctttgtgacttccgctacctgtttttttaaattttttgacaggctgcttgtgatgaaacctctgataaaccagaacagttgtttctccaacttcttttaaattcaactaatggggacaacgatagggaggtattttatcgctctatgatttcttgtttaactatatgatttatataggcaaaattggttatatgattttgccatttatatataaatttcacatgcatggaggttactgagccctgaggtatggagtacccagttttttttctggtcttatgccttcatggagcatgttacgaggtggaatcaacaatttgtaaaacaggaattggttgatgcatgataaatgataaattgctgtatattagcaagtttgagtaccatgatcagttctccagggatctaatacattacggttctttgcaaccatttcatcacaaatagtaattctcaccatgtgatgctaggattgaaaccctattaananaacccaaaaaaaaaaacctgtncccccccccccccttttccctaattggaaaaatttccctaatactatcttgttagaagtctcatggtattctttttaaggtcatagtttttcctgtcactttacttgtattgatcaacagacattaactcacctttactatgtatgtgagcacatgctctgtttgtatatttgttatggagatcatttggcatcgatatgatgattattttgtgttcagattctgaagcattctgctgcagattacttggaggaatctgcttatgcatctcaggttagatgattgttctgtcatataattatgaaattgactggacactttctctaggatgtaggatcttatttgtttcgagtggtgtctattatgtaggtcttgctcaccagagagcagcttgaaagacaatatacctgcaatgaggtgcaccccagcctagcactggtagtttcagagaagctactgttagaagtgttattccttgatccagatatttctcaaagctgcactgattcatcagagtacgtatactccaactttgttcttggaatgtgatgatggatatccataggggtggttcatttttctctcttggtcattgttaattaagtttgctcattatttctataggatatcaataaccaaatcaaatagagataatttggtcacttgtttacttcaacaaacatcacttgatggaattggtcctcagtggatacggcctcctcctccaagacttgaaatacttgatggagaggtaaggttgttggctaaaagtttttgtttagtagtacctttatttctgaatctaaggtgtacttcttgatgaatgggcagttgcagtggctgaacctagacaacaaccacgagctattgtgggacagtagtatgtgtgctgatactagtcgaggtgctgcgatccgagatttagttggaaaagcttgtaaaggaccactttcacctgcccaacaggaggttctattctattctttttctcaaatgaatatcttgatattgagtttttaattaagc

SEQ ID NO: 93061 - DNA, 650 bp, Oryza sativa
taactctgcaagtaaagtctgcacccacattatttttgcaggggcattggcaatagctttgtattctgactctgtgctagatctaaacacaggggcttgttttctagcattccaggagaccagatttgaacccagaaatattgcaaatcctcctgttgatcttctgtcatctaaacagcctgcccagtctgcatcagagaagccactaactaaagtagatcctgacttatgaatttcaagtcctaaccgagtgcattgctttaagtacctaagaatccttttcacagcaatccaatgtacagttgtgggagcatgcaagaattggcaaactttattaacagagaaagctatgtcaggtctagtaagagtcaaatattgcaaagcaccaacaacactgcgatagtgacttgcatcttcaggccctaacaatgagccttcatgaagagagagtttctcacttactgaaagaggtgtattagcaggtttacaatctatcatgcccactttcttcaataaatcattggcatacttgtcttgattcagtacaatgccattctgaaccttgcttacctctattccgagaaaataatgcagctcaccaagatctttgagtgcaaattccccttttagatcctgaagtaaagctgcag

SEQ ID NO: 93062 - DNA, 651 bp, Oryza sativa
tagggttccgtgttcatcctctgtgaaaccagcggctttaccctgtttcatgttcttgaggagcccatgcatatccggatcattcttctgagcctcgcggatttgatcgagcaaggtaggcttggcttccaacgtagccaagaatccacgaccaactatgcttaggttcagggcttccaactgttgattaagttccggtggaatgccacggacgccaagagtgttgcaatggctttttcgacttagagcgtcggcgactacgttggccttgccaagatgatagtggatccccacatcataatccttgatgagttctaaccatctcctctgccgaagattcagatccgactgagtgaagatgtatttcaaactcttatgatcagtatatatttcacagcgattcccaatgagatagtgccgccagatctttaaagcatgaaccacagcggtcaattccaaatcatgggtagggtagttgccttcatgaggccgtagctggcgtgaggcataggctaccacatgaccttcctgcattaatacgcaccccaatccttggcgcgaagcgtcacagtacaccaggaagtccttgcgagtatccggtaagattaacactggcgaggaaaccagcttttctttgagagtttggaatgc

SEQ ID NO: 93063 - DNA, 685 bp, Oryza sativa
ttgaccaggctgcacagctggcgcaggaggacggggtgcacgggtcccttgctgaccctgctgttgctgcggctgtgggacgcgcaccacgaattggggtcggggcgcggagcgaggttgctgctgctgctgctgcgaggaggattgtcacgccctgaaaattttaaaatttataaattgttgtttaaatggaatttctagaaataatttaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaaagtctcttttggctttgggccgaaagtcggcccaaatctcttctctctctcctcggcccagccggcccagtccgccgcgcgcgcgcgccctcgctgtcgctgacaggtgggtcccgcctgtcaggtccttcatccttctccggccgccgccgccgaaaccctagtttcgcgccgccgccgtttcctttccaaatccggccgttcctttccttctccggccgaattgaaagaggggaaatgatccttgggatctcctctaccttttctcctttggaatctttgg

SEQ ID NO: 93064 - DNA, 1137 bp, Oryza sativa
atacctttcggcgcatgcacgattactttttgccgcaccgatgcagcctcctttattcgcgtgcgatacgagtatttgcccgccatttgccgcatacgaccaatgtaactttcggcgccgatcaggcatgcaacttcggcgtacccaccatgccccaccacgttcacatgtcaaggatatcactcgattttttgcgcctatataagtcgccttaacgagtgaggcctcacgaactcagtcacattcagtactctcttccctacttgcttcattacaaatcctaccggctttcgtcaatggctagacgccggagtgttgaggatccaaactggcgcagcgatccttatgtatacctactaccaccttggtgccagcgtcctctctgcctatgcggtgatcgatgccaactaatggcttcgaggaatcctgatattcgaggaaggcgcttttttaggtgccctaactatgaccgtgaagtattttattatctgcatatgcttattcattccgtatgggtaatcgctttattcttcgtaacactactctattcggcagacccgcactatggcttgcacatacatcgagtgggtcgatacagaaaatcccgttctcgacctaaccacttgtttacaagaaggtcgctggtatttcgcatccgaaagtaccgagcaatacttacagagaaaagcggtttatgaacgacaatatcgtgaacaacagagcgactggcgggtgctaactacggcactccctccatgggaagcccgtccaagatgcaggtgtggtgatcgttgtcaggttcttcgttctataaatcctacaacattgggtcgaaggttctttgtttgtccaaatattcttgacgacgatttcatggtaagaatattttgattacatgaatccttattttctcacaacatttactaactttgctcgctttacatctattctttcctcccaggaaccaccaaggagatgtcaatacagagaatggatagacaccagaagggttctaactccacctagccgtgttgtgcagcttgaactaccagagcaatacagggttactaaagcgcggtttgagaaaggagagggatcctcacgtaggggttagctattatcggacaacttggcata

SEQ ID NO: 93065 - DNA, 2109 bp, Oryza sativa
  unsure (1)..(2109): unsure at all n locations
caaaccctagcccgctgacgcaataattctcttttccttttcaaaaataattctttattgcgtcataattcaattaaaatccatataaatgttttaatccggtttaatctttaaaaattcataactaattcatattagctcggttttagttggttcaagtctctaaagttgtataaaataaagatctacatattaaaattatccataaattgaattaaatttatttaatcctttttaaataggctttaattagattaaatcttgtaaaattcgtaattatttcatatgaagtcagaatgagcccgttcaagtctcataattcatctaaaatcatgatctacacatttgtttactttatatgtattgtttatttggagtttcttagtctttttccttgttttgcgttttagcttgtcgtttccgtcgtttcgaaggttcgcgagtgcgccggaagtattcaagaagattaattgaagacccgttattgcaaggcagtcacacagatcccaaacacagttcctttgagcatgctgatcctatatttaaattctctatttatttcaactgtgcatttattttttaatgtcatcgggctctgtagacccccgtttttataacaggaatcaatcgtgtaaacagtaccatttccctggatcaagtagtctggtacacacgagttcatagccgagataccaaatgcacatacacgagagtctagtgcgaattattacaacataagtctgcaggcgtagtcttaaatcatcagaccgatgtcacatcctgatttttgtttcaggatttataaattatttaataaattattattagaatttatattaaatgttcattaatttacaagtgaagttaatgtgggaaataaaatttcctaatataaagcatggatggatttaattttgattaaattctccatgattaattacactctctgaaattttctcagatgtttcggagctcaattcttaacttttaatcatacaaagagcatttcagtaattacccacatattaaattaatcattaaatggtctgtttttaatattgttaaatactttgggtctccaagtatgttcaagatttttcttggaattatttgagcataggaattatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgatttcagccagcccaagacgaaagtctaatntgcctccctccacactgtttatcttctaccttctacagccgaactgagaccgattggctcgggtttcttctcaaatctgacctttccccctgtgtttttctaaaattagtggagggaaaatattcctcctatcctcctctatcttactccccaaacatcggagctaatcgttgagtatcttatccgaatggaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtagtcgccggccgagctccatccgcgtcgcgccgccgcctccgccgtcgccgccggtctccgtcaccaccgttaggtgcgcgggagggtggagaagcccggccgctatctccccgaagccgccgaccaccgcagccccgtcgccgccgtcgaccgaagccgcgccgccgctagacctcgtcgccggccgtcgtcgttcgtcgttggttcgagggtgggtaccgttgggttcgtctcgtcgtcctctacgtgttcttgtcctccaaagtcgcagccgaccatccaatctccggcgaggtcgccatcttggttcggccattgatgaggtcatctgacgtcatcatcgtttttttctttttcctgtttttcccatagattaaatcttcggaaattcataactaaatca

SEQ ID NO: 93066 - DNA, 832 bp, Oryza sativa
aaatatacaaaaatcctccaagcccaatttgactttcaactttgcacattttatttttgaaggctttcacaagcattttaattattctaggcataatttagaggatgtattttagggtcgatttgggaccccacaattatgcaattgatgtctgaattgtatggaggggctaggaatgtaccctacactaaaaaagacataagcaatttcaagtcaaagttggggagcgagtataggagtataggtgtagagatattcctgaaacaattgctcacttcgaggaaatcaaaaaggatgacccaaatttcttctacaagattcaacttgatagggaagacagggtgcagaacatattttgggttgatggagcagcaagaaatgcctacaatgacttcaaagattgcatctcgtttgactgcacatatatgacaaacatgtataacatgccttgtgcaccattcattgggataaacagacatgggcaatcaatacaggtactccttttttttgcaaaaaagtaattctaaaaaatctgtaataactttggaaattatagtacatcataagttacttgttgcattcattgagttacatcaagtcctgataaaagttacttccagtagaatgtgaagttacatttttttaaaaaaaaaaggtaaaaaagtaactaagtttacaagttacatttttagtgtttgttctatagttcaaaattgtactgatttacttccagcaaacacaaactgtacaaactacgcaaaaatgtagtaacttacttgcttcaaaactgtactgactcccttatgtgtattatttttgatattcagctggg

SEQ ID NO: 93067 - DNA, 2278 bp, Oryza sativa
  unsure (1)..(2278): unsure at all n locations
cggcggtcggccttagagattggacaaaaggcatctgctcagaagctaaattgcaattccatatggcactcaatgtcatccaaagactcgacgtggcacaagagcacagagaactctccccccccccgaaacgcgactgagggcggctctcaagcggaaagtcctaggactcgcttctatagaaagggcaaggaaaaagcaagcctccagggtaactcacatccgtgaaggagatgcgaacacgaagttcttccacctcaaggttaatgcgcgaaggagaaggaatacaatccaaagattgaaaaaggacagtggttgggcggtgacgcacggtgaaaaggaatcgacgattcatgatcacttcgcaagcttcatggggaggccagggccgaggccaaacgagctaaactgggagacgttggacatcacaccgattgatctagccacgctgggggaacccttcactgaggaggaagtgcatagggcaattaaggaaatgccagccgacaaagcaccgggaccagacggcttcactggggccttcttcaaagtttgctgggaaatcatcaaggatgacattctgctagtcttcagctccatctataacctgagatgtgcgcacctgaatttgctcaactcagcaaacatcgtcctaatcccaaaaaaggatggggctgaaagcgtttcggactataggccaattagtctaattcatagcatcgccaagatcttcgctaagatgctagcgctgtggttaaggccccacatgcatgagttgatctcggtcaatcaaagcgctttcataaaggggagaagtattcatgacaactacctcttcgtaagaaacatgaccagaagataccaccgcctaagacgggcaatgttgctcttcaagttggatataacaaaagccttcgactctgtgcgatgggattacctcctagccttgctgcagcgcaagggcttctcgacaagatggatagactggctaggggctttactgtcgtcttcgacatcccaagtcctccttaatggctcgccagggcaacggatcaaacatggaagaggantacggcaaggggaccccctctcgccgcttctcttcatcttggcgattgatcctctacagcgtatcctttccaaggcaacagagctgggtgcaatttcaaaattacgaggaagaacaactcggctgcagatctcaatgtatgcggatgatgctgtgatcttcattaatcccacccggaatgatgttgcgactttcgcgaacatcctacatcgttttggcacagccacaggactctcaccaaccttcagaaatcccaggttgcggctataagatgcggcaatatagacctggaagaggtcctccaaggcgttccggcgaagcgggcaaatttcccactaaaatacttgggcctcccgcttgttctgggaaggctgcgaaaaacggacttgcaaccggtctttgacaaaatatcagggagagttgcaagttggagggggaaaaacatggcagtagccgggagaaccacgcttgtaaagtctgtgctttcagcgcagccaatttatctcctcactgccttgaaggtgacgaaggaatccctggagcagcttgacaagcagagacatcgcttcctttgggctggtacgggggatatcaccggggggaaatgcaaggtcaactgggcaaagacatgcttgccgaccagccaggggggccttggtgtcctaagcttggacaagttcacaagagctctgagattgcgatggttgtggaacgaatggagagatccaagcaagccttgggtgggtttggaaacgccttgtgatggtgtggatagggacctcttcgccgcctcaacaaagataactgtgggcgatgggaatacaacgcgcttctgggactccgcatggattaacggccaaagaccaaaagacctaatgccgttggtctatgagatctccaaaaataggaagaaatccctacggcaagggaaagaagacgactcctaggtgcatgacctgaccctcgatgcgggttcatctatcacaatcaaccttctcgatcagctagtccgcctgtgggaggcggtacggaatgtgcacttagacagcgaggagccggatcagattgtttggaaattcacaagcagcggccactatacagcttcctcggctaatcatgcccaatgtttgggggcgccaaacacaaacttcaactccctaatctggaaagtttgggcgccagggaaatgtaaatttcatgcctggctca

SEQ ID NO: 93068 - DNA, 645 bp, Oryza sativa
gtcaatgcactcttgtgacgaaatatttcgtgctagatcatgtaataagtcgtgcattacataatatggcctactatcatcaccttccttcatgagaaaaccattacctactagttcgttcaaatactttaatcctacatggtcagctttattattttgatctccataagctatgatgcctaatgcttcccaaaaataagtaatctctaaattaccaaaccggtagtcctcagggtaaagggaacaataagaaaaacactttttcagaggaaaggtaggtagtcatagcttatttgtagtgctggcattatgccatcaccatcttgctgatttttccactcatttctttcatgaacttccatccaactttcctgggaaaggttattcttcaataatcgaccaacggttttggctgctagtgggaaacccttaaatttcttggaaatttttcttgcaatatcaatcaattcatcttcataacacgcaggtttttcctgaccaaatatacattcttcaaagaatgtgaagaattcatcatcctctagaccttgcagttctattggcttggttgtttttaccatttgtgctatagatggaaaacgagtggtgacaataaccatacttcctttggcttctcctgttttc

SEQ ID NO: 93069 - DNA, 684 bp, Oryza sativa
ctaactaatatagcattgattcagatagcagataaagaaaacagctcaaccatatggactaaactaaaagcagctgcctgaacttagaaagaaaccacaaaatgaaggactgccttggttttccatgaactgaccttttagattgctggccttcatgtaatcttgtgtagctcgcattaatttactaagttggttagcgatgaaaccactactccacatgaggtaaatcattaatagcaaaacaggcaaaaattagttaaatatgaaaatttacagatttaataagggacaaatacaggaattaggagaggacatgctttaccacgtaaacctggcgttgatgcttttagtttcttgagttgatcctttagatcaacactgatgccctcgtatgcaaatacatatctcagtgatgcggggaacccttccttgggaagcgctctgatttcaggacatttatggataattagttcacgaagtgaagaaaggcgatgtaacccttctgggagggactgcagacgggaacacacatagaatcctaggcattggagggaggtgaggagctgaagcgcctcctcctgcgtttcggtgaagctttccatccacatgtcatacgggaattccatcttacagagggtgctagccaggaggttgcaaatgggggcaacaagcactgctgagatg

SEQ ID NO: 93070 - DNA, 593 bp, Oryza sativa
ttttgatgaagtggagaagcttggtaaagggtttacatcggccaatccattggaggaagtagacataggtgatggaattaagccaaggccgacatttataaataaaaattgagagccgattataaggttaaaataatcgagctacttaaggagtatgtggattgctttgcatgggagtatcatgagatcccgggtcttagccgtgagcttgttgagcatcggcttccaatcaaaccaggttttaggccttataaacaaccacctcgtcgttttaatcctttgctatatgaccgagtcaaagaggagattgatcggttgttgaaggatgggtttattaggccacgttgttatgcggaatgggtttctagcatagtcccggtggagaaaaaggggagttgtaagattagagtttgcaaagactttagagatttaaataaagctactcccaaagatgaatatcctatgcctatagccgacatgatgatcaatggtgtctcgggtcataaggtgattagctttttggatgggaatgccggctacaatcaaatctttatgggggaggaggatatgtacaagaacgcttttaggtgccc

SEQ ID NO: 93071 - DNA, 752 bp, Oryza sativa
gtgagttgtgttgtacaaagggtattgtcacagcctctattcgggtactttccagtatcgcgacgcatggtagacatgatgttgaggttgtgtcttgtgggtacagtggtacacctctggccagagtaaaactattcgaatagccgtgcccgcggttatggacgagttgagcaatgtttttcgtgattagtctcacacctctcacaataattatggatgttataactggtaataatttgcttagctccggtttggaatggataattcctggtttggagattagatctgtacagccgggtatggttgtttcagaatggttgggcctgagcagcataggcatgttgttcagtgttgattaaaatttttgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgcaataatcaatcaacctcagttgaagacaagttgcgaaggagaagacgtttggctcataccccagttgagctgcctgtgggagtggagccggagcttcgctagattttattttccgctgcagttttcttcttggtgaggacttagtgcctcttaagtaagtaattatcgtttagttaatttgatgaatctgtatatccaattgtcagtttgtgtacctcggctgattcctggacgagg

SEQ ID NO: 93072 - DNA, 679 bp, Oryza sativa
ctgaccaaccaactgatatctggggactacgctgacgttgagaggctggttgacaaggcaatccgtcaggaggatcaacgcaacaagatggacaggaagaggaaagccgcacagttcagggcacctcagggaagtcaccagaggccgcgcttcgctcccaggcagcagggtggacctaccaccatgatcgttcgtcagcaccgcccgttcaaccctagcaactttccccagggcgccagtggcagtcagaaccaccatggaggtcagtccaaccgcggtgcagctccacgcccaccaatggcaccggcacagtcaggcccgcccgcgcaagccaagaaggagactggagcaaaaccagggtcctgcttcaactgtggtgagcttggccacttcgctgacaaatgcccgaagcctaggcgtgccgggccaaggtttatccaggctcgtgtcaaccacgcatctgcggaggaggcacaagcagcaccagaggttgtactgggtacgttttctattaactcaatccctgcaacagtactttttgattctggtgcaacgcattcgttcatttcaaagaagtttgttgggatgcatgggttaataagagaggaacttacacaccgatgcgggttcataccccagggaatagctccacttcggttcaattcagcccttctataac

SEQ ID NO: 93073 - DNA, 697 bp, Oryza sativa
agcagtactgtaccttgaagtctctttccacacacccatctccatccttacatccacaacacgtcgccaatcctcattggcagcatacaagtttgacgctagcacataattccccccgtattcaggctccatttcgatcacatgatcgaccaccttcctcgcgagaatggcatttcctagatcccgacatgctccggtcaatacacgccatattacagggtcaggcctcactggcatagccaggacgaactcaaatgcctcttccagcataccagatttgcacagcaggtccaccatgctcccatagtgctccatccaaggtgtgatgtgatactcttcaaccatagacttgaacaattggcgcgcttcattgacgagccccgagtgactgcaggcattgatcacgctcaagaatacaagttcatcaggctggaaaccttgtctgagcatctgcgaaaactggacaagcgcagccaccccatgcccgtgcacggcgagggcctgaattatggctgtccatgagaccactgtccttacagtgatcgagtcaaatatctcacatgatctccttaccctccccatcttaccatgcatatgtatgagtgcgttggcgacacgggtattctccaagaacccattttcatgggcatactcctccacccactcccccagctctgacctgcagtccaacattgtg

SEQ ID NO: 93074 - DNA, 1654 bp, Oryza sativa
aattcctgcaccccacatctttatgaccactgaattgctgttgtttcctgaattttagctctttactgatcttgtgattgcacttttgcagccgggaaacgaatggcataactgctattctgatgaacactatttgccaaccctctttaatgtaagaactctcaaaaactcttaaatgatgttttcagttgtgtttacttcccagtgatttcaggccgttattgtacctgcagatggttgatccaactggaattgcaaattggtcagtgacacatgttgattggtctgaaggaaaatggcatcctaaagcttacagggctgttgacacaagctttgaactgcttaagaatatttcggtgagctctggtatacttgtacatgcaaaagaaggggaaacatacatgttttatttccttaatggccaattttcgcaaaaatctgcattcttgggatttgtctaattaataatgaaatttttgcagtccattgatgagagtattcatgttacaagcaatgcaaaggtagagttatttgatcttttcctcttcttgctttctagtactagaatcttcaagttagttctgtgagactgaacaagttctccccttctttactgcatgcatatttgacatgttcctacctagatttaacttgaaattctaatgtgactgactggctgaacaaatttcttgaatcaacactgtttctacaaatcgatttaattttttttcacattttcacaattcttttgaggaggattttgataaattgtttggtcttgcagcaccaagtgatgagaagaccgtgcctatggaatggcatgaagaggccttgctacctatttgcacggaaattctatcccgaggcactcgacaatctgatgaacattttctcaaacttcactatcatctaagggaaggatgaatcaaaaacctagttcgcatgtaacactacagtataggccttggaaaatcagaaacccagagagactcgctgaattgttttttgtgatctctcttggaacatcaaatgattttcctttttcgcgaagatgttgcatggtttgcagttgaaagagcagtcaaatttgttcctcactgcgctgttctgagcaaatgatgtgttgttcataatgaacttcgtagtcatccatctgcatattcatgggtgcagctacctgatcagtttgcctgtaacgctgcagtgttggcaatgttgtagtgtttcattgctgaggaagatgaaaaatccagagagatttgccaattttttcttgaaagctctcttggaacatcaaatggttttctattgcgaactgtaatgatgatgtttgagcacaatgattttgatcaacaacttccctatatgaagaatattcagtttgaagagtaaaattgtttttgttcagcaggaaatcgatcgtatcttccttattaggtaggcatcataatgtgaaatagagtaaattgcactttacactagataaagtgtagcttgtttaacgtatactttcactttacaccaacaccaggttatatcaaaacaagtttttagtttgcattaggttgtatcatataattaaagagagatcttgtaaaacatgagtaaaatgtacgaaatcttcttgaatttagactgttttaccccgtttctt

SEQ ID NO: 93075 - DNA, 635 bp, Oryza sativa
attcctgcagccccgttggtcggtggcgcgacacttgtcgacatggcgaacggatcccgaggatgatccatctgggctccttgctgcctccttgatgcatcatcgtataagctatcaagcagcagcttgtcgaaccctccagcctacaagagtcattgagtgcaaaaattggaaatgactctagtcacagtatgatcaaaagaatggcattgagcaatagagagttcttgaaataagcaatagagagttgttgacttaccagcttgctctctgtcagtagttggttgctgctgctgttggtgggttcagtgaccaacgctagctcccaacctgacgatccaagcatgccaccgaagccactgcctgcaccagcagatgtgttgctacctgttataatccaaaaggatgtgattatgcatggatttgggagaattactagtgattcttgaattatctaatcgggagatagtataggcagatgcatgctaatcacctggtgatacaatggccagagccagtgcattgttctcttcaagctgggcggcagcagggttcacttcatttaaaccctgcagtccaccataaattggatcaactgctaccatttattgcagtaaatagctgatatgaataca

SEQ ID NO: 93076 - DNA, 1589 bp, Oryza sativa
tatacatttctagagaatcaaaatgcatgcaactctacagaataatgaaagcacactgtgattacgcgtaccagatgtcctgttcttctgtagatgtcgaaagctttgatagcatcaatttttgtcatgtcgaagaactacaacagttcagaaatttaatttgatcaggatcatatccattagatccatcgatgattcaaatgcagagaaagctggtaaataataaaaggtaccatttcgacaagattaatgattccatcattgactgcacaataaatcttgaaactttccttcagcacctgagtaacattttcattcatcatgagcaagagcaattcggataaattgttctaactagtagtatctgaagttcagatatcagaattaaggtcagccacaataccagagctaatgcatactgtataagatagtttccaaatgcggctccttcaggcttcacacacagttacagcattggtaaaaatgagtcagaaactaatctagatcaagcagataacataccacaaagttaggtgtgtacattacctggcagccgactagccgatagagcagctgctgcagtgcaggaagttgctccaagagctcatccttacctaagcttctagttctactctgaccctgaacatcatatttcaattggtacatatttctcaccaaatggaacaaacaaaacatcacaagcaacaagatcactcatgccgaactatcaccaccgaatcattccctgaaatttagaagccataatcacaatttcacaaacctttggagctccctctgctgtcctcagacgctctgcttcaatgtcgtatctcagaactctgaagcactcgagcctctcctccaagaacagcgcgtacgtgcgcacccacgccgagcaatcccacgctgagcaaagcaattggagatttcaaatttgcaatcacaaagaaatgagaacgatcggtgacaaaattttttgaaccgattgagttcatgttaatccagttcagtttatgcaggaattcagattggattgggagctgacccagcggggtggagtcgtccttgaagctggacatctgcaggcaatggccgccgcggccgcgccggtagctgagaagctcctcccggaacgcggcgtcgccttcccgcagcgcgcggtgtatcaccaccagcgtcttgagcgccacctgcatcaccatccatccacccccgtcgtcagcagatcacgcggcggcgagcgatgaggaaaacattggcgatggcggcgtaccacccagttgtgcgtcttggagagacggcgggcgagggcgtggacgcagtaggacacgtcggcgagcgggcgggcgccggacgcggcggcgatgatctctgcggcgacggcgacggcaatcgagttagcacgcgaggtcgcgagcgatggattgggcggcggaggcgaggaggaagaagaggaggagaaggaggcgtactggagaggtggcgctccttgggcgggcgctcgacgtggttggtggccttgacgacggcgacgtcgaggtccttggagtgcgcccgggcgaggcccacggtggtggagtccttgatcg

SEQ ID NO: 93077 - DNA, 2008 bp, Oryza sativa
  unsure (1)..(2008): unsure at all n locations
ccgccgcggcgaggtcgagtcgtggctcgcgagtggctccattttttaaattttcgcctccatatatatatttctcatcctcccaaaatcacactaaactccctcaccttttcattattcccaaacttagaaccataagccatccaaaattgcaagtgttctatcagtccaaaaataatcgacgtttaagtaaagattgaaacttttgaagattttgccgttgatgttatactaaaataaatttgtaaaatctagcaaattttacatttttcaaagaaattccacacgtttttttgttttttttaaaagtaaacatatgagtcattattatcaacatttaaaaatttgatcaaatcttgtcctaaagtcaaatattcatgagcagagataaaaaggctacgaaaagttgtgaaactcacaggggtgtatttgcgtatgagaaacattctgggatgatggcacgacacaatccgataatgcgacgtgcgcaattgattcataaacactattggaataatggcgtgccaggccggccgcccattgtaatttggaattggaatcagttgaaaagatgcaatcttagacgatttttcaggctcccaaatttgatttggttcaagtcaaccccttgcttacatctggtgttcagtgctaatgccagcaatgctcaaccaagtgctgccattagcaaccagccatctggccctcaaatctcaaatttcagattgggccaatcccagttaggatcaatactagcatgaattgagaacgagtacatggtaaatttcagatatttgaactcaggtgagacatgtgcaatcttgcaaatacatgccaatatatatatatatgaatctgctatgaaatgcatttcagtatgggtttctttcttttatcagtttattattattacacagtgcaatcaccacaataggggaatcaatcaatcaataaaatcatgtgcactgttgttttgtggagaaggcatgtcagctgtaatctagtctaactctacattgtagcacaccatgaattttgctccaatgtgcttttcaccaccttggcataggcacctttctttcagcaaaatgtgcttttgttgcttttagaattcccaattatagaataagtgtgctgcgacttccttgtagtttagccattaatatgtgcaccaacagcggagatcgaatttttcagatccaaactgatggtcattgtataccaaaccttggaatgctggttgtgttttcataagaagactcggtttcacccctcattctaacttacggntgtctgcattgaatccgaacgatctgggttgtatatttgttgactgcactcttcaaccacctttgttggagctttgcttttaagcagcatctcattgtactctgcttctggatctgacaatgctacaatagccccgcctgccccaatcgaagcttctccattgtgcaggacaactgttctgatcacgatattcaagtcaaaagtcttgttatatgaaaagaatccaactgatcctgagtatattcctctcggactagtttcaagtgaatcaagaatctccatggatctaactttcggggccccggtcattgaacctcctggaaaggcagcctttacacaatcgacagggcttaggtccgacattttggttccacgaatggtacttaccatggtatgtacagttttatatgattccacatccatgaggcgaggaacatgcacactcccaggttcacaaaccttaccaagatcgtttcttaggaggtcaacaatcatcaagttctcagcttgatctttttcactgttgaaacacataagaaaatatcagtattgtgaggactggtaaaaccaaaatcataatgtttgaacagtgaaaaaagtatctatcagatacttgcctgtatttcaactgcaaacgtaggcattcatcttcctctggtgttctgccacgtgctatagtacctttgattggctttgcttccagaattgcatttcggtc

SEQ ID NO: 93078 - DNA, 622 bp, Oryza sativa
tgcccccccatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgttgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaatttggaagccatgttgctcattctaagtatgtggtctctaacaccacctgcatggtacctttctgtcacaagctgcttgatcagctgtgtagcataagtctttgaagagccagtaaactgactctttattctttcaaagtactctgagacagcg

SEQ ID NO: 93079 - DNA, 744 bp, Oryza sativa
ggtagagtgcctaacgcccatgagaaccctgtagccatctaactcacttgcatcgtttatgctgggcatttttccatcagtggtactgcactctgactggtttgttacgaataagttatccaatgatccccacaaggtactgctagttatatcaggcttatcgctttcaaggaatgagagcatttttggagaagcagtccatgctattgatataagatcctcagatagagagtctggttctattacaagtgagtgatagcgcactacctgaaaaataacaactgtaagtagagtgttctttgcggtgcatatagaggctgaaaccccaataatatggctagcaacatgagtggtacactaaccttgaatccagagtttatacctgatgggatgtgattaaagaggtagcatccattgtgttcaagttcactgacataaaaaaaaggggtatcaaaatcaagacatgtgttaactacttaactgaaagaacacctagaacttagaagattatgcatgacacacactaatccatagcaattgcacaaaataaaaaataaatgctgtacaggtcagaaagctgaaagtattaagcatgtaatagagttcaaggccttacctaagccggccatgtatagcttcaggagcatggacgattttagcaccatggacaaatcccagggcctgcagtggtaaaacaaaacggccatttcagttcaacctaccaccaaattgtccatgaatttt

SEQ ID NO: 93080 - DNA, 1193 bp, Oryza sativa
ccaaaaaaaatgggatttttctctacttactcagcagcagagggaggccgaccttccactgatccccagtttggggagccatctgaagctgtcaattccgatgttgcttcatcaccctttggttttgaagatgtaaactgacctctattgcgctgcatcctacacatacatagaaaatattttaaactatgaagatttcctgtacataatctaagcagaggtaatttagaaaacatgaataacagcaaaatataaatcctactatctgccacggtaatatcaaaactgaaagtaaccacaagaaagacactgatacttaaaaaggtactacctccgtttcatattataagtcgctttgacactgatactttgatctttaagtttgactaagtttatataaaaatatagcaatattttcaacacaaaacaaacttattatcaaaatattgtaaatgttagttctaacaaaactaatttggtgttgtacatgttgctaaatttgtctataaacttggttaaacttgaagaagtttgactacgaaaaaagtcagaacgacttacaatatgaaacagagggagaatagcttaataaaagcagccagacaactcaaaactaaaacacgcttttggtacaaatacaatgtataagttgccaagtttagattatattattcagttcacttccactatattaagtacattgttagcagagtgtattactcacagatcaaatacagcacgcttgactcttcctaattcaggtcaatcagcattcaaataggaacaaaattctatagcatttcagtacgtataaacatccacagccaatgctaagctagcaccaacctaagtgcaacttccttccgaacagaataccggatcttcttatcaaagttgcgctccttccgcttttctctgaaccgcatcaaagatgccacccggtgtggaaaattcaacctctgaaaccaagggaaaaaaaatacacaatgaactccagagtgcacaatcctgtcaaacataatgaactgatactacaaagaaagacagttcaccatcacccgtgccaaccttactgtatggcgcagatgacgatgctccagagcccaaacctgggttcagctcccttccaccgagtagcaagagcactgcttgaacctgcgagaagtaatcgaacactcagccttttttttttt

SEQ ID NO: 93081 - DNA, 522 bp, Oryza sativa
ctgcaccccactgcagaggtttctaaaacctttgatgagaagataaggaattattgtgacgtgacattgatgtcactggcatatgctgggacagggaacgtgcttaaggtgattcccaattaacagaagaattgtgcataggttgtaggattacatttttttagcgcctatttgttttgatgaatcttcccgtttgatttgcaggttcagaaactccttggaatttgctccgagcatcttgagaaaggtgaaacccaccaagggccagcagttcttggaatctccctaattgccatggctgaagaattaggggcggaaatggctgtacgttcccttgagcgtcttttacagtatggcgagcagaatattagaagggcggttcctctagctctgggtttgctttgcatatccaatccaaaggtaacagttctttttgtatactagtagcattaaatgtgtgctatcttcatgccgttgcacacaatcatttaattggattgttgagaaagaactatttaatag

SEQ ID NO: 93082 - DNA, 1506 bp, Oryza sativa
cagcagcaacatgagtcagtatcctaggcagctttcagtatcagattctgcttatctaactgacgacactgaaattgtgggaaatgctagtgtaactagaagattgacacagtgggtactagaggagagacaagatcgatctgtcatgtccatcttcggcatgggtggggtaggcaaaacaactatagcaagcagtatatttaaaaaccaacaatttatgatggcctttgcttgcaatgcttggattactctatcccagagttatgaaattgaagacttgctaaggcaaatcagcaagcaattgatggaccaacaggtgtacttggctagtaatgtcgaggctatgaatcgaataaaattaattgaggaacttcagatctacctaaagcgcaggaaatatctaattgtcttggatgatgtatgggataaagatgtttgattattcttgaattatgcatttgtcagaaacaatcttggaggcagggtactgatcaccactcgcaaaaaggatgttgctttcttagcagatcacaattgtgtagttgagcttgaagctcttccccatactgaagcatggcatctattctgtaagaaggcgttccgtagattggaagataaaatgtgcccagaaaatcttagaccttgggcagagaaaattgtgaccaagtgtcaaggattgccactggctatcgtagccatcggaagccttctatcataccgtgaattcgaggagcaggagtggaaactgttctacaaccaacttggctggcaattagctaacaatccagagctcaattggattgccaatattctaaacctgagcttaaatgatctcccaagttatctgagaagttgttttctatattgcagcctctttcctgaagactgcaggataaaagaaaaatgcttgttgagttatggattgcggaaggtcttgtagaagaaagaggagatggaacaacaatggaggaagttgctcagtgttaccttacagagctcactcagcgttctcttcttgctgtcatagaaaggaatgcatgtggaagggctagaacatttcgtatgcatgaccttgtgagagagatggcctcaatcattgctaagaaggagaggcttgctttttcatatgacaatgttggtataacccaagttgcccatgaataccgccgtttatggatccaaaaggacgctcagtccctcaggtatttaggaggttctaaactccgatctttcgttctgcttgatatcggagaaccatcttcttggatttatgatgctttatcacgtttcagactgctaagagttctgtgcctgagatttgccaatatcgaacaagttccaggtgtggtcacagaactatataacttacattatctagatttatcgcacacaaaagtgaaacatataccggcatcattcaaaaaccttatcaacctacagtttttagatatcaggtccagctatgtggaagagttgccgttggaaataactttgttaactaatttg

SEQ ID NO: 93083 - DNA, 1107 bp, Oryza sativa
cccctttgttttacaaaccaggcatttgagagttattgattgatagagctttaaaagtaggaccaaatcttgttctaaacgttaaatattcattatcgactatcgagtcgtgtgagtagcccatgcattcagatttggacacattaactccagatcatttcatagaggcttcaaagcccacatatattttacagccaggagcacaagtataacaacatggaaatacagcatcgtactgactattattttctttctactaagctacaaaaaattacagcattcctcagcttgaagctttcagaggcagacatagctctagctcacctggagccacttacattagtctacttaaatcccatagctaccactgggattctcacaaggtgacctcggtcccctttcatggggatctctccaaaactgtaggtgccagtcactgacctggccgtgagggtcgccgttatctctctcgatgcgccggggagcactgtcagcgctggaggtgagacctccagcgcgatctccggcgacattcttgtcatgatggtgtaggtttcggcctcggcggccacgcttgtaactgtccgcttcaccgtctgcgtgcctctaagctgggagatggtgattgaggggatgttgagatcataggggcgctgctgcaccttggagctggagctgcaagttgaaccagttatgtttgatacttcactgtgttccacgtcggggatcgaacacaaaaatgtgatgtaatcttgatgagctaccaacaaaaaaaaattcaaacttagaatggtcttcagattattgtctgaataacatggagcagtttgaatttattaaaaaattgcatacgaaaaatttaacttacttgcatccagaacaaggccaggatccagggcggcttttgggttaaccgcaccactgccataatcaaacggcgtagccgtgtaagtgtcataatttctgatgtagagtactgttgtgctcttaaaggatggctccccttgtccaatgtattagatgtagtcatcaaggcagattttattgctgagggactccacttggggttcttctgttttattagtgccgcgataccagcaatatgtg

SEQ ID NO: 93084 - DNA, 508 bp, Oryza sativa
ctgcaccccgtgcatgggatgaggctcacatggcgtgctatgataaacgcgaattgcttcttcagttgaaaatcatcagttgctgtaaaaatcggcttcaactccagggactacaaatcaatgaaatatttgtcagtgccctaatgtactggacagcaaataggacatgacaatattcatcacccaccttgtcataaagcagaagtgcaatacgcaaagcatttgcaaaatctccaaatttcatgtaaatctcaaaagctattttaagtgccgacatgtcatcaggagcaggaagatatctgcaagtttgcatcccaacacaaaagagtaaatgaagttcaattaagtaaaactagataatactaagctttaatcaagtgagaccaaattcagtggcatacttagaagaactagtgaggtacaagcaggtccttttgtagttcgtggagtcaacgtgcttaactagcaaatcaagcttttcgacctatgaagcaatttgatatcacac

SEQ ID NO: 93085 - DNA, 814 bp, Oryza sativa
ctgcacccccagcatagcaaatatatgtgtaaacgtggccacttgaaagttgacacttcatagtgtaatataagagcatctaacattacaagccttgataataccgaattctgcttcacgtactcatacaacacattagtccatatactacaagtagaggtccacaggaagaacaactccagaatgctgtcttattcgcacatatttacataagaggtcacctgggcgacatcgccatagcttaagcttgataggcgcgacaatcgcgaataagatttatacaaaaaaccaacatgtgaagatcttagtgtagcacgttgccttcacatgttcgttcttgcctgtcacatattcactcctgcaacaacctctgggtgatagtggagcatctcctgccacatcatctcccggatcatatccacgccaagattttcatcgatgtcgagatcgatgggcacttgagcaggagggtttgcgcttggatcatacagtggagacatgtaagggtgctccagagcttcagtgacactaatccttttggagggatcaaagacgagcatcttctgcaacagatcaatggcaagaggatgtgcttgcgggtacatactggtgagggggatgccaggagtgtatggaagggtcttgatatacttgcgggcctttgggttgtcaatgaactcaatgtcagcttcactcatggtgccgagaacgttgactatgagcttgagctgattgaggcactcagttcctggaaatattggcttgcggccaagcagctcagcaaagatgcagccaacagaccagacatctatgg

SEQ ID NO: 93086 - DNA, 697 bp, Oryza sativa
aatgatttattctcatgggttgcagctgtagccaaatgagaaaactgtaaattaaccacaagtagaaatttctatgtaactgtcagattgcctgcatttgttgacatgattgcaatctagtaacatatttgctatgggatgcagtaacatatgacagtggaattacaaaggaagaaaaacagaggattgtctctttcacacaaagtattttcacaatgagataaaaaaacacaatttcgtataaagatctacctacagtcctacaccctacataacaaaaaaaaatcaagtgcagctgatgctgccctatcattcatacttctctaaggctgtgttcggcagcccctcttcccaacccatctccctcgttttccgcgtgcacgcttttcaaactgctaaacggtgcttttttgcaaaatgtttctatacgaaagttgcttaaaaaaaacaaattaatccatttttgaaaaaaaaaatagtaaatacttaattaatcacccgctaatcgctgctccgtttccgtgcgggcacttagtgttgggaaccaggggttccgaacacaccctaagcgcagacaacaacattgagtgatttttatttatttatttattttgggggggggcgaagttaaaaggtaggccacttagcttaggtcattttaattcattttgtacaatttttgttgcccatgaatgca

SEQ ID NO: 93087 - DNA, 693 bp, Oryza sativa
ttctttcattggggtgaagaaatacattatgcaattcatatgatgatatggattagggtccaacctggcgcttctggaattcctgtgcaatttcaccagccaagtttctagcaagcgagacattgacattgttagaaaatccaattcaaattcaaaagacaaacatatgtattccaacagaagacctgaaaagaataactttttatcaataatttcttgagtacaattcaatatttttttaatacactgagaacagttaaatatttgaccacaccataaattctaaataagctgatatgaaggtaattgtttggtaattcatcataaactacctcaggaataaatctttacaattaagattcacaagcagcaactgtctcattaataaaattgcaagctaaacaatttaggaggcctggaaattggtgtcacctcacatattcatgaccccatgaaccaatgtcaccttcagagcctatcattcggtagttgaggctctcctgaaacgataaaagaaggcatattagccaattcttgaaggattgatactgtacagttaatggtgagaaaaagttgaactctatctgtctatcatttaaaacccacgaaaaaatgtatgactatttatagaagtaaatcattctcagaagttagcatgcaagcaaattaaaaaagcactgggaaattgacaca

SEQ ID NO: 93088 - DNA, 618 bp, Oryza sativa
aaatttcagtttcaagaggaatatacagaatactcggttcaaaacccaaagtgccaagcatgatatgtgaaattgtgttatctgcacagcttaccgtgcgaatgctaccaacattggatttagctttaagggtttcaacgtcacgatccagttgttgcttccaatctgtgagtaatgtttcatcctgcaaattcagttgcttggattagataatatacttgagcataatacttgaacaagataacaagggatattagcacctgtggaagttggatcgaaattttgttagggaaaagtttatttagatgtttcattgccttcggactttctttgttcctttatgcaaccgactaccaaaactatcctgcattttagatataacaatgcatcagatagttatatcagaaccatgggttcatatagtgcatttataagcactgatagaaagaacattgtgaccaataagaatgaaaattgttaccgggaaaaggtcaaatagcgtctggctgctactagcaaactttgtaaaaagaaatccacctgggtgggcctacaacagacaccatagcacaacatcaggatacattttatagtgtacttaacaagcgataaatgata

SEQ ID NO: 93089 - DNA, 702 bp, Oryza sativa
catgtttgaaagccttctgactgaccagatgtaagactaatgacaatatcaacatttctgatggtcagatcagaatctctagaaaataattgcaagtactacataaaatggttccctaacaaccaccatataaaaggataaagccaaattatttttctctaaacaatgaataaaagggacaagaattaccacctcaaggatccacccaatatatttaacattgttcacatgctgattgacatcgaggtcaccccatctaggctgttgcagtaaacaagagtccatcaaagatcatttaaaataaatgaggggtgagatcaaatattactatttttcttagataaatgattgcagttgaggcataatgataatttagtatgtaactatgtctagctgacttacagtgagcccctttcttatgaattgctctgtagcatcatcaccaactttatttcctgtcttggctaacttttcactctgctcctctgttatagctgaacggtcattgaaatatgggcctatttcagctctaacttcatctggcatttttgaaagtcttctagttttcttgtgcatcatcacccaaacactgcaagaaaggattggaaaaggagcacaattagcaattatcaatgatgtgatcaagcagaaataccaagattggatatcctcataaaaaaaacgatacagatgattcttgca

SEQ ID NO: 93090 - DNA, 1450 bp, Oryza sativa
  unsure (1)..(1450): unsure at all n locations
tttgtaaatgtaaataaatcacttgctaatttatttttaaaacggagcttatcgctggaaaacgaaagtacatgcccgttctggcattcccactcaacataattcaagatccaaggaagcacagagaagacatcatttaatgaggcagctttgggcaatgaataaggcgtaacaaatgaagttgctcttggatctaaattactactccactaataactgacgtctaaaggagagattactgttcttctttgtttttaactgatgttgtgtcttttgaggacaacatagagcaaggatagctacagacttacagtgctgtaccaaaaaggccttggggcatcagaacttttatgttgcatgtactaaagctagattatgtctttaatgaggattactcaagatgcaaatcctgtttctaaatgcaaagaaataacttgatagtttgtgttataatcagggctcgacaattggaaacaaagtgcatgctcctccccacttaagtaggaatatattcatttcttcctaattggaaaatttagtttgccacaaactctatccttgatccaacaaaactggagctgatattactacacatttcttagtcaaccaatgaggaataacagcacctcctaaacatgaggcctatcacgggaaatcaaagaaaaacatggccttctatagcagtaaaaatttcaacccatattcttgcaaaccagcagcagcgaaatatacgaccaagtaaaagattcacttgattttcatcaaccaaccagtatatggagaaatcagaccagagatccacncacatttatgataacccatgtaaaagtaaatattgagctaaatactactgttgcctgagtaagatcttcttttaacgaaatagaaacaatatgcccaggacacgcagctataaagtagtacataaaacgatatctgtaaaagaagcaaaacaaatatgaagtaatttaaaatgtgacaaaaatgaaaacttacggtaaggaattgatagaaagcaaccaaagatacatatattaagaggagcaaaggtttgcaaagaagtaccatgcggggtattgctcaacaagaagctggattttgctgacaacccatatcaagttccgtttgctcatctccggtgtagccccaaaaccatctccaagaagaccagcagtcctcacatggttaagagctgtttcctgcaaaattttaaataattgccagcttgaaagagacatatgaatctataacaaaatgctgaaatgagaaataaaactaaaaacagaatgtgcaaccacttacctgtaaatgattcatcaatgtctctatagaagctgtacgatcagcaccaatctcgtaggaccgaatcatgaagttttgcctaaacaccataccgtcctggataatcctaccaaagccaaatgtgtcaacaagcatgtcaggtttcttt

SEQ ID NO: 93091 - DNA, 650 bp, Oryza sativa
tatactttgttaggaacaatctatgctccacttaatcttggcagccccaagcattcttgcatccattgtggtgctttattttggtatgaagaacgagcacgaaaagaaaggcacacgaggaacccaacctataatttatgttgcagggggggaaggatatcactgccatcttataatccacctccagaacccatattgaatttgttaacttctgcgagctccctttcaaatcatttcttgcagcatattcgtcgatacaattccatgtttgctatgacttcaatgggggctaaaatcattgaatccatcaacgacggccatggaccatatgtcttcaaaattagtggacagatctgccacagagtaggctctttaataccttcacaaggtcgtcggccagaatatgctcagctatacatctttgatacagaaaatgaaatctctaacagaatcaacattgcttcttcttctcgcgactccttccatgccaatgaagaaattgttcgctctctaatagaaatgttcgatacacacaatcccattgtgaagttattccgaacagcaagagaaagattaagtgaaaatgaatctgatcattacaagatccgactatttggcttgacagatgcacatgtagatatatatagtgc

SEQ ID NO: 93092 - DNA, 790 bp, Oryza sativa
  unsure (1)..(790): unsure at all n locations
ccggtcggtaaaaagtaaacgtccaacaacgncggcataaaggccagcggtgcaggcgaaacaccagtcgctgcgccgaaggcaacccggtcggtgaagatgtagacgcccaacagcgggggcataataggccagccgtgcaggcggaagcaccagtcgccggcggacaaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgtccaacaacggcggcataaaggccagccgtgcaggcggaaacaccagtcggcggcggcggaggcaagccggtcggtgaagacgtagacgcccaacagcggcggcataaaggccagccgtgcaggcggaaacaccagtcggcggcggcgaaggcaagccggtcggtgaagacgtagacgcccaacaacggcggcataaaggccagccgtgcagacggaaacaccattcggcggcgga

SEQ ID NO: 93093 - DNA, 2222 bp, Oryza sativa
ctatgataccactagaaaacctaatggtgaaaacgagggttatgtgttggaccatagaaatggttcgacttacttacatactgaagataagagcttgaagactgagaaagagtctgctacatctggattgactgataaggatttttcaggtggtgggaatgatggggaccacaaaatctctcccattgttgttgataagtctgcatctatgccatcaaggtgcaagaatgaaactacagaagcatccatggcagttcctgcttctgaacctgttgatcaatgggtgtgctgtgataagtgtgagacatggcgccttttaccttatgggatgaattcagatacacttccaaaaaaatggcggtgtagcatgcagagttggctgtaagtttctgcaagaaacgttaatcagattcattctttttttttaatcttctcatttcatgctttatatttgtctatgcactggtttctgtgaactgaaataactgacaggagtaaaatttcccttcactatatatatatgcaccataatttagtttcatcagtggaaattcaaatgcagtcttttcattttctaactgccctgctgcctgagagagaaaacaactgttgagatcacataattgattttgttctggtttatttgtaatcttgggattcatgttttccttcaaggatcttctggaaaattttatctcccgtcatgttgtgatgttgcagactataggctattggactattatatcattgcttggaaatatttagttttgtttatttatttatttttgcatttgtggtgcttaatgttatcttcaattgattggtacttttaacttcttgtaggcctgggatgaataactgcaaactaagtgagggtgagactacaaatgccatacgtgcactttatgtggttcccatacctgaaaataacatcagtttagatagtcgttgtgatactgctacattggttagatccaatgatgcagccattatgtcagataatttaggaatgccagaaatatcaaagtcttcgaagaaactacatgctcctaggaatcgtgatggtcttgactgctttcctaaactcaaggaaaaacagaagcgcatagaatcatcagataaaggtgaaaaatctacgggtgttcttcatttagaatctattatcattcattttattattaaaggtcaccatttcctcaggacaaactatggcaaaagatcggatgcatcgaaaacggaagaccagtggtgctgattatgataacctgatagcatcaaagaaattgaagaaagtatacaatgagcctccaaagcaccaaccccctcagtttgaactaagcaaaagtagaccttcaaccaagggatctctaaaagaattgccgaagcatactaatatttcacctggcatgggaaagcatgctttaccttcatcaggtaagcagttttgtgatggagataactcgataggggtgctagagcttcggatgcaggaaaatctgatcctcgggacttgttcattaagaagaacaaatcaaaacaaatgcagttaagacagcatggtcctgatcctcgacctagtgatgcctttgcaaaacatgttgtaaaagaagtgttaagtgaaagtaatgctgccaaggaaaagcttgggtcagacctgaaatttctgaaggtagatgatcatgagaaatctgctcatgccagaggccctgtcactgggactaatagcaatgcaatattcagtgagaaagaggatttaattgagcaacacctggagaatatccatttccagcacccattgctctctgaaagctcagtcaggaggaatatctgtaatgtacaagcatctacagctgccacttccagttcatccaaggtgtctagctcccacaagaataaacctgaatttcaagaaacaaggacctcacctgtagagtcagtttcttcatcacccttgagaacttctgacaagaaacacttggatcggcatagaacgaattcatatgcagtggcagaaattgtgcattctcaggagtcagtgaaaactggtgcttcatgctcgaaggaaaaatatggttttgaatgtggttctgatcacacgaaacctcatgtttctggttgctctaatagagtcatgcatcaagatgctttggaggatggggacttggataaacaaaatatattgacaaatggagtctttaacaacagaagttctgggcttggta

SEQ ID NO: 93094 - DNA, 530 bp, Oryza sativa
catgtgttatggtgttgcgcttctccgtgaaacgtctgatgtagtcggagaaacgttcattatcaccctgaataatttgatatatagaggtcccaggggtgccacgagtgggaacgtgccttggaagttggcgatgaactggacctttaactcggctcatgagtcgatagcattcttgaggaggctagttagccaggcccaagttgccgaagtaaacatcgatggcaaataattcgccatagcgcactggtcacctccggcagcttggatggcggtggagtagactgacaaccaagaagtggggtcagattttctgtcatatttgtcaatcccatctgctttaagttggcaggccactgcacccaacggagggtgttggtgaaggcggggaccccctctgcttggtcagggtgatggaagtggtactctatagattgaatctgtattggtgtgtgcacaacacgacgtgtgaatagcacgtgctccctccggtttcattttaattgacgttttggacaatgacgggctgc

SEQ ID NO: 93095 - DNA, 3118 bp, Oryza sativa
ccaatgttaaatgcagttgcaagaagtttgaatttgctggcatcttgtgctctcatgcactgaagatacttgacgtcaacaatattaaatcagttcctcaacatatatattaaaaagatggacaattgatgcaaaagtattgcatataagtggcaacagcaatatgcatgatgaccctagaataaagatatcagatcgatactcctcattgtgtagaatgtttgttcgaatagcttctacagctgcaaaatctgaagaaacatactccatgtctactaattgtgctgaaaaattggcagaagatatagagaagttcttgagaatcagaagtgatccagatttagacaagtcgccttccccacaaggttcgtatcaaagttctatatgttaattataagtaatattatagtctgaccgatacaattctaaacatattatttccagttgggaaagaaaatcagatgcccaaaaagccaagaggcattaagctcaaggaaaagggcatccatggttcagctagacgtgttggtggcttagagaaagcatcatcgcagaggaagagaaagaagaaggatgacgatgttccggaccatgtgctagaaccacaacctgagatgcagtcacaaccacctgctacagtaatggtatatttctcacataattaatctccaaaatcgcatgctcttgttatcatccctgacctttcctctgttttttttttgttatgttagggccatctggaggttcctagcaaccaaacttttttacatgtatcacagtactatgctgctctggaagcgtcaacacaccctttatttcatactcctatctcagtgactccagaaagtcaggggctgcaccaagggaggccatttcaacaatttgacactgatttccacaatatgttcccctgacctacttgcaatattaatttcttttagtgcaacaacatttcgtatttttaatttactgaacactgcaatgaagtttacttattagtagtaatatgtgtttttggtcagattttgaataaacgatgtgcaaactatacagcaatcctcttcaggccacaagatactatctaaatcatgcatagcattcagaagttgtcaaaaattgaacagatctgaaaaacaaaggcaacaacattgggattgggatcttactgaacaaaatcaagtcacacgggctggattggatccacaggttggcgtaatacttgacgatgttagcatcgatcacatcatggaccttctcgatccaagctcatgcactttgatgcagctggacattgattaatttgcacgagctgaaccatgcatcagctccaactcagcggcaaggcgcttgatcagtggtggcgagctcgagacaatcgactgctcgggcaagcggtgctcgagctcacccgtaaagcggcggaatctggcggagttcatctaggtcaaggtggggaatttttattttgttgtagtaatagtagatcagcagcatggagagagacgatgccttctgttgggggagggaagggatcaagggattacgccgttgtgtgaaaaagaacggagacgttgacgccgtttaagtgaaagagaagcgcatgcgtactggcccaccagaaaaaactcggcaaataagaagatgacacgtcgccaggaacaggaaaggaacaagcgtatcgggacagggaagccgcatccgctcgctggaggcatgttaactgatatcctacaagtggaatgctgattgagatttgagcatatctgaatgaatatgtcccaggagaactgtaccaactaacactgcagcaccatgttggatttactcccacatttctatttcgaatgtgcaaaaaccttgcaagtcaatatattagaaaaagaaaagatgtttataactgcaatgtgctgacgtagttagggaggattaaagggaaggggaaaaaacactggattaagtaggagaaaatcgagccctaaccagcaagtggaaaagtgaaaaagacaagctagggtctataatagtggggagcacaacttatggggatagcactcacccaaaagattagtgtgtgtgtaaactaggacttaaaagttgtagctctagttagacctgtgtggtaaaagacccaatatgatctagatgacccacggttggtgggtcgaactacgcactctaataagtggtattagaacccatgtttagtattccaaaacaatttctatggatcacataggaggagctatgataacaagtttctagggtcacatgggctcagcacagattattaggcttggctcgaaacaagtgtctatagttatatgggttgatgtgataggggagcttgttaatagttttatattaaaaattatttttggggggaaggcgatattctgtattttaaaaactaatattttaggttgtgtagtcttatgacttcaaatgatgatttatgttggacctatagcaggtccaacgtaatttggggccacagttggagagccactcttcctggaggtttggatgggctgattacccgcacgtaaaatgagaaatgtgattagcacatgattaattcagtattagtttataacattttgatgaataaatttgttggattttttaagcaacttctttatataaagttttttttatgaaacacaccgtctagcagtttgaaaagcgtactaacggaaaacaagtaatagctaatccaaactactccttccgttctaaaataaatcaactcctagagtttgaaatttgtcccaaaataaaccaatttctaccttcttacctaccaccaatccacaaatcgagaaattttattacttcaatacccctcacctacctaccaatcaatacaagttttacattaattaagggtactatggtgttttgtttctttccttaatagtttcttgggatacaggtttgtttttttttgacagagagagtagctacaaagaacgcagccttaacatagtatgtgggcctcaagtgtcctctgtctttgccatatccagtgctctgcagttgtaaacaacagtataacaccgttgaaatcatgtcaccgggaccgggacgtgaatttttttgaaaattaatattattttta

SEQ ID NO: 93096 - DNA, 2695 bp, Oryza sativa
tgagaaacaaaggagttgtactgttgcatcggtttggttgcaggagatggcacttgttgccttggcggagcagcatacggcgatgaaggagctggataggtatttgtgggggcaacagaagcaacaggagggttctgcatctggtatgttgcaggctgaaaaggattggttgagttgacacttgctggcatcgcccatggtggtgctgggtagctagatccatattgttgcatgggctgagtttgatatgctcctccagcctgtgtgccctgtccagcttgggcccaaggtacaacataattgttgtatggggtgtaagcttgattcgttggatatgcctgctggttagaagagtaatgtgatccatttgatgcagcaggctgatagtttggtggtaattctggcccatttgacgtgacagactgctgcgtgccattttgggtctgtgaagaagaatctgtagatgcttcaggggggctgtacagggtgaggcttagaaggtcgatcatgtcctgctctcttgtccgagtaccactggcaggagacgagtcaacaggcaccactgcattgcttgcaacagaagatgaggcttcagaagttactgggtcaacgggtacaagggcctgatcaccagcactggatgatgcctcatcactacttatcacagatttgttttttctgcagatataaaaagcattaagactaaatttctgataatgaatgaatagattgcctgttaaaggatacttttaagtaccttcttgctatctgagcgaactcgtcatcttcatcctcttcaactggaggtgcggatggaggtgcaatcggaggtgcagatggctttatttttggatcttctctgggtatctcgtctttccttggtgtttcgaccggcaaaggagctccagaagcaatggcatcatgttttgcaagtacgctctgtaagtgatcattgatttctaggccttgcttcagtagctcctcatttctaaacaacagaaaccacaaaaacatagatattaatttctgcagtctggattatagcaccaattatatggcataaaattagcagaatgcttatgcatgtgctagtgaaaaacagcaaactttgaagtcacttcagggaaacaccaagtggtgattggaaaaaggaattatatctttgtacagtttgagagaccgagtcttcagaccttttttgacattattcataagcaggaaggaacacaaactagaaatccaacgagcttaccctgtggaactgacaaatcgcatgagcttttgttgatttgatcggcattgggtgacaagctctgaaataatttcatctttaacagcctggggtcaccaaaatgttaatagatcatttgcgtgaacttcaacaaaactagttttgtgttgagaatttcaccctaccatgcgatcagaaggattcaaagcattcaccatatcacacagaagttctgttgtatctctaatattatttaagtcccctaaactgatgacaaaagcaataaaaggttataatcataaagtaagataacaaaaaggacagctggaatgagaagagctaataagtagtagattgtaatgcaacctcagagtttcaacatcggatgtcattctctcatttagacttccagcaggatatgtaggtgaaccataagactgagtatgatgtgttgcagggggagtaaatattggaggagcatctacagggcgcctgggaaacattattcctgacctctgtaacagattttgacatcagctattatggtaaatgagatttatgtcctaagtagattataagtaaactaaaaggttgatgcataccttaagttcaatgtatgaccagtaatactgtggatatttgcctccaggtccaccaaatgcttcttgccatgagtccagaagtatcaatactttatccctcacttgagtatcatgctgcatggacattcagaaaatgaatattctcagaaaaacagcatcattctaaatatcctgacacaattatatacacctcaatcttactggttactcaattaaaattcagaaattaaagcttccataaattcttaacacagaaagaacttccactgtttgggtgaggtaacttctttttagactgtttatttagttcaaattcctaaggatttagatacaagttcccagtatccaaacaggcctagtgccaaaaaaaaaagtacttttacttttctttgctaattaaaacaacatgagagcagtaacgagagtagtggctataaccaaagcagggagattaccttcttctggacaattctaaccatttcttgcaaaatatgttgttcaacaacttcaaaatggacatattcaccacagttcttcatcattgtctccaacaactgaaaagattttgcagccaacgtcagacaagaaaaatcataatcatgaagtagtgttgatagaagaataatttgatatgctcccttaccatgtggatagtcaggagcagataaataaaacaatatatgtgtaaatgttcattcaatcgaacaaattgacgtttgtcaaaaaacatccacataccgtcaaagtgaaaaactgaactcttggatctttatgttgcaaccgcttcttcacagcttttaccacatcctttgtttgcctgattcaaagtggaaatactttagtaatcactaatcattgtcca

SEQ ID NO: 93097 - DNA, 2316 bp, Oryza sativa
cctgttaatatattgtgacatgtagaatccaagaaaaattccacatgccgattctgattattatttgcatttattaattagagaattagctctaggttaattaagataatttcttcggacgatttatttagccaatttttaaagcaagcaaaaggggggaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgagagacgtggaacacattatggatgccaagcatgttggagggaagctcaagctggtaagcaacttcacccctgcgttccaaaatccgatatggtcccacaaagcgtggtgccaactttcctttggtttggaagcggtgtactcccctgagcggagtgacacggagatacacataatcccctacttggaaaacgagctcccttcggcggttgtctgcatagcttttctgccgagattgcgcgattctcaatctttccctaacagctctgactttctcttctgcctcatttaaaacttctgtaccaaacaactggcgttcccctgtctgatcccagaagagcggagtacgacacctccgtccatacagtgcttcaaatggtgccatctgcagactagcttggtaactgttgttgtacgagaactcagcatacggcaagcttttgtcccatgccccaccaaagtcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacatgattcttgatagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaactcagctatttcccttctcatgctgacccaccagaacttttctttgaggtcttggtacatcttagtactaccgggatgaatggaatattgagtttgatgagcctcggttagtatcaggtcttttaattccttgttttcgggtacacacaatctttctcccatccagattgttccttgttcatcctcaacaaaacctcgggcttttccaaccctcatgttctttttgagctctgctatttcaggatcacttgcctgagctatgcgaacctgctccaccagcgtgggctgtgcctctagggcagccacgaatccgtgctcaactataccaaggttcagatgttccaaatcgcgttgaacctcaccacatagttgctctacccatgcaacattgcagtagctcttcctgctcaaggcatccgcaaccacattagccttgccgggatgataatgtattcccatatcataatctttaattagctccaaccatcttcgctgtcggagattcagatcaggttgggtgaaaatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggctttagcaatttagagaagttctcaatgaaccggcggtaatagcccgcaaggtcctaagaaactccgaa

SEQ ID NO: 93098 - DNA, 2018 bp, Oryza sativa
aaaaaaggaggcccaggcctaaggagaggggaagagaaaaagaaaagaagaagaagaaaaaaggagaagaggagggcctgaaactctccctggctctccggctctcggtattcctcactcacagatccaccaaaacacaggagtagggtattacgcttctcagcggcccaaacctgtctacgtcgcctgtgtcttgtgcactttctcgctcgctgacgttcctcagatcgagggcgaagaatctcacttagcgcccccggccgaaccggcaaaggggggcctgcgcggtctcccggtgaggagccccacgctccgtcaaacactgttgagtaaccacgtccttcgacgtacgcagttatcgcttcgacaacactccattaaggaaagaaataaaaaagaagaaataaaaacaaaaatacgaggatgacctagactcgaataaattagcaacagttccctagcaacgacgccagaaatgcttgttggaatttcttacaaccatagataaatccgaagcgcacggaataccactgtagcactttacattcggtgtcatgccctgaagtttccccgttcttctttctttaaaagttggttgaataaatcgtccgaagaaattgttctaattaacctagagttgaatccctaattaataaatgcaattaatagtcagaaatagcgtggtggaatttttcttgagttccccatgtcctaatgtattaacaagatttttagtggaattttcacagccctataaataattttaaccaattaaaattcattaaccgctgtcacaacctgaattttcgtattaggatttataaattatttaataaattattaatagaatttatattaaatgttcattaatttacaagtgaagttaaatgtgggaaataaaatttcctaaatataaagcatggctggatttattttttattaaattctccatgattaattatactctctggaattttctcgaatttttcagagctcaagtattaattttaataatacaaagaatatttcagtaattatttaattaataaattaatcattaaatggtctggtttcaatattattaaatacttagagtgtccaagtatgttcaagatttttcttttaattatttgagcattggaagtatttttaacaattgaaagatcatctcattggttaatttatttggaaaagtaataagaattttcccctcagcttgggccgaattcagctcattctctcccttcctctcagacgcagaaaagtctgtttttcgtccctctcgctacagtgctccttcttctacctctggacagcgcccgagctctccagcctgtgcacagctgccgccgatatccttccaaatccgacctccccgttgctcctctttccaaattagttgcgggaatgggatcctctcaatctcctcttccttttccccaagaaatcactaaaagtttctatggaaatcttttccaatttcgcggttcaatctttccttactccggcgagaaccctagactttcccgacttttcccgtcgatttgggcccggacccgagctcccgtgcctatataaaggacccactagtcgtcctatacctatcctctcaagtcccttcttccgccgccgccggaatcgctctccccacgctctccttctctctccaagcgccggcgccgctccagccgcaccgttcgtcgtcgtctgtcgtcgctttcggtcgccgctgccgccgttggattcgcaagaaggagaggaagaccggcctccacttccccgaagacgaagacctctggaagtacctcgccgacaagaatccaagcttcgccgcctccggccgccgctgcagcagccgtgcgccgtctcctaggccgtcgccctcctgcgccgacacctccatcggctccgcaaggtcgagctctaccccgtctaccggttcccctccgccaagtctcgctggaagtcgctgtcaccgtgaaggccgagtttgccgcctcggattgatctccggccga

SEQ ID NO: 93099 - DNA, 850 bp, Oryza sativa
gccggaggcggtggtaggcggcggcgctagcggcgagtggcgcgggcgcgatagtaggcacgggagagagcggcgagcgcggaaaaaggaagaggggactccggggagggattttataggcgagggaggggagaacatggccgggaggtcgtggttggcgccggcgacgacgtgggggaggtggggagagagagggtgttgggggatttcaagtcccccaccacttgcgggcacgcgcgcgggggagatgcggggaaggtggaggaggtgggtggcgtgggcgcaaggtgcgggagcgagaggcggggaaggtgggcggcatgaggagcggtggtttcggtggcggttggcgccggggcgtgggcgactggaggtaggggacgacctgacaggtgggccccacctgtcagcgtcccagagaggagagtggggtgatgggccggactagtcaaggagggagagaggacgcgggaggaaggaaggttgggccgacggcccaacaaaggaaatagggaggaaaagaaaagggaaaaagggaaaggattctcctgggattaaatattgcggttgtcacgcccggaaataccctagtaatttccgaactaatttgtgcatgaaatcctcgtccaggaatcagccgaggtacacaaactgacaatttaatatacagattcatcataataataacgttacatacttacaaaagaaaagaaaactgctgcggaattacggtctagcgaagctccggctccactctcacaggcagctcaactggggtataagccaaacgtcttctcctttgcgacttgtcttcaactgagatttgattgattattgcaaggtgagcata

SEQ ID NO: 93100 - DNA, 694 bp, Oryza sativa
ggagaagttgcttatcagctagaacttccatccaatatgatcggcgttcatgacgtgttccacgtgtcccaactaaagaagtgcctaagagtacccgaagaacacgctgattcggagcatattgatatccaggaggacctgacatatgtggagaagcccggtcgtatacttgattccagcgaaagaagaaccagaaacaaggtcaccaggttttgtcgagttcagtggagtcaccattcagaggaggaagcaacctgggaaagggaagatgagttgaaagccgcccatccgcacctcttcatcagctcctccgaatctcggggccgagattccggttaaggggggtaggcttgtcacaccctgaagttctactcccaagcctaaaatttaatttataaatgaccctaagaaaatgccagtgcaaattgagagaaaaccctactaaagtaatgcaaataataatcgaaactggcatgtggaatttttcttgagttctacatgttttggtgcattttgaactttttcattccggtcaaaaacatcgcacccacgtgtgccaataatggcattaattgacaaaagttcgccgcgcgaatcacaaagtgagtttttgccacgaacgtacccaatagactccaatatgtccaaaaatcatgttttggtgctttttaaattttttcattccggtcaaaaa

SEQ ID NO: 93101 - DNA, 698 bp, Oryza sativa
agacctcaaagaaaagttttggtgggtcagcatgaggagagaaatagctgaattcgtcgcactctgcaatgtttgccagcgagtgaaggcagagcatcaaaggccagcaggtttactccaacctcttcaaatcccggaatggaaatgggaggaaattggaatggattttataacaggactgccccgaacatcatcgggtcacgattcaatctgggtagtcgtggatcgactcaccaaggtagctcactttataccagtgcataccacttatacgggaaagaaattggcagttgtacttggcaaggatcatgtgtttgcatggggtacccaagaagattgtatctgaccgagggagtcagtttacctcaaaattttggcagaaactgcaggaagaattggggacccgtttaaatttcagtaccgcctaccatccgcagacagatggtcagactgagcgagtcaatcaaattttggaagacatgttgagagcttgcgctcttgactttggtggagcttgggacaaaagcttgccatatgcggaattctcgtacaacaacagctaccaagccagtctacagatggcaccgtttgaagctttatacgaccggaagtgccgcacacctctcttctgggatcagacaggtgagcgtcaactgttcgggacagaggtgttagcggaagcagaagagaaagtcaga

SEQ ID NO: 93102 - DNA, 4580 bp, Oryza sativa
atatatatagacacacacacatatataatgtatcatacgtagctccatgcctccatgaatcatctgaagaaatcagggaaggaccacatgatgaacctggcgtacaaatcattctccaggaactcgatgtgagcagctctcccgatcatggtgttgaggctccggcgacggccatgggaggactggtcgaagctcacgtcgcagcgcatgaacacccgcgtctccgacgatggggctcggagctggtccaggcagttgttgagcatctcggtgaacacctgccctttcttcgagttatccgacgatgaggcagggcaggaatcgattcttgctgaatgatatggaacatacccatcctacagttagttaagcagagttatttgattaggaaaatatacatgtcagataatcagcatacatttgaaaggaatattttgagcaagaaggtacctgtggcgatgataccaagatgatgtttttgaagttatctaatgtattcagctgcgaagattaaaaaatatatataagaagttgagttcatacaggttaattaccctgtgattcctagttcagctctaattttggggaaattaattcttatagttgagttttgttactgaagggacatagagtagatctaccttgcatagcttgtaaaaaaatgtgttctggggatcttgttcatcgctgaaagtgagctggtgcatgcattggactcccttgagccttttcataagccacagaccagagttgaacagagaatttgagctgtaccagtaacctaagtgaggtccagatattgacatgtatgtgtagaggttcttcagaaatggttgcatcttggggtctgttgaatggaaaagaactggttagttagtcagacagagccagctacatatttggaagtaaagttggaaaaactacctgctagggcacttctgataataatgtttccaatggaatgaccaacaaagctaagcttcaaatctttgcagcctccatttcttgaatacctatcaattttccttttgaggaatgcaactacctcatttgatagccttctgcccatttccttaaaatctccacatgttctgtcttcatttgtctgagacagtaggcactcagctccaggatcacacagtatccattggtttctaataagccgtaaatccagatgatgtccctgctttcattcgagtgaatagaagaagttttcagtgtttcatcaacataatatatgagatgaaaaccatcgctacaagtctgaagacacttgcctgaaatccatgcacaaaaacgactgctcgcaatatatgcccaatatttccatcacagctaggcattcttgccacatgtttaccatttagcttatgctgtagagtagtactgtttgcctctgaagcacttctcaccaaacgcttgctagaaccatgttgtggaacaaccatgacatgttgttctatgtgaacaacaggaatttctgaaggattagcataaatttgcatatcttgaatgaaccgtgcattaatctgcagaatgatttgtgtcagtatccttttctttggagtaatgcaaattgtttcagttttcaacattgactgactaccgaccttcatttgtgcaatacttctcctatggagttctgcccgtgaagaagaattctgtacaggctacaaatatatggaaccatcaaaacttgacaggaaaatgctactaattaataaaagagatggtaagaaaagggcagatagttcactgtaagcatcaagacaagacaattacatcaggatgcaactttcttgaactggaacctctcagaagtgaatggcgaggagaagacttgccactcaaactgcacaaataacgatgtggcatgtcaacttttgaatgaacaatccatattgaccattctgattttcggtcagcatcccaaatattgcgcaagtgatccaatatcttgattttgtttgccctgcagtaaatctcaagactttggtcggacagaaaataaaatgaaagaataagaacagtaattaacaaatcattacaccaacacattagagaagtagccaatggctatcttgattctaagacaaaataaaaaaaccacagataacctcacctatgaaatttcaagaatgcattccataaaaatgaaacttgatcgctcacagcttgaaataattctaacaaatcttccttggaaagggtgtacagcagaatgtcattagtgctccgaaccacattatcagatctctggaattagttgtaaaaagaatcgtaaacagttagtaaaagtatcatatgtgacaaaaattgtcacttttgagagaccaaatcaagtgtacctctattagatcatgtaaaacaccagtaagatggccaatgcacttcgtgggtatatagagccctttgctatatttaggcaagcctgcctttgatgaatcgatcggctcatgtttaccaagagttaaatcagcatcatctaaatcttcaagagttttaccaatgccagcactcatcttcatcacttcctcaagcaaaatttctctagaacttaatagtgcttttataatataacatgattttgagcataaaccttgctcagatgcctgcatattggcagcttttagggataataaatgaaggcaacatgttcaggtcattattttttaatatatgaagtcgttgactttttagataagtttgaccattcgtcttattcaaaaaatttatgtaattatcatatattttattgtgatttgatttattatcaaatgttctttaaggatgactttttttttcatattcgcacaaaaaaaattgaataagacgaatggtcaaatatttgtcaaaaagtcaacggcatcatatattaaaaaaggaggtagtatatgctcagcaccctataatgttgccaaatttatcaaatgttctagcaatctcagtctctcagacaagcttttttgtaaggtcaccagtatggcagtgtctaaaagaatattaaagctaaagtatcacaaacctgtgtaccttctgagacgatttggtcacaccagcttttaggtacacgatatgcattgttagatcaacaagcacagggtggaaagcatcaaaatggacaggaaaatatgcgtgtaaacccaggagtgctttgtatgggattctaaattcatgcactgggacatatatgtcacttggatcttcaatctcagtcctacaataattttttttaaaaaaatggaagcagcttcagtactgatgaatggatgttgattttgtaggcacacaagtactccccaaaacgaacaatataatgtgaacaccaaaataagatggaaagggaaagcaaagaacatacctgtcttccaatgttggaacatagatgagctcaaattttaatattacagacgaggttgctgggccctggaatggagaaagcagaagttcagaccagccattgtaaacataattcagttaggaaaagaaagttaagctaacctcatcttcggtgttgggtatgtagaaagacaccataactgatagataaatatcttgtctagaatatttaatctggaatggttgtgtatagaagctattgtcaacgtcatctattttccaaaggccaaatgctcccttcgaaccaatatcaggaactgcacaatccacctagcatgtcattatgtattagccaaagattgacggttcaagatgatactatacaacagaaaaagaaagaaaaacaagaacatgaaaaatccaacctaacacaattgattgtaattgccaacaagacagctctgatgcatcttgaattggttttagttcaaaccaaactaatcaacaacagatcttaaattataggtacaagtacatgattgatgagcaaacgtgcaaaatatatagcacatatcacatattgccatcacagaataggtgcaagaaatgcacaaaccttcatattgcacgaccctggcaggagatacgggcgccctgtactcatcctcctcccacgccgcactaatcttcagccggtaccatctgcacccaaatagcaaacacaatcacatacacctcgatgaaactgaatcaaaattgcaattcagagatagattttcatcagattcataaacagacagaacaatcaaaatcgtacagaataattaggttcaagtctaaatttccaaagcccaaattcatcctggtagaatcatcagcaagaaaggtaaaatttctgccgttcgttccttacccttgctggaacaggtcgaggttgtggaagcggtcgatgtaaatggccacctcgtgcgccgtctccatcacggcctcccacccaccccgccggcgacccgcggccggagaagcttcgcctaccccgctccgctccaccaacgccggcgagatcggccacctcccacctctccctgccgcgcctccgcgcctccgcgcggccacccatttaccaccttcccctctccctattcttgtcttccaacaatgggccgcaccgcgcgcgtcaaggcccaacaacccattcgcgtattgggccgcgcccggaggcccaatactggagtccgtaa

SEQ ID NO: 93103 - DNA, 1561 bp, Oryza sativa
gcacaaaatggggaaccagaagaagcccttaaccttttccgtgaaatgtgtatggaaggagtaaagtacagtaatgtgaccatatcttctgtgctatcagcttgtgcaagcttaccagctatatattacggaaaggagattcatggtgtcgtcataaagggccccataagagcagacttgtttgctgagagtgctcttatagatatgtatggcaaatgtggtaacttagaatgggctcatcgtgtttttgagtccatgcctgagaaaaatgaagtctcatggaatagcataattgcttcctatggggcttatggccttgttaaggagtcagtaagtttattacgccatatgcaagaggagggattcaaggcagatcatgtaacgttcctcgctttggtttctgcttgtgctcatgctggacaagttcaggaaggattgcgacttttccgatgtatgaccgaggaatatcagattgcacctcgaatggagcattttgcttgcatggttgacctatatagtcgggcagggaagttggataaagctatggaattgattgttgatatgcctttcaagccagatgctggtatttggggtgctcttctccatgcttgccgtgtgcatcgcaatgtcgaacttgcagagattgcttcacaggaattatttaagttggatcctcataattctggttattatgtgctcatgtccaatatcaatgcagttgctggacgatgggatggtgtatcaaaagtgagaaggttaatgaaggatacgaaagtccaaaagatacctggttacagctgggtagatgtaaataacaccagccatttatttgttgcagcagataaaagccaccctgattctgaagatatttacatgtccttgaagagtattcttctagaattaagagaggaaggttacattcccatgccagatttatgttgtcccacgcacctggacagcagcacacaggttcagcaacaataactctgcaacttgtttgattgtgcactttcatacttcaaaccttttgaactgctgtgtcaataatgtctaaacatgttctgaagatactatgttatggatctacatactaactagcctctgttgaaaagccatcactgctctgctagcatcattgtagtaccagattgtctatccattaatagcatgcaacatcagaatgtagggtcacttgggcaattgaagtttaggtaacctgtcacagatcgtctctgtgttcagtgaacagaacaatggcatatcatgacttaccttaacattctttgcagattggctaaatcagaatggcattcttgaatctcgacaaatatatgatgcccctatgctattgtgcattttctgtcaaggaattatcaaaagctatttctatctgattcagtaatgtcgtaacattgcctggttcaggaattcatttattttgttgtttcttatgtgtgcgttaatgaaaagtttggtaagagttgccagtctagagttaagattttactgataatgtctttatcttcttgcaggtcatggggatttgattgcgatgttgtcc

SEQ ID NO: 93104 - DNA, 2585 bp, Oryza sativa
aggcatttgtctgagataattgcattgcgtgtcgcgcttgcgcgatttatctttcttcttctgctactactgctatatagcatgcaaaaatgtttctttcgctagcaatcttatgtgtgtactataggagtaggtgttctaaattgttatatttttgtatacggttatcctttatgaacacgcagatgacgagtccaatctaatccattccattaaaccatggggacaatagaggcatttgtctgagagaacattttatttattttcttgccgattttcctttgttctgtatgtgattcttctttatgatcctgtattggcatataggtaaccttacgtttatctgatttatttgatgataaattcctcctactcattctgaatgccaaatcctgtacatttgtttctttcttttcatatgtacgttagtcagtacgttagtgttctgcttgctaaatcatgaacatgattcagatccccgtccaggactggccggggtacacaaacgacaatgttgacattcagatccacgtcttacaaacatcataaaagtcttacataaatgcagcggaaaaacaaaagataacaggagctaagccttgacttgaactgcagcgggaacaccactccacaggcatcctcgacggcacggacgaagcctactccttggagaaaccaccatccgacacatactcgtactctggggttggggaaaaataaagcaagactgagtactatccataggggtatgatgcagggaattatcaaaggagagctagagtggttcatttgcataaagcgagcatttataaacagaagttgaaagaagaaaacagtcgtaataattaatcaatattaatcatccactgtccaacgctataccacgttgcgacaggcccaaccatccacctatactatccaatttcaatagactaaactagggtgagactaatcacggtgaatctggttgaccgcccataaccgcgggcacggctattcgaatagttttactctgatcagaggtgtacaactgtacccacaagacacagccccacgacatgtttccatgccccgacatgccaccacgacataccggaaagaggccgtgacaggacccttcgcataaccccctctaaccaagcacaccacacctcaggtttcactcccactcctcgcaaggcagcgggcagtcccctctcgtgcctaggtgaatccggaagcgacggaggctgtcgcagggcccgccccgctccatcacgcccacccttgtctggatgcgtcagctagaggaaagctacactacaagcccagccgttgcccacgctggcttgtggtaagtacgataagttcttccagggcatcccgcgaaccggtccttaactgatatgggtgcgactagcaaaactatgcacccacaacccaccatgtgatttattttaattaaccaacaccaaagcggtggtactaaaccaacattatcatatgaacctacagtttatattttaaatgagatttccccattatgtgctagttgaactaagcatggctaagcaactcctagtccaacgtctattcatgttataacccgagctaacaaaggagcagggtaccaaaatagcatggctgtaacaataggtaaacatcccatagtaacattataaaacaatgcagtatttgaagaaaaacaatagagcatttgcaatataggatcaacatgttcaaatgacaggcatgacttgccttgctctgcagctggaggaacctcggcgactatctcgaagtacaccggagcgtcggaagaaccggaatctaggcgatatacaaagcaaacaatacaaacaggctataagactactgaaacaaagaacaaaaccatttttaatggattctacatatttttcttgatttactgagacttgaatgggcttaaacggagctcggttgaattagttatgaattttagaaggttcactgtgttttttactataacaaaaagtccttaaatcatttattgcgcaataattcccagggctgacgtcatcaagggggggcgccgacaggcgggtcccactggtcagtggctcaggagagaggggaaggggcgccggcacgcgggccccactcggcagtggctcaagggggggggtccaccgtggaccggaccacatgggtgatccaccgccggtccacgtaaccgacggcccagatcggccccgagccgatcgggcggtggcgatagaggtggccgccgggctcggctcggcatcaaagtcggtcggccggccagggctagcggcgacgacacgcggccgacggcgacggcgacggcgaccggcggcacgggaggcggcggtggcggccgaaggcgacggcgcatgacttgaagcggcggcgcggcactaggagggagagggaggggagtaaaggggagaggacgcctcatcgagggtggccggcgcggaggaagacgacggcgaacggcgacggcaagccacgggaggacgacggcaaccggcggacgggcttcggggtgccgtaaggaaggaggagagagagattagagagagggagatgaaccacggcgg

SEQ ID NO: 93105 - DNA, 4740 bp, Oryza sativa
aaacagccgcggtctcattccactcgcgcagctcctcatcaatggcgtacgaggtggggatgaagatggtgtcttcctccgggcgcggggccgggtcgccgagctgcgtcatcctggttgcccgcgttctcggcgggggcggcgaaagctggagcggaaaggccgggcgattgcttgtctgcagctcgcgcacgcgatgacggggagacggactcttgcgcaggcgacgcggtgacgacgagcgaggacgcgaccgcgggggcgtgcgagcgcccaaccgcgcgcgccgaagcggggaccgagagaacgcacgcacggcgcgacggtgccggcagtcacgcgcgcgatgtccggaacgacggcagttgaagcagcagaccgggtccctgtactgcgcagcgtggtgctctctgctgaggcaaatgaagcatttcccacttgtttgagcccagaacgcacgatacgaagaggagtaaatggggcgctgtcgacttgaaggcggaggtaggcgggaggcggatgaatgctcttctctacgccaccagcgcttgcgacgcaccggaatctaaggcgaatccccggagatatggccatccatcttctgctcggcgacgtgacggtgaggaaggctagtgacgtagggagtactcctccgcggcggagtgacctctcgagcagagcggttgttgcgccggacagtggaggtaaaagccaacttgaatagggggcgtggcggagagcgcgtgcggctggtgcccaaatttgaatttgggaagccctgaccacggacagcatcagcgaaggaccggcgagcggcagcaggtggcggatctggcgtctctgctaccatcgaggcgacggaggccgaagggggacgcccaaatctgggcggaggcggggacttcgggcacggctggaggacacttgcggagaactggcgtggctgggaggagcttgcggagcgctgggacgacggccaggaggcggcgaaaaagctagctgggcgtcagaggatacacgtgggcggcgtcagctggagtgccgacaccggcggcgggcgcgggggcatgctgcttacctttttgccgatagatatacaggttattgctacctgctattctgtcgatatgcaagtgttgaagtgaagcctgaccagcttcactagctgcctgcttatatgttgccctccacagcctcacagctactagtagcagaaaccaatatctcgttgtggcttggtctgccaacgcgctacgatagtttgtgggtaggcttgtggtgaactggtgatcagcctagagtttgaggcaggaagtggcgccggccgacgtgttccaacatgcagtaagacgcgcgcgtatttaagactcaactctctaaatattttaccgataatattttattttaaattaaattttatttgatagatgacatttgaatttactctcgtataattgtggttttattgctacaaacaatcgtattattcaagaaatttaaagccaaaaactagttttaaaaaccgtaataagtttgactgtgtcttaatcaataggaggaaggaagtatgtagcaacattacacatgcttagagcgcataaggaagaggagatcgagatgaggaaagaaaggagagaggatacggaggaaaccatgccgttcactctcaggacagtcccaaccctccacttaggatggtatctatagcattaactacattgacatgtaggacttttaacttatgtggcactatattaattaagagagagagtgaagagaggaagaaactaggtctcatgcaagacacagcttcaacgcgagaacctatgcactagacactatcaagttttgcgttgggagataatagtgtcttcataatatatgaagaataaatatgattggtagagaagagagatgatgtatttattactgggccactttaagaaatcatgggttgtagagtgtagtttttattgtgatgtcttattgacatggcaccatagacactgcttatggacactatgggttgagactgccctcacagcgtcgccattacgccaagcatagtatttttttatgccattcacgactgcaactaaattttactgttgtacacttcttcatacttatgtaatattttttttactcccataatcccattatattcaattaaattagcacaattctaagcgccgtttcgtgaaaaaaaaagaaaaaaaacggagcgccgcattcctcaatttttcaacgacgtttgtcagtttgcgacgacgccgttggaccaccgggatgaccgagcagaagcatagcttgggcgtcgcgtggcccggagcccccatctcccccgactgctgtgacgtggcccaatggcaccgttcaaaagcctatccggcagcatggcccatatataccagtataccaaccaccacaagagaagccaaggccgcattccctactacgagccatacagacaatgccgaaatcatggaggtttaagcagccatggccacccaaatctcgtctccaacaacaccgggctctaactttggcactttgcatcattaatgtagaccagctctagcgaaggtgaggtactaaccacagaaaagaaaaaaaaaaccatgtacaatgtggtgcatatatacctacattgaatatatgccatcagttaaccgataaaaaaacattaggttgccagtttctggcctatgttgcattgtcatatgtttgggtggccatgcatgaatcaaccggtgcatattgttgatcagtattgtgtgttgaactgatggactaatggactataagtcgccatgcatttcatccattcttttccgccacaaaaatgcgtgcaatctgcaactgcaaaatgcagagtgatatgaacgcaccaatgtgcgtataaatgcatcggcatcttcctaactgcttatatataggcatagccctccacagtgcacacatagtatagcagtaaccaattaatcaacctagcttaattacatagacgagctagcttaccacacatggcgtcttcaacctcgagctcgctcgccgtggcaacaatggtggccgtcgtcctcctcctgggtgccaccacccaggcggcgcgcctcctcgacgaactcgtccccggcattccgatgccgacgatccccggtgtaccggcggtgggccccaccatcccggccatcccgacgatccccggcgttccggcggtgggccccaccatcccgaccatccccaccgttccgacgatccccggagttccggcggtcggtcccaccatcccggccatcccgacgatccccggcgtgccggcggtcggccccaccatcccgaccatcccgaccatcccgacgatccccggcgtgccggcggtcggttccaccattccgaccatcccgacgatccccggcgtgccggcggtcggcccgactatcccgaccatccccggcgtgccgacgatcccgacggtgccgggagtgccggagctgccggtaaatcccggaggcgtggtgccgacgatcccgaaggtgccattgccgccggtgaatcccggagccgtcgtgcccgccgtgccagctctgccggtgccgccgatccccggagccgcggggggtgtcgtgccgaccctgccggtgccgccgttgcccgccgtgccgggagtcccgctgccggaggtgcccggcgtccctctgccgccggtgccgtccgtcgtcccgcccgtgccttaggtcaactccggcgagccccgtgccgtcgttaattaattactccggccagctgacgtgtacgtggcattgaccgtgtgcgccatgcattggccgccggcgccggcagccatctacagattaattacgtacgtgtgttaagtagtaagtacttcctccgtttcacaatataaatcattctagcatttttcatattcatattgatgttaaagaatctagataaatatatatgtgggaaatgctaaaatgacttacattgtaaaacagagagagtacaaattaagatgacttgcatgtacgttgttacgtcaagttggtatagtatttgtgtaatgaacgtgtgtgtgtgcagaccaggtgcagtatgtgtttgtggcgagtggcgacaaatgcgtcacgctctgtatacgtacgtgtgcaaaagcttaacgtgttgcttaaattatacgtgtcatgttaacaaatatatatttctatcaccgttttaattgtgtatatctttgttggcaaattaccacgcatgcaatcttagtaaaagtgccccttaacaatattgtttgggatgacatatgcgccacttatttcaaaatttacatataatcatgtgagaaatgaaagcccatatatacttggacttagtggcggacgtagctatagaaaaaaagaatgtgtttgatgctcattctataaggataatcgaacacaacatttatattataatcacataaaaaagtataatataatcaataaattaaacaaacatgaatatttaagatggtacctaatctttgagccgtaaatagtaaaaaactactcaaatcttaaattagaggaagaaaagaagaatttcccccgggaaaaaaaaggggggaaaaaaaaaaaattttacccaactgatcacttgttgctcatccgtcaatcaaattcaagttccactatacaatcctacgataccttggttctgaacttattaccaatgacacttttcccatcaggcatgcattcg

SEQ ID NO: 93106 - DNA, 1202 bp, Oryza sativa
agcctgattttcgttttaggatttataaattatctaataaattattaatagaatttatattaaatattcattaatttacaagtgaagttaaatgtgggaaaaaaatttcctaaatataaagcatggctggatttaatttttattaaattctccatgattaattatactctctgaaattttctcggatttttcaaagctcaaatcctaatcttaataatacaaataatatttcagtaattagttaatcattaaattaatcaattaatgatctaattataatgttaagtgcttttcttgtttaaatatccttaaattataaattgttgtttaaaaggacttattagaaatgatcttaaaagcctaaaagagaagatctaattttaatttgttaaatctcaacataaaagtgggctagaaaaaattttgttaaatatttctcttgtttctatagttcctagatttttctgggatttatttgagctaaggaagtatttttaatccatggaatatcatttcatgaataatttaaatagaaaaaggttttaaaatctcccttgtggctttgggcccaagtcggcccaagtctctcccttcgcctcggcctgctcgcgcccggcccaagccggcccagtccgccgcgccctccctcctctctctctcggtgccgctgataggtggggcccacctgtcagtagtcttcaacctcgcgccgccgtaaccgcgccctagccgcccgagccgctgccacccttccaaaattcggccactcctttccttctccggccaaatcaattgaggggaaatgatcctcgggatctcctcttttggaatcttcgtctagtttcgtttggaaaccgacggatttgagctcgattcggatcgatctctctcctctaaccctaaaaccttccatctcgccgccggtcgccatgggcctccgtcgccgcctcctagcccctataaaaggatccccgggacctcctctctccgtcgccaacctcgtcttagcttgctgccgctcgtagcgccctagccacgagtgcccgtgcgccgccgccgccgccgtgagtccagccgtgcgtcgccgccgctccggtcgtcgtcgtcgctcgagaaggccaccgtcgggttcatcacgtcatcgccgacctcgtccacccctctgtcgtcaccgaggatcgccggaagaccgccgtcatcat

SEQ ID NO: 93107 - DNA, 717 bp, Oryza sativa
gtcagaagttcagaacttcatcagatagtactgtcagaaatccccatcgtcagagagttcggagacgtgtttccggaagaactacccggtatgccgcccaaccgggagattgagttccggatagatcttgctccaggaaccactccgctgtacaagcgaccctaccgtatggcagcaaatgaactggccgaagtcaagaaacagttggaagagttgaaagaaaaggggtatatacgtccgagtacttccccctagggtgctcctgtgatttttgtggagaagaaagacaagacgaagaggatgtgcgtcgactacagagctctcaatgaggtcaccatcaaaaacaagtaccctcttccccggatcgatgatctgttcgatcagcttaaaggtgccacggtattctccaagatcgatcttcgttccggatatcaccaattacgcattcgtgaagaagatattccgaagaccgcattcaccacgcgatacgggctgtatgaattcacggtgatgtcgttcggtttaaccaatgctcctgccttcttcatgaacctaatgaacaaagtgttcatggaatacttggataagtttgttgtggttttcattgatgacattctggtatactcacaatcagaggaagaccatcagcaccatctccgtctggtgttgggaaagttgcgggaacatcaattgtatgccaaacttagcaagtgtgag

SEQ ID NO: 93108 - DNA, 766 bp, Oryza sativa
cccagaccaatttagtattgcttattttgctacaatctggttaaaatatcctatacttagattgggacaatacgtaagatttggatgatttccgggtggctagtattgtctcaatcgatataagatttaccaggtacttatgtcgaacgaacgagtacgaccgcagtttctagaatggggacagacctagttattaggttaattggcaatatggcacctctgtatagtggttcttatttttaagtcctcgcgcaggaggcaactatagccgcgaagggcaatttctaccattaccatgtacaggtaattggtttattgagctcaattataattatggttatatttctaaaccctgatcgagatgacatggtgtcatacgatcagttccccttaaatacctcgggaacgccagaactcctcttgctgctgttaatattacgttcagggcatatgaggatataagttcatggaacaggtgccacaattgttaatgacttaatactgggccatgactgaagccgatgattatcagcaagtcgtggactgcgggtaaagcgtacatctactgcagtagaatatctttgaaactattcgaatagccgtactcatggaattgagtaccgggactcatatggtaccctggttagaaacctaaagtttatatgttataaatcctgctataattcttccagattgtccaatactactttttgcaaagaaccctattatatgtcagtgcatatcatatttccgagataacttgctg

SEQ ID NO: 93109 - DNA, 586 bp, Oryza sativa
ggctggcggcctcctctatttctcctttatgtagatttgtgaattttggcccagtttgacgtgtcaattctgagttcttggcccattcatgcataagtttgattgtcgacatcgtccgatggacttatcttctatgttgatgtcgattctcctccactttattgtcattctctgcaaaatgttagtagacctaattctagtagaatattattattctgacatatttatgcattgcaagcatcactagttctcctctattttggtaatattgacggtcgaaactgatcgataacgactgtcaacacctgtaccggtggcgcggtgggaagtcggaggtgggcatgatctgggagggcggtgtagaaccagtcgttcttccggtcgtcccactttttgcgcagcatgcagttgatgtagcggtgcagcgtgtgggcgtgtggctggaagaagctgccgcaaacctccatcgctggggacaccagctacaaggtgaagaaccagcggaagaggcccaatgaacatctcgcacagatgtgcgaagatggccagtatcatcatggtgttgggggtgtggtgcgccatctgg

SEQ ID NO: 93110 - DNA, 1694 bp, Oryza sativa
gaaagatgtgaagtacaagtggtcggaagaatgtgagcagagtttccaagagttgaagaatcacttaatattagctcctattttgattttgcctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgagttagctgcagtaattcatgcgttgaaaatttggcgtcattatcttttcggtactcgtacagaggtgtataccgatcacaagagtttaaagtatatctttactcagccggatctgaacatgagacaaaggagatggttggaattaattaaggattatgacatgggaattcattatcacccgggaaaggctaatgttgtagcagacgctcttagcaggaaaggttattgcaatgctacagaaggacgacagttgccattggaattatgcaaggaatttgaaagattaaatttgggaattgtcagtagaggtttcgttgccgccttagaagcgaagcccactctaattgatcaagttagagaagcccaaattaatgatcctgatattcaagagatcaagaagaatatgagaagaggaaaagctatcggtttcttgaaggatgagcaaggaactgtatggttgggcgagagaatctgtgtccccgacaacaaagatttaaaagatgcaattctgaaaaaagctcatgataccttatactctattcaccctggtagtacaaaaatgtaccaggatctcaaggaaagattttggtgtgcaagtatgaagcgtgaaatcgcagaatacgtagcagtatgtgatgtttgtcagcgagtcaaggcagaacatcagaaacccgccggtttgttgcagcctttgaagattcctgaatggaaatgggaagaaattggtatggattttattactggtttacccagaacgtcatcaggccatgactctatttgggtgatagtcgacagacttaccaaagtggctcatttcattccggtaaagacaacttattccggaagtcacttagcggaattgtatatggcaagaattgtgtgtttgcatggcgtccctaaaaaaatagtgtctgatcgaggcagtcagtttacttcaaatttttggaagaaacttcaggaagagatgggttctaagctgaactttagtactgcttatcatccgcaaacagatggacaaactgaaagggtgaatcagattttggaagacatgttgagagcttgtgctttagatttcggtggaagttgggataagaatctaccctatgcagaattttcgtacaacaacagttatcaagctagtcttcagatggctccttacgaagcactgtatggtcagaagtgttgcactccgcttttgtgggatcaaacgggagaacgtcaggttttcgggacggatatcctaagggaagcagaagaaaaggtaaagatcattcaagaaagattgcgtgtagcccagtcgcgtcataagagttatgtcgacaatcgccgtagagatttgagttttgaagaaggagattatgtgtatcttcgtgtcacgcctcttcgaggggttcatcgttttcacaccaaaggaaaattggcaccgcgttttgtgggaccttataagattgtcagta

SEQ ID NO: 93111 - DNA, 2409 bp, Oryza sativa
ttttggtgtaccttccctctgggacaaggattaatgcacgcacgtaagaacgcccgttgggttatttccggtcgtgacaagcagtcgtgtcatgggcttagcaatcttagaaaaattctctataaaccttcgataatatcctgcgaggcctagaaaactgcgaatctctgaaactgtctttggttgcttccaattagttacggattccacattactaggatcaacggcaactcctcctgctgagatgacgtgaccaaggaacttcacttcagacaaccaaaattcacacttgctaaacttagcatacagttgatgttctcgtagcttctccaatgcaaggcgaagatgttcttcatgctcttctttggttcgggagtagataagaatatcatcaataaagaccaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatcgatcttggagaaaacagtggcacctttaagctgatcaaacaaatcatcaattctgggtagcggatacttattcttgatagtcacatcgtttaatgcacgataatccacacacattctctgggtatggtctttcttttccacaaaaataactggagctccccatggagatgaactcggtctgatgtatcccttctgaagcaaatcatctacgtgcctcttgacttctgccaactcattggctgccattctataaggtctcttatggatcggagttgttcctggtaccagatctattctgaactctatatcccttttaggcggcataccaggtaaatcatctgggaacacatcgggatactcccggactataggaatctcttccaaagttatctggttcagtcttgaccttaaagactcagaagacaatgcatgaacagttacaactcgaccatcattgctggtgagagttacttttctgttggcacagtctatcacacctttatgtctggctaaccagtccatccctaggatgacatctaggtctttggattctaacaagataagattggccagaaatggtactcctttaatttctattctgacagaggggctacgatgcaaagagagtgcttaattacttggggtactaaccatcaaaaaacgtctaagatcttctacttccatcccatgatttcccgcaaaactcatagataagaatgaatgtgtagccccagaatcgaaaagtactgttgcaggacctgagttacaaggaacgtacccaaaatcacatctggagcatcttgagcttctgcagcagcgacatgattaacacgggcctttgatgctggtacggtagagttgctctgggtagggacaaccttcatgcgtcggggcttcggacacttgtcagcataatgtcctgggtctccacagttgaaacacaccacgggcttgctgccttgctccctcttggcaggttgttgctgtgttggagctgcaacagggcgtagagcttgattgcggatgttgttgccaacattgttgttgaagaactgacgctgcggacgaacaacagacgaagaacctccctgtggcattgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattattaagaaataaacaaagttgaaaaggttttataaaaagaaaaccctaaaagaagttctttttccccccccccttcctctcttgggccggctcggcccacttctctccctctctctctctcctcccctccggcccatcggcttcccccgcgcgcgcgcgccgctgacaggcgggcccgcccgccactctcgctgacgggtgggacccacctgtcatctccctccccgcgccgcgcccgccgccgcccgtgccctagcgccgccgccgccgccgaatccgccgcatcccgccttccccgcgcgccataaagaggggcgaattactccccgcgtttccctctcccgattccccctcttttccctctctctctccctcggattcgtccgatttgaatcccgcaatcatcgccggcgtcttcaatggcggccgagatctccgcgcgcgattccttcctccccgccgccttctctcccttccgacgctataaaatcgtccctcgtgcttcgctcttccgtttccg

SEQ ID NO: 93112 - DNA, 1066 bp, Oryza sativa
ttgtgcaagctaagaccactgatgctttaagcaaaaagctagctgccaattacaagatcttagaaaacattaatgttaagctagatagcttcgcttctgctttccaaaaccagctgagctttaacaaaatgatagaaacttagttagctcaattagctgccttagtacctgcaaatgagtctgggaggattccggggcagcggactcctccattgaaaatgttaaggtgatcaccacgaggggaggtaagtccacttgtgatctgccatatcctaaccctgtaggaactaacaaggaagcgccatctggtacttcagctgacaaaaagattcagctagagaaggttgtgccacaagcatactatgacacgcaattgctgccatttcctcaaaggaacaggaaaccgtcagtggacgagcagtttgctcgttttgttgaagtgatctagaagattcacatcaatatgccgtagttggatgctatataagtgctaacatacgcacgttacctcaaggatatcctcaacaacaagagaccgctcccaacaatggaggtggtcaagctgatggagcagtgcaacaatgccatactccacaagttcccggaaaagaagaaagatccggggtgtcctacgatcacctgctcgatcggggcacaacagttcaaccaagccttttgtgatattggagcaagtgtcagcgtcatgcccatggacgtctttgaaaagctcaacttcacgatgttggcaccaacgccaatgcacctgcagctggccgactcattagtccgttacccaacagggatagcagaggatgtgccggtcaagatacgggattctttcatcccagatggtttcgtggtgctggacatggaaacaggaaaggaaacactgctcatcttggtgcatccattccttaaaactgcaggagccaacattgatgtgggaacgggaagtatccgtttccgtattaacgggaaggaagagaaatttgagtttcagccaaggactaaacactgctccatggtcagaatcaagtacgggccaaacctaaaaaatatcctggtg

SEQ ID NO: 93113 - DNA, 757 bp, Oryza sativa
agaaaagttatgcagataaccgacgccgtgacctggaattcgcagtggatgactttgtgtatcttcgggtcacgcccttgcgcggtgtacacaggtttcagacaaagggaagctcgcacctcggtatgtgggtcctttccgtatcattgctcgacgcggagaagttgcttaccagttggagctgcccgcctccttgggcaacgtgcatgatgtgttccatgtgttgcaactcaagaaatgccttcgagtgccatccgagcaggccgactcagagcaaattgaagttcgcgaagacttgacctacgtggagaagccagtgaaaatcctggacccatggaacgcaggaccaggaaccgggtaatccgtttttgcaaggtccagtggagcaaccacgccgaggaagaagctacctgggagcgtgaagacgagctgaaagcagcccatcccgatctcttcgccagttcttccgaatctcggggtcgagattccgtttaacgggggtaggtttgtcgcgtcccaaaacgactctaaaacacatcctcaaaattatgcttagaagaagtaaaatccttgtgaaagcctccaacaattaaaatgtgcgaagttaaaagtcgaataaggcttggaggatttttgtatatttcctaaaagcctaaaatgcgtaaataaattttagtggaattttcagagcacaaataataattaagaagaaataaacaaagttaaaatggttttataaaaagaaaaaccctaaaag

SEQ ID NO: 93114 - DNA, 2364 bp, Oryza sativa
ccgcctcttgcgtcgtcgccggccgtcgtcggttgtcgtgggacgttttggtgagtaccatcggttcgtctcgtcgtcctcttcgcgtaggtgcccttggataggccggccgacctctctatcgccggcgaggtcgtctcccgtgtcatgccggcgatgatgacgtcagcatgacgtcatgattccttttttccagttttttctaatagattaaatcttctgaaaatcatatctaaataaccgtagctccgtttcaggtggttcaagttactaaatttttctaaaataaagatctacatattaaaattgtccataaattgaattaaatttatttaattctttttaaatgggctttaattagatttaatcttgtaaaatttataataaattcacttggagtcagaataaggccgttcaagtctcataattcatctaaaatcatgatctacatgtttgtttactttatatgtattgtttatttggtttttattagtcttttacttcgttttgcgtgttagcttgtcgtttccgtcgttgcgaaggtttgtgagtgcgtcggaagtgatcaagaagattaattgaagaccgattattgcaaggcaagtcacacagatcctaaacacattcctttgagcatgttgatcctatatttaaattctctatttaattcaactgtgcatttattttcgaatgtcactgggtggtgtgaacctattctttgttatggccaatttgcattgattactctattccttgataccttgggttattataatttgactagttgagctttatatattggttcagctagatgttagacataattgcttataccccggttgagctgcctgtgggagtggagccggagcttcgctagaccgtaattccgctgctattttcttttcttttgtaagtatgtaacgttattattatgatgaatctgtatattaaattgtcagtttgtgtacctcggctgattcctagatgaggattttatgcacaaataagttcggaaattactagtgaaattcgatcctcgacggttgccttgattgtttgcaatggtttgcagaagttgggtttgggtggccataacgccagccagggtggttaggtcgggtgcttgagtctcttcattgctggttgatgcccgacgtcggcttgccatctgtgtaggccgattaggtaagtaacctagtttcctaactagcccttatggttttattccgttaaggaaattgttttgatgtgaactttgttttgcaagcatggtggaataaactcattcataacacaacagtaaaatatcataaataacaacacagagttccacagatagtacataaatcatgatacaatcgactgcacatatacgcagtccaaataaagttcatccaaatggtacatcgaactaatcatcaagctactcgtcaatctaggtaggggggtgtgtctcgcatgctatccaaaaaccatctgaagcgagatcgaagctgcaatagtcctccagtctagtcatccaaccatccgcaggaacctggggcaggaagagggtggtcgctggctcgtgcaaacctgagtccccacggctcggaagtaggggtctctggatctagcttgggcttcttgcccgagggtcgtgtgctcttgcaggcagtgctgagggtacgagggcctccgacaaaggtgatgcggtggacaggagtctcgtcctctgaagggtcggtgatgtccggctctatctctggctcggtgtcggtcccctctgtcttggagtcgacctggatcggagtctccaaactggaacccagctgcggtgaaagagtggagatcagtggagtgtgcacaatcttcggggcaggtggctgtgtcactgtcgggtccaccaagtaaggtgctgactcggtagctagcatatcaacctctcccaacagagcgtggaacgctggcgggtacggcggggtaaggaagaagtagcggtcacgcctgtcacatcctgattttcgtttcaggatttataaattatttaataaattaatagaatttatattaaatgttcattaatttacaagtgaagttaaatgtgggaaataaaatttcataaatataaagcatggttggatttaatttttattaaattctccatgattaattatactctctaaaattttctcggattttttcggagctcaattcctaaatgatacaaagaacagttaagtaattagtaatcaattaatgatctaattataatgttaagtgcttttcttgtttaaaaatccttaatttatagattgttgtctaaaagggaattattagaaatgatcttaaaagcctagaagagaagatctaattttaattaat

SEQ ID NO: 93115 - DNA, 2203 bp, Oryza sativa
gtttactttatttacttacctttttactttgactttctaaactttattcaaattaatccaaaaacttgtgctattaattggataaaggtcttaactcactcctttcacttgtctttagatgccgcgctacaagcctgagtacctgtttggtgttgagggttttgtccaggagttgcgtacgatgtcctttgtcattggatttgggactgcccctttttatgcccagattcctcatgatcgtcatgaagagaagtgtcgagtcaaagtcactttgaacagtaatagtgaagaggtcccctcagtaatgttcgaagctggaggaagaactacatccatgcatgtcaggaggtggcaaggatcgccataggagagctccgcgatcgctacagtgatcagttggccgacactgagtatcgctaccatcctcgtcaaccacagggaagtgaccgtggcagttaccttgagactgaaggaattgaaaatgatgctaccacaaggcatttggttgagatgttgtgggctatggatgaaagtcgtgcggagactgtgttagcagctcaagatcgtgaagatcggaatcgtggtaagatttgtaagctcgaagacaaggtggatcgtttggagaaggaactagccgcattgaagggagaagcaccgccgcagaaggccaggattcgtcttaccgcaaggaagagagctctatttgtccctcgttatcaattggcgccaaaggttcgtgtggtggagaaagaagttgccccaaccctagcggatcctccggtcatgatcataagtgatgaagaagaagaatccaagcgcaacaattccaagattgagtgggtagcaactcaagatgatgaagacgagccaaatgagccttcaatcgacctccgatgcttggaagaactagagtagcttgttaagccgttgtcttagatcgttgtgttagtttgcttgctttaagttggttgtgtgtgtgggtcttgcatgtgctttacatcagtggtgggatgtaagtgcatgcgtttgtttgcttttgagtgttaggaagttggtgagtttagtggtgtgagagtcttcagtttgtaataatgaaactcagttaagatcaataaaagctaaagtaattctctgtcctaaatagtttcccctggtttctcttcttgtgccctgccagatggtgaatactcgcagcaacgggaatggtcccaacaaccccaataacaacaatggagagaatcccactcttgctcaagttcttgctcaacagacacagctaatgaacatgatgatgcaacaacttcagaatcagcagaaccaaggaaataaccatgtacctcctcagaataagttagcagaatttcttcgtgtgaggccgcctattttctctagtaccactaatcctgttgaagctggtgattggctgcatgccatagagaagaagttggatttactttagtgcactgatcaggagaaggtctcatttgcatcacaccagttgcatggccctgcctctgaatggtgggatcacttccgccttaacaggactactgctgaacctatcacttggcttgagttcaccgctgctttccggaagacgcatataccatcgggagtggtgtctctcaaaaagaaggaattcaggtcgcttacccagggatctcgctctgttacggagtatctgcacgagttcaatcgtctggctcgttatgctccggaagatgtgcgcaatgatgaagagcgtcaggagaagtttttggaaggacttaatgatgagctttcttacccactcatgactggagattatcatgatttccagaagctagtggataaggctattcgtcaggaggacaaatacaatcgcatggagcagaagaaacgtcggattgctcaattcaagacacaacaggggaataatcagaagccgcgtcttactttaagaccccagtccatgccacatggaggttcttcgtttgttgttcgtccgcagcgtcagttcttcaacaacaatgctggcaacaacatccgcaatcaagctccacgtcctgttgcagctccaacacagcaacaacctgccaagagggagcaaggcagcaagcccgtggtgtgtttcaactgtggagacccacgacattatgctgacaagtgtccgaagccccgacgcgtgaaggctgtccctacccagagcaactgtacggtacca

SEQ ID NO: 93116 - DNA, 2042 bp, Oryza sativa
attgcccttggctaggcctggagttggtcggggagagacacaacttctttcatctacaacaattctttgctgaggctgtcgatgcaaagaatggttgctaagatttattgccgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggagtaatgcccttcttcactgcagttgtaacaaacaataactttcttacactcgggttcttcatcttgtacttgatttctcagctgctgtattggaacttccaaaggtacaacgcagatactggcccctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaacggtgaccttggcggggatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgaccgatttctccacaacgagagcatgccttaagttctattttattctggttaaagccttggggagacttcgcatcttcatcatctgaggagacttgatctgaatcttcactaccagacactctacctccattagctaaaagatgctctgtcaactgttgtgcaccttgggaggaatttcttctctgatgttttgtcattcctggtggaggccattctgtgctggtaatgatcatcttacggacttcatcttcggttcgcattgggcttttcttttctgctgaggacagttccttgcgtagtgcccttgctcatcacacataaaacagatgatacttgcttcttttgggtcaacatgtggcatggcatgaggggccttctgggatgttggcggagcgctgacttgtggagagagagcttggactgcctccaactgcacttgatgttgcatctgactcgggttcaaaattgcaatccaatgctgctgtagtatctctataagcaattggttctggttaatcaggtgttggacactgccacacaactggtgtctggtgcttcattcactcggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaaacaaggaaacacacgactaacgactctaccctagagggtggcttaggttctgcgacgggttctccaagatcttcactcctgcttcacagctggcttcactgcttcctccacttcactagcggatccttgcagtcttccggagcttcggcaaacaattgacgacatcttcttcttcgcaaagctgaccatctagtactagttgaaaatccgaagaaggaagaacggagaaaccttttgcaaatagcattaggggaaggagaa

SEQ ID NO: 93117 - DNA, 2044 bp, Oryza sativa
  unsure (1)..(2044): unsure at all n locations
ctttgattatgtcgggtccaaacaacgcaggttctccagtctcggaccacattagtggggtacggcatcgtcgaccaaataatgcctcatttggcgacatctttaggctagcttggaaactgttgtcgtagaagagttcggcgtagggcaaacatttctcccaatccttgctaaaatccaacgcacaagctctcaacatgtcctccaagacctggtttgttctctcagtctggccgtccgtttgtgggtggtaagctatgctaaaagcaaggtaactccatagggcttcatgtactttttcccagaaatgcgaggtaaactgtgtgcctcgatcggatataattctcttaggtacaccatgaagacatactatcatggtcatgtataactcggctagcttgacaccgctatagtttgtcttgacaggaataaatctcgccgtcnnnnnnnnnnnnnnnnnnnnnnnnnaaatggaatcataaccatatgcggttttaggcaatccaacaataaaatccatacctatctcgtcccattccactcggaaatcctaaggggttgcagcaaacctgccggtcgctggtgctcagccttcaccttctggcatacgtcgcaaagtgctacatattctgctatgtctcttttcatgttggccaccagtatccttccttcagatcctggtacatcttcgtacttccggggtgcaatgaatatgctgattcttgggcttcttttagaattaatcccctcagtccaccctgtttgggtacgtagatcctcttcttataccatagcgtttccttctcatcaattgagaattctttcgcacgtccagcggccatgcgctccttcacttcttggatcacttcgttgtccttctgggcttcctctatctgggttctcaaaagagggtgaatgtccagggtgtttatctgtccacgaggtactatatgtaggtttagctgggctatttcctctttaagctcaggagccatcccttccattctcagatgattgcaatggctcttacaactcaaagcgtcggccacaacgtttgctttgcccgggtgatagtgaacctctagatcataatccttgattaattccaaccatcgcctttgccttaggttgagatctgactgagtgaaaatatatttcagacttttgtggtcagtgtagatatcgcaatggtttccaatcaaatagtatctccaaatttttagcgcatgaaccacggctgctagttctaggtcatgggtagggtaattttcctcgtgcggtcgcagttgtcgcgatgcataggccacaacctttccgtcctgcatcagtactcctcctagtccttgccttgatgcatcacaatatataacaaagtctttcctattgtcggggagaactagaataggcgtagaggccaatttttccttgagctgctcaaagctttcctggcactgttctgaccatacaaacttcttttccttcttgagcagttgagtcattggtcgagctatcttagagaatccttcaataaaccttcgatagtatccggccaaacctagaaagctctgaatttcggtcacagacttgggtgccttccattccgtacggcctcaactttggcaggatctactgctactccaccggctgagatcacatggcctagaaaggcgacttcctttaaccagaactcacatttactaaattttgcatatagcttatgcttccgaagtttctcgagtaccaaacgcaagtgctctgcatgctcttcctcgtctttggagtagattaaaatatcatcgatgaatactaccacaaatttgtccaagtactccatgaacactttgtacataagattcataaagtataccggggcgttggtcaaaccaaacgacattactgtgaactcgtacaatccatagcgtgttaagaacgcggtcttgggtatgtctccgatcctaatcttcagttggtggtatcctgatcgaaggtcaatcttagagaacaccttagctcctttaagttgatcgaaaaggtcatcaatccg

SEQ ID NO: 93118 - DNA, 1784 bp, Oryza sativa
tagacaccgatgacaatgaagaagagagacatcatgggcagatgagtagttaggtaacaaaggaaagggaggcgatggttgccatggaaaacgggccaagggggcaacaaacgagtgaagtggtagcgctggtttctaaatccaataaaaaggaacctcaatgatgataagattttgattttataaggtaccgataataacaaagataaaagacagcatgacaaacggataacaaaagagaagagagagtgagagacagcggttgccatgggacagtgagccacgaggggtggcaaatgaccgtaaagaggaaggagcaggtgggctgtaaaggattaggatggcacggttgatggaacatctaaagactataaaataaaccgcaatgacgataaaaaaggaagggcagcgggcgaatcctaaacgagtgtggtaacggcgattgacatggcttctataaagtaaaaaataaaattgactgggcttgttaaaatcccaatgtcaacaaagatggctaaaagaaggggttgtaggtggactgtaaagaagtagagtagcttcggttggcagtactttttaaaactatgaaaagggaaacgatgatcaggttcaatttttaaaatcttaatgataataaatagaaggggttgaaggcaggccataaaagagtagggtggtgacgcttaactggacttctagaaactataaaaaacagaacttgacatgacaataaactctgaaaactattaagtctaatttttacaggttccaaagaagattaaaagaaatcatagtgtgccgggcaagattaaaggggtggtggctggtgtgactttataaactggtttttttaaatcttaaaacaatgaggtaactatttaataaattttaaagaaatttatgtgtaaaaaattagataatattatatggatgctagccgcgtaattgcgcgggccaccctactagttgtagtagaattcctcaatattctgctcaccccctacaccattgtagtagaattccacagcagagtaatgggccggtgtggcgaagctgaaagcattcgcggtgaggttgtccatgttgtgcggcactatgttctgcacaccgctcacaccgttgtagtagaattcctcgtaattctgctcgctgcctacaccgttgtagtcgaattccgcagcagagtactggtttggtgcggcgcggctgaaagcgttcatggcgcgggcgtcgatgttggggaagaacaccgtgttgtggtcgccacctccaccgatgtgatggagatccgccgtagcaaagtaaggggcgagcacgccgaaagcgtgatcgacgttggggaacaccgtgttctggccgccccccgcatcgatgcggtgccaatcttgagcagagtaagcaaccggtgtcgcgtagctgtataggtagttcgcggcgagcgtgtcgccgccggcgaacaccgtggtctggtcgccggcgccgcccacaccggtgtggtgctggtgcaagctcaagctcaagctcgggccgatgccgtaggagtctggcgtcgccgccgccatcgccaagggttccaggtcagcttttccagtctcctccttcccctcttcttcctcggtcctctgattctttccgccatgagttcttgttgttctaccagcagcaagtgttatgtgcaaaacacagggcgaggagcaaacaagatgcagatccagcgccatcgatggctgtgtcggaagaattaattaatcctggtttggataaatcttcccaagcaaccgaat

SEQ ID NO: 93119 - DNA, 4032 bp, Oryza sativa
gcaaccgcgacggcccacccacaagccagtgttcgccgggggctccccatttggtggcttcagcggcgacggcgctgctctccgaaactgctgccacactggtcgagtccgccgccgccgcccgcatctgcccgccggcctccctcagtgaagatgagaagagagaagaggagaaagaaaatataatgtgcagctgacatgtgggccccacatattcctttttattttttttgctgactagatgccacgtcagcgaaaccacccatctatttgtgtgcacggtttgtgtgagtttatggatacatatttctggtagttaagggacctaaaaaatttcgctataagttgagggacctccggtgaacttattcctttcaccgtataggtcccatggcccatgtgttcatcttacatgggctaggctttatactttcctgtccaatgtgaggcggcattttaattcagagcaagtccactttacgttcctcatattcgtatcgagtttaaacagtatcgttaaatctcaataccgaaattcttaataccacaaagatgcaaaactggataaattagatacacggcagtacggatgattggtttcgttgacatggtatcgtagttagtaaaaaaagttttaaaaaaatacgaagcctacattgtaagtgatcatcttaccttctttctttacttcctctctcctcccttcaatccctcgtctcatccatggtacgaactacaggaaccaagatcaatctgcacatacaccaacccgctaattgccagcacgcaacgtagaaaagcattgagcaatcaacgagataattactgcaccgaacacatagattgaatgcatcagacgaaccgaaaccaccaagagacacgtaacaaaacggataggcctcctgtacacgatcgaatcgggagaagaaatcacctgggacgcggccgtcgacagaagactgaactcgggaagacggcaccaaagacatgatcgattcaagagacgggacaaacctggggacgcgaccgtcgtccctcggcgccggcagcagatcaaacacgaggagaatggacagcgccgtggaacgccttgggcgctccggactcgggagcatggttcacagttccgacgaaaaccgatcaaattccacaaaatttcgttaaagccgaccggtttacgcaagcttatcggtaaactcagagaatttgtattcaatttttggtttatgaaatttgttcggaatctattgacttttcactggatttcgtgaaaacaatcattatattagagcccgaaacgaaaggtcacatcggaatcgtaaaccctcctcgggaggcggcatggggtaggagagatggcgtgcacgcgggtggctgccagcacacggggatgtgcctgcgtccaacacggtggagcacacgccgaggcggcacaggagtgatcgccgtggctaggccggattgagatccccacgatgacgatctcctctttcctttggataagagaggaataaggtgaagtgatcacttagatatggattccatatgtttttttttaaagtttctctttaccggctaggatactacgtcagcaaatcaatcatccataatataatgggatctaatttaggccaattttgcaagttagggtgccaagattttcggtattgcaattcagatatgcaatttaaaatttatgaactcgacacaaagttgagggatgtaagtatttgcgattgttgggctgttcacgggttctgttttgaagtcgaagtccatatttgcgattgaacctgggctggatggcgccgtgacttgggccatacgggactatgttttggaagaagcacacgtagcatagaattgagcaccgcagtgacacacacggacacacctagtacatgcttttgtaacactcttacaatagacaaaattcagaaataaatcattaaacctaaaaaagttgtatgaatcatacacatgcctatgcaagtacccgtaccaaaatttcaaggcaaacacttccactcactccaggttgataatacttatcgttttagataagggcacggttttcaagaaacaactttgaccattatttcttattataatatatatataaatgttaacgatatatgattttagtgaagtacttagtatttttgaagactaatctgtgcatataatcaccatatttcaaaaagacaaatattttataaattattcacaacgaaaaattttaatgttttatcttacccttgtttaaaaggataagagtattatcagcttggagagagtagctacgaacctataaacttatcccggaataaaaatgtccccaatatcatcatatccggatatcccctgtattagaccacggtctatcatcattcattttccgaagaaaaaatatccaacgttccgacccaccaccaccaccaagcatgcaccggccaatcgtacgtacccggtccgccgtcctccgccactttcctccgccgcccgcctttcccatccccaccaaaaacacggtttccccttttccccttccgctgccgacgtccgtagaaacaaacggcagctaaccactgcactattcctctcatcacctcgtttcgttggtttggaaagacacactgccctgcactgcactgcgaggcgccgcgaccgcgaccgcgactgcgaccccgaactttcttttcgttatcccgcgcgcggcgcgctgccggtagactagaccagtggttggttggttggctggccgctcgatcgatcgggcgtgcgtgcgtcaaatgcaaacgcgagattgcgttgcggagccctgcgcgggacggccgggacgtcggttcgcgagtcgctttctctcatctcttttcgcggcgcgttcgcctagcgatcgacctgagctagccgcgcgcgcatgcacggtctctgccaccggccgtcgtccttgccttcttggtttcgaatacaggataaggataggcatgcgtgccatgcggggtaaaacttaaaatgcgagccgtactaggtgagaaaacttcggtgtcacacgtacgcttggcacgcatgcagtaccggtccggccgggatattttggaacacgtcacacacggtcatggttggcgatgctgacacacggccatcggtcggttcaggttcatgtgttgcctggaggacgtatgtatgcgtccctttcgtccccagttaatttccacgttatttttcacgtacgctggccggccggttcaaacttttactggagtacgttgcgaattgccgcgttgacgcagcgtatacgtaagtgtatgtagctggcgctcgacgggtcggacggtgccactgccatgcaaggcaaatccgtcgctgtttttctcatttttttactgtcatcaacccaagccatgtacagcccactggtagagaaaccatctttggtcggtcgaccaaattccacaatagtcccggttgcaataaaaaccgggagtaaagatcatctttagtcccggttaaaatttttttgatctttagtcccggtttaaagaagttggtgggtagggtcaggctccaattatctttagtcccggttggtataaacaaccgggactaaagatctatttttacttccggttgtttataccaaccgggaccaaaatagactgccgagcggcgtgccccaattatctccttgcggtgacccctctccttttttttctctcctctttaagtctctcggtatccgcctccagcgcctgcctgcgatatgccccttcctcccctggcccttccccttcctccttcccctctctgctcccccttcctatccccgcctcctcctcctccttcccctctctgctgcggccgggcggcggcgaaagagcgaggcagctgcgcggcggcggctggtggggccgcggttgtgcggcggcggcggcggagcgaggcggccgcacggcaggcagccgtgcggcggcagcggagcgaggcggccgtgggcggcggtgggtggggctgcggccgtcggcggccgcg

SEQ ID NO: 93120 - DNA, 633 bp, Oryza sativa
tgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttctacggtaacaatccaaatatgccctaaaaaataataaaattgtattttaccagtcttgagattttaatcttgtatagttttcaatataaaaagatttgataactattgatatttatacaaaattaccatgccccctaaacagcccatttgcaggcgagccccccgcacagtacaaaatcgaccctcgcggagggcgagcaaggggggccgcctgcaaatttcgttgacggccgtcgcccgagagcgaacggccgtctgccacgtcattttcgccgccctctgagagggcgattttt

SEQ ID NO: 93121 - DNA, 2149 bp, Oryza sativa
cccgttgaagtgctgccatgccagtatacatggtatggttgttactagtgaaagaataattttcagttaaaacactgtaaaattatcctaacttaatttgttggatatccttgtctccttggtgttggtggtgtgaggcatctctacgagcatgttcaatcttgttggtcaaaaggggtcatttctggcaatgagtgaaaaatgatgagataataaacaaagttcacacttaaactaccaattttattacctgaaccagccatttatagaatcagatcattagatgtggtagttagtaactagccagtaagcattgaaataaaccaattattccattgaaatactgataaactaccatttatttggctcaacgacaactatttggaaaaataggatgtttggattctgttggggctattaacaatgtcgtttaagatgtgctaaagttagctaatattgaataaaggtaaggacgtagggttttgtgaatacttggtcttcggtgccaatgacattggcgcctatcccccttcacataagtggcttagcttccacggggaggctaggggtacggtgccaatgtcattggcgccctcatgttggaccataacaccaatgacgttagccccacaagaaaggtccattcccggaataaatttttctggggtctatttgtaaagtaagttttcaaaaaggaccaaaaagtgaattacaggcttataatcgttgataaccactcatcatatagctctgaacaatattaggttagccatacggacttatgtaaacttgtacaaactggccttggatgtgtcaaggaagctgtgatgcaattatatctctttagtttgcttcttcgcacatactattgattttactacttcgaatcattacgacctgataacttcttatatgattggtcgagtgacatgttggctactttgatatacacagatattattttatacttcccattaataatattaggttgttattgttattagggtggccagtctatatgtatcagtgatcttgtttcttcttcatcttggagtattcttttgcacagagtaagtttaacaaaaatccttttctctgatgattatggcctgcaatctttttttatttgataagatacttgtttgtgtttcagatcggggatcttctcatgtgctatttgctgaggtgcacatcaatctttctgcctgttaaaaagaatgattattttcaggtctctggtgttccactcaatgtggttctgcgaaatcctatatttgcaagtactgttgcgagaaaacatcaaccccaaactacaaaagcaaaatgtcatacagtaagcatttatttccagattttatagtttttcgactattgagtacaagtctttgtccagtgaaccccgtacaaatatttgattcccaacttaatgctctgaagacacaagtcaacaatttatctcagtatgactaggtctaccatttaaacaagtctcaacattcataaatttattttttcatgtataactataggtgaaaatagttctcaaatacagaaggaaatgtttacctcatccaataatgtgatatcctgcgatgttttatgatattcttgagtaagcatatttttctaaagaacaatagttttgttgtgtgtgaaaacaataacaataacaataacaataagttatacataaaagcctttcagaggtggggaaaggtgtcttctttggtagaaaaaacaaaactatcttgattagcctgattagttatatgtgattttggaataaaagctagacggagaacagtgtctgggattgcagcggaaacatgacttatctgacttcgtgttgatttcattacttcataaatgttgagttccaacaaggccacaacttttctgcaagatttttaattaaataggcaaaacacagcagaattacgatgaaatgagtatatcgcaatttctggttttcatgaagttccaggaatacaaaactagtccaaagaattggcacataaatttaaatttcccggtaataccaaatatccacatggagacatttttgtttataaagtatttttatacttttgtcaattttgtcagagaaatcttcaaattgcatcgtctccataactcgtgctataagaaa

SEQ ID NO: 93122 - DNA, 698 bp, Oryza sativa
tgtatttaaccacatcggccttacatatcacagcgcattcattggataatagataatgcctcaactttgtgcagagaaatatagacacaaacacaacttttccataggagaataccttgtctctccatccaagagcctgcggcttaaataaaatacagctctctctttcccttcaagctcctgaatcaaaactcagccgattgacttctcaccggctgatagatataatctgaaaggtatacccttctgtggagggattaaaactggaggagaactaagatattctttaatattatccaaagccttatgttggttagcccccagatgaattcttgatcggctttcaatctcaacaaaggtgtaaaaggttccaacctaccagataaattagaaataaaccttataacaaaatttatcttgccgatcatttcctgcaacttcttcttgcactcctgaggttgaatcttcttgaatgcataatactccttttgagttacctcaatccccctctcatgaacaagaaatcccaaaaactgaccaggcgatactccaaagcacactttggcggattcatcttcaggccatattttctagtcctctaaaaacccttcctcaaatccggtatgtgggtgttctaccttcttgactttacgaccatgtattaatataaaacttaaactaaccagccgacagatcat

SEQ ID NO: 93123 - DNA, 1326 bp, Oryza sativa
catcaggacacttctcctttatcttgtccatgtggtattcatacctctgaagtgtgcagctcttggcagctccccacatgttctgagaaaacaatgtgccatgatacttcttcttcatgttcttccacaagtgcctcatgcattctcggtgttccactcctggatagacaccatctacagctccctctatccctttgcttgttacaacaaaatgacaaggcatgagatacaagtgtacatcacagtcatgaacaaaagaatgcaaaacggaaatcacttgttaatatacctgcatcggtgctgatgaccaatcctgtaggagtacctatggcttgcttcaagttctgaataaaccatgtccaactctccttagactcggtttcaatcaccccataggccactggaaatagccaattgtggccatcgactgcaacagcagctgccaactgacctctttaccttcctattaagtgagttgaatccattgcaatgtaaggatgacatccttgcaggaaaccatcaatgcatggtttaagagctacaaagaatctcctgaaacaaacatccccattatgctcttcagtgtccaactcaacaatactaccagggattgccttcagaagtgcctctttgtaagtaggcaatatatcatagctctcatcccacttcccatatatcatgtccataaccttctccttggccctaaaaaccctgaaatatgggacatccatcttatacttcttattgaccttctcttgcaactcctttggtcccaatgtgggtttctcctttaaccagtccaccaccctatcagctatccatcccttagaagccattgtatcaccacacttattgactgaaaaacaaatgtggtctggcccattaagcttaacctgcatcaaacaatcaatgggcttgttaaaattcacatgaaggcacacatgttaaaattcatgattgaaagcatggaaaaaaatcagctcactacataccttgcatccatcatatttggacttgctggtggatgcaaaaaacattcacttgcaaccctcctttgctcgcctacactttgccttaaacctatccttgttttttttaacagtttggaaagcataatcattcaagattgcatggtgggttactgctgatttgcattcatcaacatcacgaaacagcacatctacatcaatgcatggatcatcaacatcatatgaaaaatcatgaatatcatcacaatcatcatcatcatcaacaatttcatcatcatgttcgtagctgtatcggagtcagagcattcagaatcatagcaatcagaatcagatgatg

SEQ ID NO: 93124 - DNA, 1677 bp, Oryza sativa
ctagacatgtccttcatgtaaaagacttgcgttacatcattggcaaggacaaaaggttcgtccgagtatccacccttgttaaggtcaacggttgtcatcccactgtcatcaatcattacgcctccaccagtcaacctaacccattggcaccggaacagaggggccttggggggaccatagtcaagttcccatatatcctcgatggcgccgtaatacgtgccagttgttccatcgtgtcccatggcatcgatacgaacagcactgttttggttcgtgctcttcatgtcttgggctctcgtgtagaatgtgtacccattgatctcacatccctggaatgtcgcgatcgacccagatggtcccctcgccaggaaggccagttgttggttgatcgtctcgttacccatgagatgttgttgtagccacgcggggaaagtatcaatgtgatgccgtgtaatccatgcatcggacttaccgatgtttctggcgcgaactagagccaagtgctccttgatgtaaggagctaccaatgaagattgttgcaaaaccgtgaaatgggccttacggaataaattgttgtctaccgtcattattgctttcctcccgagagttccctttccccgtagtctcccttcatggcgtgattcaggtaccccgattgggcgaaggtcttcaataaattctacgcaaaattcgatgacctcctctgttccataccccttggcgatgcttgcctctagacgagcacggttacgaacatacttcttcagaacgcccatgtacctctcaaaaggaaacatgttgtgtaggtacacaggcccgagaatactgatctctttgacaaggtgacaaagcagatgcgtcattatattgaaaaatgaaggtggaaatatcaactcaaaactgacaagacattacaccacatcattctgaagggcttctaatatatccggatcgatgaccttctgcgaaattgcgttcatgaatgcacatagctttgttattgtttcccggacattgtctagaaggataccccttattacaactggtagcagttgtgtcattaacacgtgacagtcatgagactttagatttgtgaacttcttctccttcgtgcttattattcgcttgatattcgtggagtatccagatggtacctttatgctctctaagcattcaaacatactttccttctctgccttgctaagagtgtagctggctggactcaagtaatggcttcctttctcctttggttccgggtgaaggtcgccgcgttgttccatatgcttcagatcattatgtgcttccagtgtatctttcgactttccatatacacctaggaagccaagaaggtttacgcaaaggttcttagtgaggtgcatcacatcgattgcgtggcggacgttcaagaattcccaatagggtaactcccaaaatatagagttctttttccacatcgccgcgtgaccatcttcgctctctataggctggcttctaggcccctttccaaacactactttaagatctttaaccatagcaaacactgttttcccgctgcgatgtttaggcttcgtacggtggtccgccttatgttcaaagtgcttgcctttcttccgtacagggtggtttgcagcaaggaatcgacgatgacacatgtacacaaccttcctacagtgctta

SEQ ID NO: 93125 - DNA, 1479 bp, Oryza sativa
atgttgatctagagcttaaataatgaaagattttaataaagctccatgtcaactttgtattagagtaactggaaagtagatcagtgtaggttcttggtcagtgctagatacatcaaaaataaattggctagtagatgagaggataacaaaagtgtccagcttgggctatagatagcaaaagtaggctgtcttgattggagaagttatcaggtagaacgcttctttttgccctttgtctgaatgaagccatagtcagtgctttcttcttcatcattttcctaaaaaagaaaaacagaatccttatcaaagtatattactaaggaaccagcaattctttctcatgcaatacttagcacaatgcaggcagtaggtttggcaagtatgagacccctagtgtcagccatatatgtgaatagtacatgtaaatagagaatagttgttgaccacagggtatacacttgcttgaatatttcattccattatctaaaaaaatacacttgattgaaatggtgccaagcttgtgcacagtacagttagtaggttaattgtatgattgaagaatgaaaaacaaatgaatttaaatatgatcagttgtttacctgatctgtactgtttggatcttcataagctctttttcctgacaaagtgcttgtttctaaattatatggttcaacttccatgctttgaatatcttggggtggttctatctgggatgatgagcagtaaataagaaagaaaagaaaggaaatagtaagagattatgtagcaccgacaaaaatgaataaaagaaagagtactactcttttacctcatgttgtattttcttggatagtataggcaccagtggaggtaaattatgtagttgttgagatgaacttgaactgatgggaagattcttagttgccttaaagccttggctggaatgttgccttccaaatctttctttaattgtcagcacctcaaatgaaggttcatcagcgttgatagttatgttcggcaaaaccttcactatgaatgtgaatttatgtcctatccatgcttttatttctggaggtgtttgattgatatcatattgccttttcatagtttcagcagtcctaccaataagttctgtacctttcttttcaaatagcacaagttcaaggctagctgtgccatcatttgcaatgaatggtattttgtacctgttcaagtgcagagttatttgaaaattatagttatatatattcacacttaatagtatgattggaaaaagaaatactcacttgtactcatactgcctacatgggcagttctctttcttgcattttaatatagaaccatcccatatcatcttgcaattgcacaatttacaggcttgataacaccaagtttttctttcctgaattccaatgatagtagcagtgcactggtatttttcatcctatgtaaatgtataaatgaaaggtttaagttgtagttcaatgaaagaatttaata

SEQ ID NO: 93126 - DNA, 1403 bp, Oryza sativa
tcactacaaattcaaaattaacatttctaacaaacactagcattccagtttcttgtgtgatttgcatcagctcaaaagatttgtagtagctaaagaattcattaaaatgaaatgaaattaataatggcagcactgcaagcaatactaacttacaaagtgcatatgctttttgcaagaatttgaaatggtaagccaaaaaaaacaagagttaaggtttattagacaatattattgtaggacattaagattgttatttacatcaagatctctaaaatcaatgtaggacatcagtaaagggaaaaaaaactcctagctagcagcacacacaatgcttcatctgcttcacgaatgtgcttacctacatatttaacttctagaactcataattgtatggaactcttaagccacaaggagaaagacggaagctacaatcagtataaaatttgcaaatatttggaatgttcattgattcttatggataagattaaatatgacctaataattgataagctcacgaatttttttccttaataggaacataaactgtagcataactgccaaagatgtgtttttaaaatattttgaagtatccgatagttcttaaaagaagtaagttctcgctggttcatgaggaatggatgtactcataaggagtggctgtggaacaagacacgtacatgaaaaaggatagaaaacgccatacatcatattatgtatttatatgtacaaagggcttatacatatgatacaacgatatgcacatactctatcaagtacatgatggcagaggcgggcattctagaatacagctgctaactagtgttgagctaacaagagggaaaccagtaaaaaaaaaaacagaacagtagcataaaaagaagaaagctgacagcaactgcaactatatgacttactacttacatctatacatgatggacctgactacaaagccacaaagaaaaaagaaactgatagctctgcacagatagttgagaagagcacaaaaggctagaaccttcttggtttagatggctctgaaagtaccggcttcctaaaaattccacagaagatgcatccgggaaccttgggtgaaggaggatcctgtgctgggggcacacggcgagtatggaacgcctggctgttgttgcacctggtgtgccctgcaccatcgccatgcctacgctgcagcccaatcaacccaacactacgggagtgtctcagctctaaggctccatcttcttgatctctctcgctatgaccatctaacataagcctctcatcccagaccaagccagatgaaccggaccttctaaatgtctgcgaagatctttgtagcgcggccatgttcctcacggtggttctctatctaggaatgttctatggtatgcaatgaggactaaggg

SEQ ID NO: 93127 - DNA, 2412 bp, Oryza sativa
tttcgggatgttgatcactgttctgttcctgcaacaagctattaaagtatgctatttctagcgagctcagtgctttgtatcttggaagaaaatatttagaacggtgcctacttattgcagggaattatagaagaattcaaggtacctggaggtgtcgaccatagttcacctatatatcgattccagtggttgtatgtcaacggcctacttggtgtaatcttttcaattgggctgttatacactgcattaaggtcaagaagggcaaggtcatgggtgtatggtcaaggttggtcacgttttcatcttacttttatctcattgtgtccaatttagggggcaagttgagctctgggtcatcaaattagcaatagctgttccattagtcatccatccaaccgttagatttatgccaaacatttcttttgctgttttgaagtttggactgggcctactttagatcaggcgttggttgggctgggctgcaagcttgtgttgtgtcagcctgtcagctttggggcaaaccatatggactccttttttttccttattgagtggatggcttggcttgagatggtgtttagtagcccatatcgacagattcttattctgcacagtgtttttccctctttgaaatttttaacatttagaaacaaaaacaagaaattactactatcttctctattaaatacgcaaagcttttgccatctttcaagtaaaaagagaagaaattactactatgtatgctacatcagcatgcaaatgactccatgatgacattttataaccattgagaagcacatgtacatgaactgatcattgtgcgtttgagttgacacttgcagggtggctcagaggcttcatttctgattatggtgtcccacttatggtgattgtttggacagcattatcgtacgcattaccaaaggatgttccttcaggagttcctaggaggctgttcagtccacttccctgggagtcaagttcactgcatcactggaccatagcaaaggtaataaatcaaacttgcttgggatactggagatgtgaatatttatggtcttcaggtttagaattttggtatagcttattttgcatggcatcattgataatatctttgggttttttttttatttccaggacctgttttctgttcccccagcatacatatttgctgccattctgccagctttgatgattgcaggactttacttctttgatcatagcgtggcttcacaattggcgcaacaaaaggagtttaacttgaagaagccctctgcttaccattatgacattttggtcctcggattcatggtgtgtgccatggttctatgataaatttatctgcttatacccgtctaaaaaaattatctgcttatggcggcccttcttaagtttttttttctcggctaactaggaacctaacatcttttggtcctcagtgaacatttcatttctctatcacttctagcctaaaactagccaaaatcttttagtatagtcttatgaatatgaaatatttccgttcaaaaaaaatgaataagaaatattctcatatattttaaagtagagttggtatttgttacaacaattgaatgggtatgattgaaaatccaacatccataatatcttatattcttttttgcgtgattataacctggcactactgcaatctacaaggtgatggttgataggagtattggacactgattctgctttgtggtgtaatagaccaaagctgtgacatgctcctcttctcatatagtagtataaaaatgatgcaggtcctgctttgtggtttgattggcatccctccatctaatggagtacttcctcagtccccgatgcatacaagaagccttgctgtccttaaggggcaggttggtgaacttcagaccgaagtgttttgtttgctacaatatccatatttgctcatcagctcacccatcttcttcctctgtttgcttagctgctacgcaaaaagatggttcaaactgccaacgaaggcctgatgaatcgtgctagcagtttggaaatctatggcaagatgcaaggggttttcattgagatggactgtgaaaaaaatgtgagtatgtactcttcattactgatgtatgttaccatataatttcctcttccatttatttgttgcattttacttctattgtcaatgccagttcctgtcaaaattactacatcagttgtcaagaaaattagtcctaagctcatgtaattgcctgaacaccttacttttcaccttacgaggagtccccatacttttggttttctttcagtaactattcaaaatgtagatgccactgttagtcttgtatggaaaatgttcaagtaaatcaacttataggtcaaaaattgtcctgcagactgattctgttgacaaggagttaaagagcttga

SEQ ID NO: 93128 - DNA, 2959 bp, Oryza sativa
ttttctttcagcaactattcgaaatgttgatgccactgttagtcttgtatggaaaatgttcaagtaaatcaacttataggtcaaaaattgtcctgcagactgattctgttgacaaggagttaaagagcttgaaggatgctattctgcaagaaggtgataaagaagggacattggctgaagaatttgaccctataaaacatattgaagcacatttgcctgttcgagtgaatgagcagagactaagtaacttgctgcaatccttattagttggtgcttgtgttggagctatgccagtcatcaagatgataccgacatcggtcctctggggttactttgcttatatggccattgacagtctacctggcaaccagttttgggaaagaataagacttatattcatcccatcaagccgacgctacaagtaatatctctatctgcatctgtttaccccatttgaacaatgaaattgcatgcttgactacttgcggtgcagcctatgtgcctccttttggattaatcgtaagataatccattttttgtcaaaacagtgattaacagctcacactatgcttcaacatttgcagggttttggagggtccccatgcgtctttcatggagtcagtgccttcaaaaacaattactgtcttcacgatcttccagttggtttacctcttgatatgcttcggcataacatggataccaatagcagggatcctgttcccgttgccattcttccttatgattcttatcaggcagcatgtcctcccaaagttttttgagccaaatgaccttcgggaattggatgcagctgagtatgaagagcttgaaggtgtccaccacgatcacacgctggtataaatttatctcccattcttggattatttacttgtcagtgatgattgtgtttcactctttaattctccgatgccccacgtctgttgttaatctgaatcttttgttccacacaggaggatggtgcatctgattcagaaagctgtggcagccgtgacgatgccgagatattagatgagctgacaactaaccgtggagagctaaagcacagaactttcaaccaccgtgaagaaaggcacccgcaggtaaactattggcatgaacaatattgcgccgaatgtgcacgggattagagatgagatgatacaatgcgtggccttacaatttgctctctaactcttctatcagcgtcactactagccaggcttgttgaaatatcgagctctttcttttttacggaagatcaaataccacgcacgatttgttgtactttctgcctgaaaaatggcagagttcacgtgcaaattcaaaattctcttgcgttaagcgcatttcatggcatccctttatcttttttatatatttgagtttgacaaatgttgatctccatcatgcaggcgcatacaaaagccgttcagcccaggtgtggagatacagaaaactggtccgagtgctaaagaatttcggcttactgtcggatgggtatacgataggcatatatagcacttcctcatacattcctactttcctatacatcgcactgtagcaggagatcggcggccgtatgatatgatatgcttgtcagttgtcacattgtgcatggagtaaacagaagcaactggattttacgatgttctctagcctgtgaaatgttgctccttgattgttctgttcgattgtaaaattgcatggcaaatcagatgtggggagtagcacttcatgtttcgtttgctatggcataaacttttagcctttttattattgacaaaattggttatatagcatcgaaccaattttgcctataacttactgtagcacgcagacgcaggagctcacatcctagggaaggatgggaacatgcacagtgcgcacggaaaacggagtaatctattagcgtgtgattaattaagtattttagctatttttttccaaaaatagatcaatatgatttttttaaaaaacaactttcgtatagaaacttttttttaaaaaaacatattgtttagcagtttaaaaagcgtgcgcgtggaaaacgagaggggagtgttgggaacttgctcttgcaaacacagtgtttgatggatccaatcttcaaactggtaagacaattcctcgatctccagttatattcctagtttatcaacttcctgcttgaaattaagattcagaaatggttcagtgatatttttagaaaaagtgtcgagaagacgaaataaaaacatgcaaacaaacatcgattttgtataaactataggatgagttatagagggattcaggaccaagtaattaaagggagcaagaaacgttggtgctgctaaatagctaaatcctagccacaattatattcatctaaaatcatgctcttgactgatcaagctaccacaacgtcaatgctgtctaaacataaatgggcagaacaattcacttcaaactaggaaaattctgtacaacatgcaaccaaaagaacagtatggcatgcatttggcaaactagacatgaaattattaccttttcatggtttgtccagacaggtaatatggcatttcactggagataaaggagagtctctcagacatccttctggcagtcatgtaggtggtgttctgatgagacaagcttccatttttagaataactagtacaacctagtagaatcttcttcttcatgtggaccttgatcatccatgttgtggcttcagggacaatgtagttgccctcgttcaacaagaagcaaacggtgtaagggttttccatgtcaacaatagggaattctggttggacatttggaaggcggttttcacaatcgaggtcccaaagttgggcagcatccagtgtcgcatcttctctccatgttccgtcctcgcaccacgaccacagggttatgctaaaactgccaccacattggttgatgatattgacgaacttgatgccatggtgggtggcacaca

SEQ ID NO: 93129 - DNA, 679 bp, Oryza sativa
cctttatctctaacattgtcctatcacattgactattgcagtcaaacttggtgttggtggctttagcatgggcgcagctaccgccctttactctgcaacctgctatgctcatggaaaatacggaaatggcaatccatatcctgtgaacttaagtgtgtctgttggtctcagtggctggcttccttgtgccaggtttgtcctagtatgttcacgtgtttaggtatcactgaaatttcagccctgtaaatgatattgactgatatacttgttggttatcacaggtctttgaagaacaaaattgaaagctcacaggaggctgcacaaaaggcttcatccatacctcttttgctttgtcatggaaaaggtgcataaactgttctgtgaccttcattagtatactaagtttctgttacatgttacatttacatgtaatggcattaccaaatcagttggcattgttctaacattcaacttgaggtagtttggggtttatacttgtttcgttgctttatgctagctgaaggcataacctaatataccaggttctgagttttgacaatagcatggcactattcctaggaaagaaaggctacatgagtcttataatccacagcccaaatttgaatttggaaagttaattttaaattaatataggtgtttttttaactttttctattat

SEQ ID NO: 93130 - DNA, 797 bp, Oryza sativa
attcctgcagctcctatgagaaaaggagcatgccacaattttggactgataatgaagtcagaacacaggatagatgcagggtgtacattagaccagaaagcagaatctgtatcctatctgccattgccttgtagattgcagtagtgccataatcacgcaaaaaaaattcagatattacggatgttggaatttaattttctaagaaatgcaggtgtattttcaatcatacccattcaattggtgtaacaaatacaaactctactttaaaatatataagaacatttcttattcaaaagactatactaagagaaacttaagaagggtcgccataagcagataaattgtatcataaaaacatgccacacaccatgaatccgaggaccaaaatgtcataatggtaggcagagggtttcttcaagttaaactctttttgttgcgccaattgtgaagccacgctatgatcaaagaagtaaagtcctgcaaccatcaaagccggcagaatggcagcaaatatgtatgctggaggaactgaaaacagatcctgaaaataaaaaaagagaagatattattaatgatgccatgcaaaataagctgtgcgaaacttctaaaattgaagaccataaatattcacatctccagtatcacaagcaagtttgactaattacttttgctaccgtccaatgttgcagtgaactcgactcccagggaagtggactgaacagcctcctaggaactcctgaaggaacatcctttggtaacgtgtacgagaatgctgtccaaacaatcaccataagtgg

SEQ ID NO: 93131 - DNA, 948 bp, Oryza sativa
cgatctcatcgtgtattccgctacgagcttggagaagagagacgacttgtcctccagtagcctggtcggcgtgtcgcgctccacggccacacctgcaaaagcattggcacggtgtttcggtcgtcagacagacgcgacaaacccatacaatatgtaagataaattgggattggttagttggaactgtggttattgtcgttataaaatcggagattgattagtggcatctgtgattggtttgggacttggaaggcgaactaaactcaccgttgtcaaggagcaagaccatgtcgctgtcaaggacggaggtgatccggtgcgcgattgtgatgaccgtcgcgtcggaaaactgctgcctgagagttttctggatgaggttgtccgtggcggtgtcgacggaggccgtggcctcgtcgagcaccaggatcttgctccgtttcaggatcaccctcccaaggcacaccagctgacgctgacccacgctccagttctcgccgttctctatcactgcaaccaagccaagccaagccaaatcgggagaatattcaccaagaattaccaagtgtaaaagtagactttgaactgcatgattctgaacaggaaaaagaaatgagtccagatgcagagaaccgaacggacctggtgaatcaagtcgcagctccttcctcctaacttcatctcctagctgacagcgatccaaggcctgaaaaggaagggcaagatattcataaatcataatagaacttcactgcaagtccacaaatagtatgtggcagctgacaatggtgaagcatgtgaagactggaactacctcccagatttggctatcagtgtactctccaataggatcaaggttggttctcacggtaccctcgaacatggttggctcttgcgggatgatgcttagcctggatctcagatcatgaagtccgatggtgcagatgtcga

SEQ ID NO: 93132 - DNA, 3469 bp, Oryza sativa
  unsure (1)..(3469): unsure at all n locations
ctctacattgtcaatttttttcagattttttcacaactatttgcatcgaatttagaagaaaaaggtatacgaggggatatccctcgagggattagaatccactcccccaccatgccatccattctctcaaggtcacaacagctgcttatatagcaaagaagagagctggaagagctagtagctagcaagcctccttatttttgcacttgcaaactgcattgtttcacttgtctgcagctagtttcaatggctgccatcaaagaggaatccgactacgacagtagccggtcttcgctgacggcgccggactcccgccggagctggatcagtgacattggtagctccagctcggtctcggcgcgctccttcggcggcgacacaccggcgtcgtcatgccggtacaagccccacaaggcgaaccaggccgagtgggaggccatccggcgcctccgtgccggcgccggccgcgtcgggctggagcacttccggctcgtccgccgcctcggcagcggcgacctcggcaacgtctacctgtgccggctgcgcgagccgtggtcatcgtcgtcgatgacgacgacggcgggcggttgcctctacgccatgaaggtggtggacaaggacgcgctggcgttcaggaagaagctccggcgcgcggaggtggagcgcgacatcctccgcaccctcgaccaccccttcctgcctacattgtacgccgacttcgaggcgtcgcactacgcctgcctcgtcatggagttctgccccggcggcgacctccacgtcgcccgccagcgccagcccggccgccgcttcaccgtctcctccaccaggttcgtactcgtacacctccacacccacgtcgaacgtgtgaatgcatgcgtgcccccacccatgacccattcatgtttagttactgctccactagcctttttctttgttttaccactactactactgtggtctgaatgaatgtatctgatgatctgaagagtgggggagaaatgctctgttccagggtcaagctttgtttcagtgtcacttttgcaaaagcttagacctcagctttaggttagtgatcgtctttccatgttgcattggggctttcatccaaatcctttttgtcttgctgtgccaatctaaacagatttgttggcaccacttggggttcatactaagctaatgatttagtaagatttaaacccaaaccattgtgcagcttaagcttttgatactcacaagagggggaaaaaagagagaagagaatcttggggttattagcattcctagtctcttactgtggatggattatctttgtcggacagtgaactgatgttgctgaaaacgaattaacattgtgttgtgtatggcaggttctatgtggcggagactgtgctggcgctggagtacctgcacatgatgggtgtggtgtacagggacctcaagccggagaacgtcctggtccgcggcgacggccacatcatgctctccgacttcgacctctccctcaagtgcgacgtcgtcccgaagctgctccgccccgccaggagcgccgccgccggtggcaagccgccgctgccgccgccgtcgtcgtgcgtgccgccgacgatccagccggtgctgtcgtgcatcttccgcggcgtgcacaagtgccatcacgccaaggagtgcgccggtgncggcgcgccggcgggtaacaatggcgacggcgacggcaacgacgaggaggcggagaccgagacggcggagcccnaggtggtggtggtggagccggtgncggcgcggtccaagtcgttcgtgggcacgcacgagtacctggcgccggaggtgatctccggccagggccacggcagcgcggtggactggtggacgctcggcgtgttcatgtacgagatgctgtacggccggacgccgttcaagggcgagagcaacgagaagaccctcatcaacatcatcaagcagccggtcaccttccctcgcctcgccggcgccgccgccgccggcgaatgggaggagatgaagacggcgcaggacctgatgttgcagctcctggcaaagaaccccaagaagcggctggggagcaccatgggctccgccgaggtgaagcggcaccccttcttcaagggcgtcaactgggcgctcgtcaggacagtccggccgccggaggttcctgcgccgccggcgccggcgccgaagaaggtgatgacgatgagcaagaaggagcggcaagagccgtacaactaccgaccggaaaaccacttcgattacttctgatcaagtagctgccatgcatgagcatgatgcatgatgcatcttggttaattaattaattaatcacttgtaagaggggagattagtagtgtacatagagtgctaatcaatgagtaaccagtgttagtttctcagtgagtgagtgagtggcaggcggccatgggtggtgggggtctgcatgcttgctctcatggcgcggttgcgcacgcgcggttcgtcactgggttgggctagtcggctacccgtgcgcggcagacacgagcccccaccagttccgtcggtcgatcgatcgatcggtgaagcagcagctttgtttgcgtggccccggacaccgtgcgcgcatctcccagccgatctcgctgctgcgcctgcgcgcaatttcttgtgccgcctttcgcggaaataaagccagccccctccccgcgaagtgtctaagtaacttatcctaaaatataacaactttttctaaaatataataacttttgacttatcttgtcctaaaatataacaacttttagctaagtgtccaaatttataggtaaaaatgcttatattttgggacagaacgagtatactctatactcatcatggaaaatgtcaagcatgtctgttcttaggccgcccaggctagtcgacgaaaactccgttaaattttaatactgacgagtaaatcgataataaaatttaaatttttatagtaaatactagttatattgaaatttgctcatgcttaaaaaattttcgggtaggcttttttcccctaaaaccaagtgcaaacgttgctcatttgttcacatttatctctataaatatacactcactatctatataattgtacacatgcaatgcacatcttatctctctggcctccgtaaaagattagactgaacggcttattattaataggtatatagcatgtcgctaaaaagaatcattaaccataaatataactactcggaacataaccagctgagtgtcagctagccatacaatttatgttcaacggtgccaatgatggcaatgctaaattttgctataaaattgaaaatgcgaacttgaatttcgatctatggaagcaattttgccaatagtttaagaggtcactaatggccaaagttgtaaacagttctgatgacaagtaaataggtaaggagagtagctaaaaataatagtgatgttcaaagtattaaaaagaatcaactcg

SEQ ID NO: 93133 - DNA, 754 bp, Oryza sativa
gctgacattcctgctggtcttcagaaaatggagagagcattcaggtcttgaagtatggagtgaacagaagtggcagtatcaaggaggaacctaaatcaagcagtggtgcccataggcttgcgaccattttgatgtatctttctgatgtcaagcaaggtggtgaaactgttttccccagatctgaggtaattatatcctcaccaggcctactttttcagaacaccttatcagaataactatgcactgcttatagtctaggcacatgtaatttcttcagtgatttgattcagttgagcagaagatcttatactaaactatgattttagatgaaggatgctcaagctaaggagggggcaccatctcaatgttctggttatgcagtgcgaccagccaagggcaatgcaatactgctgttcaatttaaggcctgatggagaaacagataaggatagccaatatgaagaatgtcctgtcctcgaaggagagaaatggctagccataaaacatataaatttgagaaaatttgattatccaaaatcatcacttgcatccgaggatgagtgcacagatgaagatgataggtgtgtgagttgggctgctagtggtgagtgtgacaggaatccggtgtttatgataggaagctcagactactatggctcttgccgaaagagctgtcgagtgtgctgattattttgcaattttttgctagtagaaatattgatgtcataggcagagaatggtgtaacaaactgtat

SEQ ID NO: 93134 - DNA, 637 bp, Oryza sativa
tgctgggcgttctcggccgtggcagcgatggagggcttcgccaagctgagcacccggaagctcatctcgctgtcggagcaggagctggtcgactgcgacgtcgacggcaacgaccagggctgcgagggcggcgagattgacggcgcgttccagttcatcctcagcaacggcggcctcacagccgaggcaaactacccgtacacggcggaggacggccggtgcaagaccacggcggcggcggacgtcgccgcgtccatcaggggctacgaggacgtgccggccaacgacgagcccagcctcatgaaggccgtcgccggccagccggtgtcggtggccgtcgacgcgtccaagttccagttctacggcggcggcgtgatggccggcgaatgcggcaccagcctagaccacggcgtcaccgtgatcggctatggcgcggcgagcgatggcaccaagtattggctggtgaagaactcgtggggcacgacgtggggcgaggccgggtacctgaggatggagaaggacattgatgacaagaggggtatgtgtggccttgccatgcagccttcctaccctactgagtagcttagcaaggtgttgaataattgtatacacatccatatatattgtcttgtaatgc

SEQ ID NO: 93135 - DNA, 765 bp, Oryza sativa
ctatcattcacaggagaagcttccttctgattgttggttgcagcggatgacggtcttctgcttggtatcgccctccggaggttgattgcccttggctcggcctggagtaggtcggggagagacacaactccttccatctacgacaattctttgctgaggctgtcgttgcagagaatggttgctaagatttattgccgagtcaggtgcagcaggtggagcattggtgcattgtttctgctatgggttctgattaacacgaggccttacgggtacggcgtttgctccagtgaccacaatacgattggaatgtctgcttcgtgtaaattggcgaaaatgtggaggtcggggacagttttttggagtaatgcccttctccactgcagttgtgacaaacaataactttcttacactcgggttcttcatcttgtacttgatttctcagctgctgtattggagcttccaaaggtacaacgcagatactggcatctgtcttgtcaactggtggctggggctgaaattgagcattgacaccttgtggtagtgcactcattggaattggagctgttgcaacgcgggctataggactgcttcgggatgcatggatgaccattcgttgaggagcaagcttctgattgcagggagttgcgtggactgacgtgccggcagctatgtttctcggttttgggcacttgtcggcgaaatgacccattccttgacaattgaagcacagatatcttcccggactcggcattttcttttctcatt

SEQ ID NO: 93136 - DNA, 724 bp, Oryza sativa
ctcgaccgcgggtgctgcggcgtggggcggaacaacgggcagatcacgtgcctgccgatgcagcagccgtgcggcgaccggagcaagtacgtgttctgggacgccttccacccgacggaggcggccaaccggatctacgccgccagggcgttcaactcctccgccgccgccggcgacgcttaccccatcaacgtcagccagctcgccgccatatgaatccaatgattaatctcgctgacatatgatcgatcattgatcaatgcatgcacttacttacggcaagagcagtgtatctcggttggaaagaattaatgttgtacccctcattctctaaatgtttgacgttgtcgacttttttaaatatgtttgacaatacgtcttattcaaaaacttctgtgaaatgtgtaaaactatacctcattccctaaatgtttgacgctattgacttttttaaacatgtttgaccattcgtcttattcaaaaacttttatgaaatatgtaaaactatatgtatacataaaaatatatttaacaatatatcattttcaaatgatatgaaaataattaataattacttaattttttttaataagacgaacggtcaaacatttttaaaaagtcaactgcgtcaaacattttgggatgaagggagtattgtagtagtatataggtattattatcagctattcccatcgttccataatataagggattttggtcggat

SEQ ID NO: 93137 - DNA, 2763 bp, Oryza sativa
cgagaaggcgttccaaactctcaaagaaaagctggcctcctcgccagtgttaattttgctggatactcgcaaggacttcatggtgtattgcgatgcttcgcgccaaggattggggagcgtgctcatgcagacggtcatgtggtagccaatgcatcacgtcagctacgacctcatgaaggcaactaccctacacatgacttggagttagcagcggtggttcatgctctaaaaatctggcggcactatctcattgggaaccgctgtgaaatatatactgatcataagagtttgaaatacatcttcacccagtcggatctgaatcttcggcaaaggagatggttagaactcatcaaggattatgatgtgggaatacactatcatcctggtaaggccaacgtggttgccgacgctctaagccgaaagagccactgcaacactctcaacgtccgaggcattccacccgaacttaaccaacagatggaagccctgaacctaagcctagttggtcgcggattcttggctgcgttggaagccaagcctaccttgctcgatcaaatccgcgaggctcagaagaatgatccggacatgcatggactcctcaagaatatgaaacagggtaaagccgcaggtttcacagaggatgaacacggaaccctatggaacggaaagcgggtatgcgttccagataaccgagaacttaaacagctgatacttcaggaagctcacgagagtccttattccattcacccaggcagtaccaagatgtacttagacttgaaggagaaatactggtgggtcagcatgaagcgggaaattgcagagtttgtggctctatgtgatgtgtgccagcgtgtcaaggcagaacaccaacgaccggccggacttctccaacctctccaagtgccggaatggaaatgggatgaaattgggatggatttcatcaccggccttccaaaaacccaaggtggatatgattctatatgggtaatagtggatcgattaaccaaggtagctcgattcattcctgtgaagaccacctatggagggaataaactagcggagctctacttcgctaggatcgtgagtctccatggcgttcccaagaaaatcgtatctgataggggaagccaattcacctctcacttttggaagaagctccaagaagagctgggtactcgattgaatttcagcaccgcctatcacccgcagaccgatggacagaccgagcgtctaaatcagatcctagaagatatgctccgcgcatgtgtcctagatttcgggaagacttgggataagagtctcccctatgccgagttctcctacaataacagctatcaagccagcatacaaatggcaccctatgaagcgttgtacgggcgcaaatgccggacaccgctattgtgggaccaagttggagaaagccaagtgttcgggactgatatcctgagagaagctgaagctaagtcagaatcattcgggataatctaaaggtggcacagtctcggcagaaaagttatgcagataaccgtcgccgtgatctggaattcgcagtggatgactttgtgtatcttcgggtcacgccattgcgaggtgtgcacaggtttcaaacgaaagggaagcttgcacctcggtatgtgggtcccttccgtatcgttgctcgacgcggagaagtcgcctaccagctggagttgcccgcctccttgggcaacgtgcatgatgtgttccatgtgtcgcaactcaagaaatgtcttcgagtgccatccgagcaggccgactcagagcaaatcgaagttcgcgaagacttgacgtatgtggagaagccagtgaaaatcctggacaccatggagcgcaggaccaggaaccgggtaatccgtttttgcaaggtccagtggagcaaccacgccgaagaagaagctacttgggagcgcgaagacgaactgaaggcagcccatcccgatctcttcgccagttcttccgaatctcggggtcgagattccgtttaaggggggtaggtttgtcgcgtcccaaatcgactctaaaattcatcctcgaaattgtgcaaaagaataagtaaaattcaatgtgaaagcctccaacaattaaaatgtgcaaagataaaagtcaaatgaggcttggaggatttttgtatatttcctaagagcctaaaatgcttaaataaattttagtggaattttcagagcacaaataataagtgaaaagaaataaacaaagtaaaaaggttttataaaaagaaaatcctaaaagaagttcttttcccccccctttttccctcttgggccggctcggcccattccctccctctctctctctctttccccccggcccatcggcctccccgcgcgcgcgcgtcgcttacaggcgggcccgcccgccgctctcgctgacgggtgggacccacctgtcatcgccctcctcccgccgcgcccgccgccgcgcccgtgccctagcgccgccgccgccgcggattgcgccgcatcccgccgtccccgcgcgcattaaagagaggggaatcactccccgtgattccctctcccgtttcccccgattccccctctctctctccctcggattcgttcgaatcgtgcccgcattcgtcgccggcgcaatcaatggcggccgagatctccgcggccggtttccttcctccccggccgccttctctcccttccgacgctataaaatcgttgcccgagctccgctcttccgtttccgccgttcaccgctcgctctcgccgtcggaat

SEQ ID NO: 93138 - DNA, 1970 bp, Oryza sativa
atgacggcggggcggtttggaccggagcggcgacactggcgacaggcgcgtgcagaggctgacggcggcggcgaccgggcggtcggccaccacggcacgcgcgcgcgggaagcaacgggcggcgtccgcgcgggcgcgcacacgctggctcgcgaggacgagcggatgcgcggctgcaggcgcggcagagcgaggggaaagggagggggcgctcggcgcggcggcttacgcgcacgcgcgcgcggcgtgcgggcgaggctgagcgggggaggagagatgggagagcgcgcgcgagagagagagagagagagagagagagagcgcccggggagagagggggccggggaagaggggaagatgggccgagcgagattcggcccatcgacctcgggggaggcaaaatagacttttgcggaggaatttgattggaaggatttggattcggaattgaactcgacgatagatcgggtattgagatcttgagatggcacggacactagacaacaagcaaagaaacaaatttcgcaattagggtttttaagagatgattttcccgctaggcgccatgacggaacgggcgctacagaccaacccccctaacaagaatctcgaccccgagattcagcacctaagggagcaggtccgggaactcggcgcggagaagatcttctcgctcccaggttgcctcgtcttcggaatgattgctccattggactttgtagaacttgatggtcttccttcgagtctgacgttctgcctcttcaagaaccttgatcggtctttccttgtaggtcagattcttttctagctcgatattacccaggggaacttgctcttctggaactcgaagacatttctttaactgggatacgtggaacacgttgtgcacgtctgcgagaccttcaggtagctcaagctgataagccacttcgccacgtctggcggttatgaggtaggggccgatgtagcggggtgctaacttgccggacatcccaaaccttctcataccacggaggggtgatacccgcaggtacacatgatctcctttttcgaactcaaggtcacgcctccgattgtcagcgtaattcttctgacggttctgtgctgtcttcaaacgttctcgtatcagcttaacttgttcttctgctgacttgagtatgtcaggaccgaataccagtgctttgcccacctcattccagcacaagggggtgcggcactttcttccgaacattgcctcattcggcgacatctgaatgctggcctgataactgttgttgtatgagaactcggcatacggcaaacaacgatcccaagtgccttcgaaatccaaggcatacgcacgtagcatgtcttctaggatttggtttaccctttcggtctgaccatcggtctgcggatggtaggctgtactaaaattcagatcagttccgagggcttcatgcaactgcttccagaaccttgaggtgaactgagtgcctcggtctgacacaattttcttgggacagccaaatctacatacgacatgggtcatgtagagttctgctagtttctttccatcataggtggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcagaccagctggcctctgatgttccgccttgactctttggcaaatgtcagacagggctacgtattctgcgacgtctcgcttcattccagcccaccagaagtatgccttgatatcttggtacatcttcgtacttcctgggtgaatggagtaggcggactcatgagcttcctttagcatgagatctcttaactccttcttggccggtacacagatgcgtggtccgctccaaactgtgccttgatcgtctatggagaaa

SEQ ID NO: 93139 - DNA, 4332 bp, Oryza sativa
gtttactttatttacttacctttttattctgattttctacctttattcaaattaatccaaaaacttgtgctattaattggatagatgtcttaactccctcctttcacttgtctttagatgccgtgttacaagcctgagtacctgtttggcgttgagggttttgtccaggagttgcgtacgatgtcctttgtcattggatttgggaatgctcctttttatgcccagattcgtcatgatcgtcatgaagaaaagtgccgagtcaaagtcaccttgaacagcaatagtgaagatatcccctcagtaatgtttgaagctggaggaagaaactacatccatgcatgtcaggaggtggcaaggatcgccataggagagctccgtgatcgctacagtgatcagttggtcgacactgagtatcgctatcatcctcgccaaccccagggaagtgaccgtggcagttaccttgagactgaaggaattgagaatgatgttaccacaagacatttggttgagatgttgtgggctatggatgaaagtcgtgcggagactgtgttagcagctcaagatcgtgaagatcggaatcgtggtaagatttgcaagctagaagacaaggtggatcgtttggagaaggaattagccgcattgaagggagaagcaccgccgcagaaggccaggattcgtcttaccgcaaggaagagagctttatttgtccctcgctatcaactggcgccaaaggttcgtgtggtggagaaagaagttgccccagctcaagcggatcctccggtcatcatcataagtagtgatgaagaagaagaatccaagcgcatcaattccaagattgagtgggtagcaactcaagatgatgaagatgagccttcaatcgacctcctatgctcggaagaactagagtgacttgttaagtcgttgtcttagatcgttgtgttagtttgcttgttttaagtttgtttgtgtgtgtgggtctcgcatgtgatttacatcagtggtgggatgtaattgcatgtgtttgtttgcttttgagtgttaggaagttggagagtttagtggtgtgggagtcttcagtttgtaataatgaaactcagttaagatcaataaaagttaaagtaattctctgtcctaagtagtttcccccgttttctcttcttatcctatccataccagatggtgaacactcgtagcaatgggaatggtcccaacaaccccaataataacatcaatggagagaatcccactctggcccaagttcttgctcagcagacacagcttatgaacatgatgatgcaacaatttcagaatcagcaaaaccaagggaataatcatgcacctccacagaacaagttagcagaatttcttcgtgtgaggccgcctgttttctctagtaccactaatcctgttgaagctagtgattggctacatgccatagagaagaagttggatttacttcagtgtactgatcaggagaaggtctcatttgcatcacatcagttgcatggccctgcctctgaatggtgggatcacttccgtcttaacaggactactgctgaacctatcacttggcttgaattcaccgctgctttccggaagacgcatataccatcgggggtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccacttatggttggagattaccctgatttccagaaattagtggataaggctattcgtcaggaagacaagtacaatcgcatggagcagaagaaacgtcggattgctcaattcaagacacaacagggaaataatcagaagccgcgtcttactttaggaccccagtccatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcagcaagcccgtggtgtgtttcaactgtggagatccaggacattatgctgacaagtgtccgaagccccaacgcgtgaaggttgtccctgcccagagtaactctgctgtaccagcatcaaaggcccgtgtcaatcatattgctgctgcagaagctcaaggtgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctttttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaaccgttcatgcattgtcttctgagtctttaaggtcaagactgaatcaaataactttggaagagattcctatagtccgggagtatcctgatgtgttcccagatgatttaccgggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggtaatttttgtggaaaagaaagaccatactcagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttgagaatcaaagaggaagatataccttagacagcttttaccactaggtatgggttgttagaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtccgaagtgaaattccttggtcacgtcatctcagccggaggagttgccgttgatcctagtaacgtggaatccgtaaccaattggaagcaaccaaagacagtttcagagattcgcagtttcctaggccttgcaggatattatcggaggtttatagagaatttttctaagattgctaagcccatgacacgactgcttcagaaagatgtgaagtacaaatggtcggaagaatgtgagcggagttttcaagagttgaaaagtcgcttaatatcagctcctattttgattttgcctgatccaaagaagggtttccaagtatattgcgatgcatccaaacttgggttaggttgtgttctgatgcaagatgggaaggtggttgcctatgcatctcgtcagttacgtccgcatgagaagaactaccctactcatgatattgagttagctgcagtcgttcatgcattaaagatttggcgtcattatcttttcggtactcgtacagaagtgtacaccgatcacaagagtttaaagtatatctttactcagccggatctgaatatgagacaacggagatggttggaattaattaaggattatgacatgggaattcattatcatccgggaaaggctaatgttgtagcagacgctcttagcagaaaaggttattgcaatgctacagaaggacgacagttgccattggaattatgcaaggaatttgaaagattaaatttgggaattgtcggtagaggtttcgttgcagctttagaagcgaagcccactctaattgatcaagttagagaagcccaaattaatgatcctgatattcaagagatcaagaagaatatgagaagaggaaaagctattggtttcttggaagatgagcacggaactgtatggttgggtgaaagaatctgtgtctgtcacgtcctgataaattcatcccaaaattaaaattcattcgctaaaaggaataat

SEQ ID NO: 93140 - DNA, 1016 bp, Oryza sativa
ccaaaatttaaattttggccaaaattcagactggaatttcgggtctatcggtacaccgagagcacattctcttcggttgaaaagtttggattcagcaaaattagtttaattaaattcagacaaattttgctgaaattttaaaattaattttgtccggaaatttccaacatctccaaaaccgattgtattactcctcaaaatattggtggtttccgtaatattgaaccgtggtcattaattattactagctacatgatcaacatgtctgaattaacgttggcacgtccgtactgtacagtacgtactactcccttaccaggttgttgccggtctcgggcctgatcccggcggccccggaggcgaagttgaggccgcgggcgaagtcgccgggctgcgccatggcgtacgccgggatgagcggcgggcggaggccgagcatgtcggcgagcatgtccaccacggtgaggccgttggtgaagcgccccggcggcgccgcgccggagaagtcgatcccgtagggctggtagttggcgcgcgccaggctcaggatgttgttgttgttgccgctgtccaccagcgagtcgccgaagatgtacatgcacggcaccagctgctgctgctgcgccgccgccgccaccaacgccggcgacgccgccatggcgacgacgagaagcacgagtgctacaggtgatctagctttagtgtgcattgtgggggcgctagctgcgctgtggcgtcgatggattatttatattggtctttgtgaatggaggagtgtgggtgtgtgtgtatatatagatatagaggtaatataatatggttggttggaagatgatcgatccgtcgtggatgcatgcacatgcatgccggctcgtgaaatttctgactgatcacgggaaaacgcaagcagactgtattgtgttgtgtggctgggccggtgactggtggaggttaaagtaaatgactcggggtgcctcagccgaaaaaggcgttgcgatcaacatagcggcgacaac

SEQ ID NO: 93141 - DNA, 809 bp, Oryza sativa
gtgataattctgtagctcatgtttagcaagtttgagtatgacggaaagctgaacccaacatttacagaaggttcatttgagctccccttttcaagtattagagcatacataaacgagccaatcactccaaggtttgttctttgtactagttttactatatgacatcatcagaataaatgagcactgtaatcgtccgattgtttggaagtcatcaagactcactagaataaatgacaattctacttgcaggtttgtccatgttagttctgcaggagttacaagacctgagagaccaggcctggatttaagtaaacaacctcctgctgttcgcatgaacaaagagctgggctccattctaacttacaagttgaaggtatgcgccatttttcctttattattgtgcatttgtgcttattgattcacatcatgtctaaatgcttatcgcatgtcctttcagggtgaggatttaatccgggaaagtggcattccatatactattgtgcggccatgtgctctaacagaggaaccagctggagctgacctcatatttgaccagggagataatatcacagtatgtagaggcagcatttgtttgttggctttataagatgccacgccattctttcttctccataagatcaaataaagcatcagtttcatataagtttcctgtattttttttttcagggaaagatatcaagggaagaaattgctttcatttgtgttgcagctctggcaagtccaaatgcagtagagaaaacctttgaggttaaaattctgcaactcattgcaagacactacttgggaca

SEQ ID NO: 93142 - DNA, 538 bp, Oryza sativa
ctaaaccgcacatggaacatgaatctaaatccagctaaacaagtggcttaccaagtctacatcgggccccagcatgctcctcgccttctcttcatttctagcctgaattgaaatttgaaatgttagatcaacattaagagcagcaaagatccaacaaaagagggagaagttggactatccatgtaataatgaatgaaaacagagaagccaaaagtagataagcttgacaagtattgtaccaatactcgaacgggtattcccttattccgcaggatatcaaccactcttcgtccaacgccaccggtagctccagtgaccagcaccacatcagaagattccattttctttggcacctcaccaggagcagagccagtgaaactgctaagaatggactctacaatctacagattgaacagacaaaacatgagcacaatgccaaatgtgaaataactgtaacgagaagaggtgaaaaaaaatcccaatacagtgagtaaaccttgagaggattcggtggcccgttgaagaaatacagcgtcct

SEQ ID NO: 93143 - DNA, 531 bp, Oryza sativa
cgctgttgggcgtctacgacttcaccgccggcctgcctccgtcgccgccgattggtgcctccgcctacacggctggcctattatgccaccgctgttgggcgtctacgacttcaccgccggcctgcctccgtcgccgccgactggtgtcctcgcctatacggttggttggtcacaccaccgttcatgggcgtctacgacttcaccgccggcctgcctccatcgccgccgactgatgcctccgcctacacggctggcctattatgccaccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgactggtgtcctcgcctatacggttggttggtcacaccaccgttcatgggcgtctacgacttcatcgccggcctgcctccgtcgccgcggactggtgcctccgcctacacggctggcctattatgc

SEQ ID NO: 93144 - DNA, 706 bp, Oryza sativa
ggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcccactctgctgccgttgatgggaaacttcgtcatcatagtcggctatctctgttgccgccaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcacctccatggttatgcaacttcattacatttgattggtggcatctttactaccactgacatcttccgttacttctgatgagcaatttcgtcttcatgttggtcatttcatctccatgccgactgcgtcagttattgccaatagacaattttgactatgacacaaggacaagctatatgctcaggggctcatcaactcaagcgtgaggattatatctccaatttggact

SEQ ID NO: 93145 - DNA, 583 bp, Oryza sativa
gccattgccgtctctctactctagtttactcttagcttcgttgtggtgatgacgagagtttgcggggggcgctttctttgcagcgaggtacaccgtgcggtcgttcggaatcaggcgtaacgagaagatcgcgtgctacgtgacggtgagaggggagaaggcgatgcagctgctggagagcgggctcaaggtcaaggagtacgagctgctcaggaggaacttcagtgacaccggatgcttcggcttcggtatccaggagcacattgatcttggcatcaagtaaaggccccgttactctttctcggatgaaacatttcgcttttcgtatctgcctgtttatgttagtcctgtgcctagaagattttaaagcattcattgtctccattcccttttgtgacctaggatagcgcttccaatatttgcttgaaattgcctcattcaatagatttgttttggattgatgtttacaagtgatagaattttattagttgtaagttgctaaacctgaagatggtttttttaagtgttctcgggtcattgacaattcatttggtacctaggaattgttagcatactgctaatg

SEQ ID NO: 93146 - DNA, 594 bp, Oryza sativa
gcagccctccggcggtgattcgcggcaatgaagcggcggccgaggtgcgggcgggctcggtgagcgcgacggcggcgactgcgcggcgcggcggtggctatagtggcggcggcgcgtgggcggagacggcggtaggcgggggcgcaaggggcgagcggcgcggcgacgataggaagcacgggagggcgcggcgagggcgagaaacgagagaggaagacgcggggagcgatttataggtgcgggagggggcggacgtggccggggaggtggccgatttggccggcgacgtggggaggagagagagtgagagaggtggattcgaaatcgaatcccgccctctcgagcgcgcgcgcggccgggagatgcgggggaagaggcggcgacgtggggaggacgcgggagcggcgcggcgtgggcacgggaagagcggaggaggcagcggcgacatgggcggttggagcttcggctctagcggccggaggtgggagacgaccgacaggtggggcccacctgtcggcgtcccgagagagaggagggaggggcggctttggcccgcccaccaggaggggggaccgcgggagagggatgggccga

SEQ ID NO: 93147 - DNA, 1692 bp, Oryza sativa
  unsure (1)..(1692): unsure at all n locations
gcattgtgtttagagacacatcggtttagttaggactgtctcggtaaggtatgatcttctgtcttagccgatataaagacacaactagctcggatataaccatgactaccttatgtattaatcaactaaaggtgcatatgttttatattagatttacttgttatatatttgaacaaacgttgctacacaatgagtttcatgtgtttttgtttgcagaggtactcgcttgggcgaaggaaaagagactgagcgtaacgaattcatggatgatcaaagaagttgattgggaccaaaccaagaccttcttcaagtccacttccatcttaacatgtcacttttggtccatagaagacaagagataaagttctacatgttttgaattcggattcgggcctcctgacagcatcaacttcaaacggatctagccgctaatctagaaggaatttcggggcccatgagtacttgttggaaagcttatggagtctactttcatatggatttggtcccacgtcaaaattcctaccgagctgtcgagaatttgcaaaacaagccacgtatctcatccagtccgaatctgatttgggttttgggccttgtaattatgtcgtgggcttagcccaagcgggtgtgcgccctaggccaaccctaggacgtccctaatcacatttattcagtagccgtcatcgtttagagtcaggttttgcttagattattcagtcaagaacagttttgccgctagatcggtttgtggaaccccaaattcgagcgcttaatcattcatatgcaattgtgttgcaatctatcttggtattgattgtgttcttcgattcgcatgcaaggattagccttctcggcgaggtcaaccgggttttcgcatggttgataactangaggagacgtgtgctgtgattgcagggctcagtagcgtgtttgttcagaagctggatcgagttgtgtcgcactcccgcccaaatcattgttantcagancctttcgaaagatcnggacntgacatcccctcatcaatagatttgttatatccatcacattagcaagatctatcagcttatcgaggattagattatcatatccattctcgtgctgcatcggttagtttcgacctactagattgttgttgataatataaaccttgttaagctgacagattcatgctaatgttttatcggggtgctagccgataaattatctggacgttgcatcggcttacaaggattacatacaagttggcttatccaattgcagcaaaactttcactgtttatctaatcgtttggattttacgacatcggaccttcagccgatgtatgctttaaccttcggatctttacatgttctatcatatcattgttagccgattggtttctactggactatattattgttatattatattatcaacagtcgattgcctttatatgttatttatatcaagcgttagaatctacatcagaattatagccgatagctcaaaaccctatcccaatcggctagtatcggcatcggccggaattaatctatcggcttgttagctgatcggctatttgatccgttgtttacatatcttgtcagttgcagggtcaaactgactggcatgcccgcatctcatcaacctttggacctgtactaaagctaagcagatctctcaggccagtgtgtgtttttcgcatcaaca

SEQ ID NO: 93148 - DNA, 1477 bp, Oryza sativa
atgggtgcgactagcaaaaccatgcacccacagccaccattcagtcgcattttagttggataattacgaccatgaagcatggccagatgtctcgagcacgcagctcattctgatactaaaaggtctaaaactgtaattaccccatcaactgagctagtggtaattaagcatggctaagcatatagttctagctatgtcatcaaagtaacacaagctaggcgatttattacccaaggttgacaaagaacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcactttgatcttccgaactcttttcctcgcgaccgcggacttccgaaacgacggattctacatgctggcacacaaaacgaggaacaactctaataaaaaccaaggaaacagtacataaaaactaaacaaacatgtagagctcaattttagatgaattttgcaagttgaccggttcaattcggagttcgaatgaattagatatgaattttagaagttttgagccatttaaatgaatttctagaattattaacgaattatgacgcaattattatttatttttccaaaggaaaagagggttgctgacgtcatcaaaggggaggggcggcgccggcaagcgggccccaccggtcagtggcacaagggagccggtccaccgtggacgggaccaccgagccggtccaccgccggtccacgggaaccgacggcctggattggcctaagccgatcggacggccacggggcgcgcggctggggcacggtcacggctcaaagccggccagccgagtgatggcgcacggcagcgcggccaccggtgatgacggccgacgacgacgcggggagcggcagcgcatcggacggtgccggcgcacgctagggagcgccggcgcggcgcggtaaggtgaggcggcagccgactgcccggcacagccggcagcggcgcggagcgcggcggcggcgacccggtcggacggccaccggcgacggcggcgcgttgtgagcaggcacaggaggtggccgacgaagggcaggaaggggagagggaggggagtgctcaccgaccggcacgacggcaaacgggcggccgacggcaaggaacggtggcagcggggctcctcggaaagacggcggcgacggagctccggcgacgggcgtcgctcaggaaggggcggacgggctcggcctcggtctgaggaaaatcaaggaggggctaggaggtcagaactggtgcgaggtaaatggaaacgactgccgaccaccacaatacgaggaggagctcaccggcgacgagggaggtggagctcgggcggatttccggcgaagagggccagtggccaaggatctccccgtccctgcgga

SEQ ID NO: 93149 - DNA, 688 bp, Oryza sativa
tggagctgcaacaggacgtggagcttgattacggatgttgttgccagcattgttgttgaagaactgacgttgcggacgaacaacagacgaagaacctccctgtggcatgggctggggtcctaaagtaagacgcggcttctgattatttccctgttgtgtcttgaattgagcaatccgacgtttcttctgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgggaaagcgacctgaactccttcttcttgagagacactactcccgatggtatatgcgtcttccggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacagccggcctc

SEQ ID NO: 93150 - DNA, 610 bp, Oryza sativa
tgcagcccttcctgcaacttcttcttgtcctcctgaggttgaatcttcttgattgcattaatactcctttgagttacctcaatccccctctcatgaacaagaaatcccaaaaactgaccagccgatactccaaaagcacactttgtcggattcatcttcaggccatattttctagtcctctcaaaaaccttcctcaaatcggctatgtggttttctacctccttggacttaacgaccatgtcatcaatataaacttcaactaaccagccgatcagatcatagaatatgtagttcatggccctctgatatgtagctccagcactcttcaagccaaaagtcatcacaacccactcaaacaagccaattgcaccaggacacctgaaagctgtcttatgaatgtcttcttctgccataaagatctgattgtaacccgcattgccatccataaaacttaatatcttaagccctgaagcagcatcaaccaatttatcggcaaccggcattgggtacttgtcctttggggtagccttgtttagatcccgaaaatcagtgcacactctgaccttgccatttttcttgataactggaactatattagaaacccactcag

SEQ ID NO: 93151 - DNA, 750 bp, Oryza sativa
  unsure (1)..(750): unsure at all n locations
tataccgcaactgtgctttttgattccggtgctacacattcctttttgtctaaaagttntgcgagcaaacatggatggaagttgttagtttgggagcctttactagttaatacgcccccccccaaaaaaggggggnnccaanatnccaaaggtattttcgacatagtattgtccttctgttactatagaaatagaagaagttcttttcccatcctcgcttatcttgctagaatccaaagatctagatgttatcttagggatggactggttatctcgtcacagaggagttatagattgtgccaaccgtaaggtgactttaaccagtagcaattgggaaaccgtttctttctttgtgtcctcccctaaatatcatggtgtgaacttaaaccaagttgctctacaagagattcctatagtacaagactacccagacgtgtttcccgaggatttgccaggtatgccacctaagagagacatagagtttcggatagacttggtgtcacaccctgaaaattcaaaatatataaattgttgtttaaatggaatttttagaaataattttaaaagtcttgaaaagaaaatctagttttaattaatacaattccaatataaaatgggcccagataaaatttcactaaatactttgcttaattctataattcctagatttttctgggatttatttgagctaagaaagtatttgtaataaatggaattgcatttaagaaataatttaaataaaaaggtttt

SEQ ID NO: 93152 - DNA, 1340 bp, Oryza sativa
  unsure (1)..(1340): unsure at all n locations
taggtaaacgccccatagtaagaggggtagttatgaaccctgtgcaccacccccatgggggtggtgaagggaaagcccccattggtagaaaaaaacccacaacaccttggggttatcctgcgcttggaagaagagctaggaaaaggaaaaaatatagtgatagttttattcttcgtcgttgtaagtaaatacgtaactaggaatatggaaaattgcatttttggaatttgcaataatgggatgggcgaacgacgggaattaaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaaaaaggagtaatcagctgtgacacgaaaaaaaaagaattcttttgtagctcatcatttattggcaaaaatagaaaaggtcaatatgaaggaggagaaagaaacaatagtaacatggtcccgggcatctagcattctacccgcaatggttggccatacaatcacgattcataatggaaaggaacatatacctatttacataacaaatcttatgataggtcgcaaattgggggaattcgtaccaactcggcatttcacgagttatgaaagtgcaagaaaggatactaaatctcgtcgttaactgaattcagaatagaaagattcaaaataaaaaatacccagcaagatattgggtatttctagctttcctttcttcaaaaattgctatatgttagcagaaaagccttatccattaagagatggaacttcaagagcagctaggtctagagggaagttgtgagtattacgttcgtgtattactcccataccaagattagcacgattgatgatatcagcccaagtattaataacgcgaccttggctatcaactacacgatagttgaaattgaatccgtttagattgaaagccatagtactaatacctaaagcagtgaaccaaatccctactacaggccaagcagccaagaagaagtgtaaagaacgagaggtgttaaaactagcatattggaagattaatcggccaaaataaccatgagcggncacaatattataagtcttttgctgtgaccaaatctgtaaccctcattaacaaattcagtttcagtggtttcccctgatcaaactagaggttaccaagaaaccatgcatagcactgaatagggaggcgccaaatacaccagctacacctaacatgtgaaatggatgcataaggatgttatgctctgcctg

SEQ ID NO: 93153 - DNA, 617 bp, Oryza sativa
gcacaggaatggtctacggaatggacggttgagatctaatcctatccaaaacggatggccgagatcaacttgatctaccgcggtctacggctgacgtcgacgatgacatcggcgatgacgtcaccaccgggggcggctcggcacgcacgctcgccgcgaacgatggcgcggcggcgcaaacggagggcacctacgggtagcgggcgacgcggcgaactcaccgcaagcacggacggcggcggacggcaaccagacggcgacggcgacgaggttgaagtgacggcggcgttcggttcgactgacgacggcggtgctccggtgatcttcgacggaaacagaggggtggacgaggacggtgacgacttgtcgaacctgacggtggcctttccgagcgacgacgacgacctaagcgacggtatgatccttttgcttcaatgccctgaactcacgcttcttcaaagcaacaactcctacaggtatgtgtgtcttattgaatgcctcagagaactccgcccaagtgattggttgtccttctgctctgatcacccggaaatgatcccaccattctgatgcaggtccttgcaactgatgtgaagcgaaaacaactttctcctgat

SEQ ID NO: 93154 - DNA, 643 bp, Oryza sativa
cgtggtgggttcaaacgtctacaccaaggatacagtagatgatctcgatgacaagcaaggacagggtttcatgtcagctgatgatttggaagaaattgatataggtccaggtgatagacccaggccgacattcatcagcaataacttatctccagaattcagagccaagctgatagagcttttaaaggaatataaagattgcttcgcttgggagtattatgagatgccaggactcagccgatcgattgttgaacatcggcttcctattaaaccgggggttagaccataccagcagttgccgaggagatgcaaagccgatatgctcgatgctgtcaaggctaaggttacacgtttatatgatgctggttttatccgtccatgccgatatgctgagtgggtttctaatatagttccagttatcaagaaaaatggcaaggtcagagtgtgcactgattttcgggatctaaacaaggctaccccaaaggacaagtacccaatgccggttgccgataaattggttgatgctgcttcagggcttaagatattaagttttatggatggcaatgcgggttacaatcagatctttatggcagaagaagacattcataagacagctttcaggtgtcctggtgcagggctgcag

SEQ ID NO: 93155 - DNA, 602 bp, Oryza sativa
ccaggaaactatgaatctcggagactgtcttcggttgtttctagttggttactcattccacattactcggatcaacggcaactcctccggctgagatgacgtgtccaaggaactttacttcagacaaccaaaattcacatttgctaaacttggcatacagttgatgttctcgtagcttctctagtgcaaggcgaaggtgttcttcatgctcttctttggttcgggagtagataagaatgtcatcaataaaaaccaccacgaacttgtccaggtattccataaacaccttattcatcaagttcatgaagaaagcgggggcattggtaagtcaaaagacataacagtacattcaaacaacccatcttgagtggtaaaatccgtcttaggtatatcttcctctttaatcctcaactgccctgatcgaagatcgatcttggagaaaacggtggctcctttaagctgaacaaacaaatcatcaattctaggcagtgggtatttattcttgatagtcacatcatttagtgcacgataatccatacacatcctctcagtatgatctttcttttcacaaaaatgactggagctccccatggagacgaact

SEQ ID NO: 93156 - DNA, 785 bp, Oryza sativa
tgtgctcctgcctatgccaaatggtgcttactcacagcaatgggaatggcccaaacaacaacaacaacaacaacgacaacaatggagagaatcccacgcttgcccaagtcctggtccaacaggcacagctcatgaacatgatgatgcagcaattccagaaccagcagaaccaggggaacaaccatgcacctccccagaacaagttagcagaatttcttcgtgtgaggccgcccactttttctagcactaccaatccaggtgaggctagtgattggctgcacgccatagaaaagaaattggacctgcttcagtgcactaatcaagaaaaagtctccttcgcttcacatcagcttcatggccctgcctctgagtggtgggatcacttccgtctcaacaggaccactgcggaaccaatcacttggcttgagttcactgctgctttgcggaaaactcacataccgtcgggagtggtgtctcccaagaagaaggagttcaggacgctcactcagggatctcgctctgtcactgaatacttgcatgaatttaatcgtctagctcgctatgctccagaagatgtacgtacagatgaagagcgtcaagagaagttcttggaaggactgaatgatgagctctcttacccattaatgactggggattatcatgatttccagaagttggtggatatggccattcgccaggaggacaagtacaaccgaatggagcagaagaaacgcaggattgctcacttcaaagctcagcaggggaatagtcagaggccgtgtctt

SEQ ID NO: 93157 - DNA, 721 bp, Oryza sativa
ccctgacaggtgggccccacctgtcagagggagagaggagggagagcggcggctcggctcggcgggctgacttgggccgggcgcgcttgcaggccaaggagagagagagaggggttttgggccgactttcggcccaaagccaaaagagaacttttaaaacctttttcattttaaattattcatgaaatgcaattccatttattaaaaatacttccttggctcaaataaatcccagaaaaatctaggaactatagaatcaaatgaagtatttaataaaattttatctagcccacttttatattggattttattatttaaaattagatcttctctttctaagcttttaaaatcatttctaataattccatttaaacaacaatttataaatttaggattttcagggtgtgacaaacctaccgtcttaaacagaatctcgtcctcgagattcggaagagctggcgaaaagatgcggatgagctgactttaattcttcttctcgttcccaggtagcttcttcttccgagtgattactccattggaccttacagaaacggataactcgattcctggttcttctctcatcttctccaggatacggatcggttcctcaacatatgtcaaatccccttggatttcaatctgctcaagattagcttctacagtgtgtaccattaaacactttttcaactatgacacatggaacacattatgaacacctgcc

SEQ ID NO: 93158 - DNA, 1147 bp, Oryza sativa
cctgcagcaacactcacaagtacacaatccagtgggtgaaaaagaaaagttagtcaaataagcgatcgaaaatttgagcaggagttcaaatttgttcccaatttgattacccaaggatgttgtctgcaatacgtgcctatcaattcttcaaacttggcaagaagaaacttctctcgcttcacaaaggctgatctcaccgttgatatttctgacagggcttgtgtattcagtgggttttcagatgatgatctctttcttttcagtcctcggattggctgatgtccgtggatcatcgtgttcagcttctcccaatcaacgtcagagatcacgcagccggaggaaccgaaatctcgcgcgggtttcagccattggcgcaggcagtcgaggttctcgccggagagggagacgaggaatgacccgatcatggcgctctgggggtgatcggaagcctcgccggcggcggcgtaggggtttctcttcttctctctgctgctgttctgaagaatttcggtgaggtcgcattgcctggaccagaggtgttcgatcgcctcatgctccgagatcggcttgccggcggcggcggcggcggcgcggacggcggcgacaaggccgtccagtgaacggcattccacacggagcatggcgtcggtgtcaaagatgtctcccggtaggtcagcctcgtcgtcgggcggaggaggagcggcggcgtcgtaccagacggtgttgaggatgatgttggaggcggggtcgagagggccgtagcagtgcccggcggcgaggagggagcggatgaagcggccgcgccgccgcgtcgtcgtccaaccgtcgccggcggggagcacggcgagcgcccggatgtagaagccatggatggcgtcgaggaggcacatcttcagcgacagaatgtgctcgcatggggagaggtcgtagttcagcgctgcgccggcagcctcgtcgccgtcgtccgccgcgcgcgtcacacccgccaagcgtctggacagcttcgcctccatggtttcgcaatcgaacgtcaggtcggagatgtacccgagttgaggagagtcgatgcggcttgcgtctgcagcgatcgtgattagggcaacacggccatcttccccgatggtggttcgaagcgtcaccgtgccat

SEQ ID NO: 93159 - DNA, 1255 bp, Oryza sativa
ccaacccagtcatggtgaggaaggccaacggaaaatggagaatgtgtgtcgatttcacagacctcaacaaggcgtgccccaaggatcactttcctctccctcgaattgatcagttggtggattcaacagccggctgcgagctattaagcttcttgacgcttactctggctaccaccaaatcagcatggcaaaagaggacgaggagaagacagcgttcatcacgccgttcggggtattttgctacgttaagatgcctttcggactaataaccgccgggaacactttccagcgcacggtccagggcgcacttagcaaccagcttggcaacaatgtcgaggcttacgttgacgacatcgttgtcaagaccaagacaagtgactcattgattgacgacctgcgggaaacgttcgacaacctccgacgatatcgcctcatgctcaattcagagaagtgcacattcggagtaccgtcgggcaagctactcggattccttgtttctggtagaggaatagaggcaaatcccgagaagatcaaagcaatcgagaacatgaagtcgcccacaagactcaaggaggtacaaaagctaaccggatacatggcagcattaagcagattcgtcactaggatgggagaacgaggacagcctttcttcgctttgttgaagaaacaagacaaatttgtatggacacgggaagccgaagaggcatttattgcactcaagcgctacctatcaaacccacctgtactcgttgctccccaacctaatgaagaattattcctttatattgccgctacgccatattccgttagcactgtcattgtagtcgagagagagaaagtacatcgaccagtttattacgtcagcgaagctctccatgatgcaaagacaagatacccacagattcaaaaactgctctacgcagtcatcatgacatcaaggaagctacgccactactttcaagcccacagagtcacagttgtctcctccttcccctcagcgaagttgtgagaaacaaagacgttgtcggccgcatcgcgaaatgggtagtcgagctaagccaatttgatatccactttgtgtcgcgaacagccatcaaatctcaggtactcgccgacttcgtggccgattggaccatgccagataacaagtcagacaaccaaggcgacaatgagacatggacaatagcgtttgatggcgcactcaacagccaaggagcaggggcaggatttatcttgacatctccctccggagatc

SEQ ID NO: 93160 - DNA, 3072 bp, Oryza sativa
cgccgccggtcggacattagtcggcaaggcctttcgacaagggtttttctggccaaccgcccttaaagatgcatgcgacatggtccagcgatgtgaagcctgtcaattccacagcaagcacacaaagctacctgcacaagcgctccagacaatccctctgacttggccgttctcgtgctgggggctagatatacttgggccattcccacgaggacagggcggctatagattcctatttgtggcgatcgacaaattcaccaaatggatcgaagcactacccactggggaaatcaaggccgacaacgccattaagttcatcagagggatatactgcagatacggactaccgcaccacatcataaccgacaacggctctcaattcatcagcgccgacttccaggattactgcatcggtttgggagtcaaaatatgttttgcctcggtctctcaccctcaaagcaatggacaagtcgaaagggtaaacggcatagtactacaagggataaaaacccgcgtctacgacagactcatgtcacatgacaaaaaatgggttgaagaactcccatcagtactattggccgtacgcaccacaccgacaacatccaacaaggaaacacccttcttcctcgtgtacgggtctgaagccatgctctctggcgagttacgacatcaaagtacacgagtacagaagcattccgacgaggaacagcgagacattgatgtaaaccttctcgaggagcatcgtgagcgagttgctgttcgagcagctagctatcaacaagccctccgctgttatcacgagaagcgtatccgagcacgcatactttcgatcggcgactatgtcctctgacgagttcaaacccaagcagggcaaaacaaactctcaccaaaatgggaaggaccctacacgatcacacaagtcttgcggccaggcgcattcaaaatcgcagacggcgacggtcgcgaattagcaaattcgtggaacattgaccaactacgtaaattctatgtatgagtcaataacaccgtacctgtaagcacccttacagtatcaataaagcctatttctaggtttcataccacgaccaaagtgttttcactcgacgatcccttactctgataacacctaacgttgaaacatatccttatgaccctttacgccgtctcgacaaggcctccgaggaacctaagggatcttcggctggggatgcccagaaccgataaggccttgtcagatccttcagagacgaaagaccatgtaagatctggtcgtgtaagagttctcgccgtgcgtattaaccaagccgtgtaatcggaaaccgagctttccaacttcacggctgggggctaggatcagagcttattcaacctaggcagatcaagtgtccaagagccttatcatccaagaaaatttctccgacgacaaggctgggggctagggagagtgtacgactcaaacagccgaggtcgttaactaagaacacactctaacacataacatccagagtaagatgcatttgtttaaggaatatttctttattcacataataattcttacttgttttttacatagatctcccactacattacactttttcctaagacatctatagcaggccacgagtattaccaagagggccaatgccagtccatagactggaataccttctcggctaacggcgtcatcgacctcgcaaggtggtctatctccgccggagtcctccgagaacgagcaaacccttcatggaggaattcgagatccaggcgcgggcggtgatctcgcaggcaagctagcacatgtcctccggcatatcgactcgctcgacgacactcttgtttcaaggcctcatcgatacgcctgccgatgccatcgagttgggcacaggccccgttgagccacgagatgtacccggtcgccgattcctcaggagtgttgcggactactcgaagctccccgcatacccgggccattgaggtacagcaactctttaaatatgacgcaaaccacacctcgcgtcctcggagcgtttccatggcttgctctttcttcacggctagcatggttctcgagagttccgccacttcaaattttgtcttctaatattggatacgacgatcttgggttgcaagggcatcctcgagatctgctaaacataacgaccactaagacaacctggaaaccactaacccaacacgggttaaaaaggctactcacttgaggtggttgtccccatctcgacctccacatcaagagtttggtcctcgacgtcatgtgagacgcgtggttcaaactcaggaaccggaattatcgctagtgactcgggctacccgcgctggtgaacatcctcgtcaccagcatctctacaatcgacaagaaaaacttccgaaatcaacactgaacaaggatggtaatcatacgcccgaaagcaaccagagttcaagatttgcaaattataaaaaatacaagaagtcctactcttcaaaaagggggaggacagactcccccaggtcactgacttcttccatcacctccttacgcgtgtcgcttgccgccccctgatccaagatatcacgcagatcgagttcagggcgcgacaaccttacacacgcgaggatgtgacacgccccggtgtagataccgttggacgtctcctccgcgatcctggccgaatgcttggaggggatttcccctatcaccgtcgccagctccgcaagagaagaagtcaacaagaactcgtcggggttcaccgggatcgtggacttgacgccgcactcctcggcgagctggtgaaggccggtgtaggtgacccgcagcgaaccacggatctcagagagattgtctccaagttccgacatgcggtcctcgagccctttgcgttggcgctcgttcccggccaccagctccctcatcttcgtgaggtcctcacaggcctcagccagttcccgcaccaaccgctcggcacgcgcgtttgccaccgccgtctccaccctcgcctctgagatctcgcggccggtgccgcgagcaccagcttcgagaaggcgccccatttcgacttggagctcttcctaggt

SEQ ID NO: 93161 - DNA, 884 bp, Oryza sativa
acaaaccccaacttctgccgataatatgatatactaaaatcatattttttttaaatcacgtagattctatcacgaaattctgtaggtactacgccatccaaaccggagtaaaagttccttggctaccaatttcaagcgtgtagcaccattacgcatagtatcctgttgttcctgtgaaagcatcatacaccaagagtggagctaattggaacacatgaatataacctgcatgatgttaggcatttttttatggttaaaaaccatatcattacggcaacgccaaattgaccaacatagagcactagctccaaataaaatcatttttttgtgtgtctaggcactccccttagccagttaccaaaaatatcttttgcattgtggggagggggaatattgaaggcaaagaagacacatcgccaagcaaaacgtgcaacatgacagtcaaagaaaagatgttggatggtctcttgtgtattacaaaaacaacattgcttgtttcccctccattttctctttatgaggttatcttttgttaagattactttttttgtgaagcaaccacataaatactttgatttttagtagtacctttacctcccataagatcctcttgtggattcttacattggaattgatgatcgcattatacatggatttgaccgaaaaatggccatttttatgtagcgaccaaataaagcaatcattttcatttgacagggttatgttagctagtcgagaaatcaaatcattccactcaaactaaactttggtcctacaattgatcgttggaataaaacattcaacggtgttgtgctcataacctctgccaaagtagaattgtctctttcgaaccacattgtacagagaaggatattgatatttga

SEQ ID NO: 93162 - DNA, 713 bp, Oryza sativa
aagctgctgctaaagcagcagcagcaacagctgatactggaggaccgaccatgtaagctttctcattttactatttcataatcccttctgtggcagtggcactgagtattcctctttgtttattttatggaagtttcacaagatcattgcaaaggaaattccttctaatgttgtctatgaggatgagaaagtgctggcatttagagatattaatccacaagcccctgtgcatgttctagtcatcccaaagataagagatgggttgactggactagacaaggtatggaatgttgttcactagtgtttgcgagaggaattctcaatctctaaaactgtgtagcatgcagtatccatgtacttcgttatgtgcttatcttagtacaagccgatgccctttttaactgcctatggaagcaaaattgttggtcatgtactcatgcttctttgagcaagccttccatcagacattatcacctcatgttggaagaacatatttttaggctgaaccaaggcatgtcgaaattctgggctatcttctatacgccgcgaaaatagtggctgagaaggaaggtatagctgaagggtaccgtgtcgtcataaacaatggacctaaaggatgtaagcactcccatgccacatctcttttctacttactggggtttgcacatgttttcccttttcagtatacatgctacacatcatccttcaacgta

SEQ ID NO: 93163 - DNA, 1654 bp, Oryza sativa
gtcttcaggaccctgctccacttcatctacaccgacactttgccggagcaagatgacgacgacgtcgaggctgaaacaatggcgtatggtcttctcgaagccgcggatcggtacggcgtggagaggctgatgctgatctgcgcggagaaggtgcacgctggcattagcgtggacaccgccgcgatggcgttggctctggcggagcgccatggatgtaccaagctcaaggctaggtgcatcgagttcatcttggcttctcaggagaatttccacgcagtcgctgcaacggagggttacaagcttctcatggatagctgcccctctgctctgaatgaccttctagtggctgtttttctgaggtacaaattaactgttctgtaaccggaacatgtacgggatagaacaacgttcctagatagagttgagtattgcgagctcgagatttgaagaagaaaatagtgaattttcccaattacaatactccatcagttttaatttatttattgttctagcatttaactttttttaaaaaaaatatttatctttctcgcatttcaaatcatttttactttggcccgttctaactttataaagatacatatttttttctcgttttccgttggcacgcttttcaaaccgttaaacggtgtattttatgcgaaaaatttctatatatgtgacctttcctcatgttattgattagggtcgcagactcgtaatgcgtactccctttcatattgtttattagggtcgcagactcgcaatgcatactccgtttcatattgaaaaaacattttgactttttgtaagtcatactgctatttatgtctcattagttttttctataaatttagtcaaactaaaagaagttgacttttagaaaaaacacgatataaaaaggagggagatagggaatagatcagacaaagcaaacaattgtaggataatttctcaggatatgaaaatcactaggatgcttgatgtagtgagagcatgtctaatgtataatttctcaagagtgtaaaggtgggatccacttgtgtcatagcaactatagatgaaaagtccatcaacgtataaaatccaccattgatcatatagttcacaacatataagatagcttctttgttggtttagcggtaactggtctggtgttaggtttctcttaggttttatataggcactatcgggcttggtgtggtggtggtggtttttttctttcctggttaatgttttacagggtgctagccttgcaatttttgaacctaagaaatcaaccatatgccagcaatttttgacagaaaagtgaagtagagacttctagctaaatattgtggctaagtggcttactcaaagtactttaagttggcaagtcaaatattaaagtaatggagtatatgttagtcaaacttacttaactgaagtgctactacgaattaaacacgtctatatcttactctagtggataatttattttaatggttactagaaaggcatgcccaaagccatcaatctgttataaaaggagtataatttgttataaaaagagtatgttataggtagcttctttgttagtctagtgatgagttttgtgttagttttcttctaggttttgtatagacgctgctcgggtggttatttttcttttcttttc

SEQ ID NO: 93164 - DNA, 2635 bp, Oryza sativa
ccctgccctctcggctctccctcttcttcctctctgctctccctcgtcctcgcagcggagcaacggcggcagcgggcagagcagaggcacaagcggagcggcgacgacctcgccaaggacgccacgcgtacctccgacgcgagaggagcggtgacgcatgccggccggcgggagggagggagaggagcggcaggggggagctgcacgcagctgccggcgggagagcatcggcggcgcacaccggccgacgggtgggagggagattagcggctgcgcgcgcagcgctgccggagagggcgtccgacgggagcgctgcgagggaggaggcaatgcgcgccggccgacgagagggagggacaggagcaacggtgcgagggggtcggcagccggcgagtgggcagaagaggagcggcagccccccggcctctctgcccttgtcggcattcccctcacagcgagcggcggccgtcgaccgtctccgcccccctcgtcggctgtcggctttttccctctccgtgcgcgcttgccggccgccgaggaaggatggccgggagggagagagagagaaggagacgcggtccggcggtccatcgtctcccgtcgtccatggcatggatagaggagggtgggacccactaacatgtagatcgtactatttttccttttgtcttactgacatgtgggcctcgcagtttttgtttttatttttttatatattttgcttccgttgccacatcatctacaccaaggacgaaggcagagttaaactagccatgtatgtgttacatcagccaaaaccatcatcaaaaccgctaaaggacccgttgtatctggtttttcggttgaaggacgaactcaaatacattcacaagttaagggaccttaagtgaacttatttcaagtaccttccacagtcagtctcaagtctgcgttggtagaagggcgcgttgaaacggaaagatctctcaaaatctctggatttaacagagcgctgcctgggaaaacgcaagcacgattcgcgaaacactctcgagagcggtacaacggttcgcgttcacccaagccgtgcagacatctgtatataacgctccctttgctcaggctcgttcgcctccgctagcttgcctgggatccgcatcaatggcgccctcctcaaacctcacccaggccgcgcgcgccgtccacaagttcaacgtcaatggctactcggccacgaaagccatggccaaacacgagcatgtctcttccaagcgtctcaccgtggccgggtatgcgtgggagatccactacaccacaggccacgatgcgcactggcactactgggtcgccttcaagctcgtcttcctcggcatcggcgagcaggcgcagcgcgccggcggcgacgacgacgacaacgacgctggcgccatcaaggcgtagctcagctgctgcctggtgcacccgtcgaccacgcgctcccatgcttccgaggagaagagcgacagtcgcacgcgttcgggtccgcgaacgagagctcgccgtgggttctgctcgtgaagcggagggagctggaggcgtcgggtttcatcaccggcgactccttcgccgtgcgctgcaccatcacggtgctcagcaagaacaccatcaactcggccgagccgtcccccgaccttcacctgcagctcggtgagctgctgcggagcgggagattcgccgacgtcgagttcatcgtttccggcgtgtccatcgcggcgcacaggtgcgtgctcgccgcgaggtcgccgtccctcgccgccgccgtcctgaaaggtggcacgaggaagaaggatgggtcggtgcgcgttgaggtcaaggacgacatgagagccggcgtcttcagggcgctgctccatttcatctacaccgacacgttgatggagctcgactggagagaggatggttctgatcccctgctgccgaggacgatggtgatgagcttgaatgaagccgcgggtcggtatgggctggagaggctcaagcagatttgcgagaatatgcttggatttgacgatgcttgtagtgcagattgtgctgtcatgtaacgcatgctctgcatgctgccaaccgttgagaactcttttcttatcgttgtttgctacttcgtcacgagtcacgacgagcaacgaaccttagatctgtgactcgcgagttgtgaacttgtgatgggtgtgctaatgcagtgcacaatctgtgcttttatttacatccgacatgtactcgtgtatggagtactggatttgagataatgaaaatggattacatctccagcttctatcataagacacacagtcataagtttaataataaaaaagggtaaagataaaattaaaattaaaatgagaaataaggcgatgagacaaatctccaacttctctttattatggactagcgttaaaccacataatgttctttagctagcaattctaatggaactacgccacctatagtggaataagagactattggctaccgatttcaaaagtgtagcactgtcgacgggtgatacccgtagaccggatatagagggtattggggtacgctggtacaaagatctacgtagtacgacatcgagcaatcaaaagacaagaattatactggtttaggccccttgacaggt

SEQ ID NO: 93165 - DNA, 738 bp, Oryza sativa
cctcttcatcaatttggtctccaggttctgaggtagtctttgtccagagcaattggcctagtaatatcagactgttgtctctgccctgcactttccgaaaagagcaacttgcagcagttagtaacttcatacatttgcgttacctagacctcagatggtcacgccttgaagaattacctgaagccgtatgcaagctttacctactacaagttttgaacataaagcactgtccgtgccttcttcatttacctccaaggatagccaacttattaaactttgagcatctgattgctgatgaaggaaaacatttactcacaggagttccatgtgttggcaatatgacttccttgcttctgttggataagttctgtgttaggaaaaccaggggctttgacattggacaactgaaaaggttgaggaacctaagaggtttgttgaaagttcagaatctcgagaatgttgatggcaatgaagaagcagcaaaggctagattgagtgacaaaaggcacctaactgagctgtggctgtcatggagtgccggttcttgtgtacaagagccttcagaacaataccacgtcctggaaggtcttgcaccacattcaaatgtaagttgtctccatattacaggctataggggcagtactaccccatcatggcttgctagtaatctcagccttagctcactagaatatctttatctaaattatggttctgaattggaaattcttcctccactgg

SEQ ID NO: 93166 - DNA, 1374 bp, Oryza sativa
aacatctttttagatttttccagtgtactgctactgcatccctctagcgtatctaactgattggagcatttactgaaacttttcaaatgaatacaatatccattgcttcgctgtcagcctatcactctaataagtaatgcatatttgttttcctgcttggcagtccttaaagatctaaaatatgctgatactcatgagtgggtgaaggttgagggtgattcagcaaccataggggtcacagaccatgctcaggtaatcagtttgatacatttgcaagctgcaccagcattttatcagccttcaatatgctatattactgggtctcttgctgagttgataacttcaacgtgttattgacatgcattacagcatttttcctcaaaatagaattttctgtgatagtgtgatggcttaatatgtcctgtttcaattccaggaccatttgggtgatgttgtgtatgttgagcttccagaagttggttccacagtatcacaaggaacgaactttggtgcggttgaaagtgtgaaagcaaccagtgatatcaatgcaccagtatctggagagattattcaagtaaatgatgaactaagtgaaaaaccaggatttgtgagtcgcaattgctacccttgctagactaatttttgagtaatcactgctatgttcagttgacaatttgcttctgcaattttacacagataaatggaagtccatatgagaagggatggatcatcaaggttaagataagtgatccaagtgagttaaactcgctgatggatgatgagaagtacaagaagttttgtgaggaagaagatggcaaacactgatcaatcccctaactgctggatttcaagaaactatgcagcaactcaccatcatgacaatgagccatctcgcctctcctaccacattatattattctggatagaggagtcccaaggaatgtaataagctgaaacatttttcttgcaaatcagacatgaaaattttgtagtgtcctgatcattccgtttgtgctccatttgaaattcagctcttgatttgcttatcatctgaatacaggtggaggattgggtttgtttaaactttgattaagtgacagtgacttgattgtattgagattgcagctcagggattgtgggtttgtttatcttctgaattcaattctggagatagctgcatgaaacgtgatccacccgttttccagctatattattccagtttgaataacaaaatcagatttataaaacattaaaacaagcatcattagacaagtcgataactctgttctttcaattcaatcgatcgttttgccttgagaaagtcaaaactacattacagcacgaagaatctagcttattaccctcgatccgggc

SEQ ID NO: 93167 - DNA, 549 bp, Oryza sativa
tggagctatacaatattattaatcaaggccgtgaacccacacgagcctgccttaacccaaggcctctgatgattcagaccgaactggcaacccgaccctgggtcccagctcgtcccaatccaacccaggccatccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacgtacggccggaacccccgggacaggtaggcaggactgagcccctagcagcaggacaccggccctgtgccatgacatctcgactaccgggccgcagctcgtgtagccttcatttgtcctagacatgtccatcgacccccgacttcgtccatctccatccg

SEQ ID NO: 93168 - DNA, 1474 bp, Oryza sativa
tgctgaatgtataaaaacaaataaacaaaaatggagaaaagagatagaattagaatcagatgaaaggatattatctagtagagtacgagttttagaaaacagaataaataaattagaagtagaactagagaacataaaaattaactatgatattaaggcattaccagaaaataaggatatacaaaataccgaatttaaagagcaagtgatgacattaaaagacagtaatactgctaaaataattcaactaaaagatgccataactaattttggaaataaatatatagtaaaattgcctttcaaagaaattttgggagtaagaatactggtaaaggtaaaattatcacccaaggtatcatataaaattttagcactcgtagacactgggtgtacaaaaaatattattcatgataagtacttcataaaatgtccagagatagttcatacaattgatgataataatgcagaagtctctacagacatgtccggaataaagaaaattcataatcagttagcttataatgttgaagtatacattaatggaactaaatatataatagatgagattacaataagaaacttatccatgataagtgatgccatgataattggcctaaggtttttacaacaatcggtacaaaccacagtaatacatgagcaaggaattacttttatcccatgtcaaaacaatgtgccatatatctcagaggtacgaaagcgtggtggaaccagaatcaaacccgacaaccttgaagcactcagccttgagtctgaagaatatatatatatatatatatatatatatatatatatatatataggacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatatatatatatatatatatatcacacacaacacaatggagagatatcctttagaatctcacacacaagtggaaaaaatgaattaagaaggtttcttggaggctgggttgaattaaggctcctactgtcctccacatactacattatgcatgaccgacacacacacatacatactccatccatctacttttgatagtcatatttctaaatctgaaaaa

SEQ ID NO: 93169 - DNA, 1082 bp, Oryza sativa
tcccccgtttgctgctgccaacaaacaaatggaataacataaaaacggagtattcgaattaacttgcaacagcaaatgcatttatgtcggattcctctctaattgttgtgtaggcatatcagatgacagcctgacagctgttttatttaagcataggatgccaaaattgctactgtgaaattattatcaacactttgctgattaataaagttaagtttgacaaatgaaggttcttggagcttacagcccaatccctctgttgataaacatataaaagatttgataaatatagttcaatgaaaggatgtggtgcagaatagttagattctgaagtaccaagatcatctcctggatcatagtcgtcatttgctggcaatttagcaatctgtgtcacctcatctttagacagatcaatgccagaataaactctagcattgcgagaaagggaatgctgtagttactctcatgacttatgccatggctcatcttctctccactctcaacagaatcagctttagttaacccacaaatctttgagccactgtcagctctacccactaaccgagatgccacatcttggctatcacctgaggttctttctcggccaacatcttcagggacaaactcatccatcattccaggtccagggcttgactcaccagtattgcccatattttcagtaagctcgggagctggttccacatctccaacaacactatcagttttatgctcagaaacatcaactccatgaatttcggcttcatgactagcacccataccaacactccctccactaactcccaggcttagttggtccctagcaaaagcaggagcagtttctgcattgaggacttcctcccctccattcatactactacctcctatctcccttgcattactttcagcagcaggctgtacaaaactgctttgcggtgcttggttgctatagttaagatccaatgcctcactcattccaccactcctgacagcactagacggcttgtgaacgtcatcaacatcacatggatggtattcaacactctctgttgaattttcctctgcactgtggactgtgtccatcg

SEQ ID NO: 93170 - DNA, 1655 bp, Oryza sativa
  unsure (1)..(1655): unsure at all n locations
gaaaatttcctcagagaatagtacgcgctaatggttgagaaaattgggggtaaatttttttcaaacaagctgatagttcaacagttgcccgaattgtcaaaagtgaggtattatccagaaaagcatcccatataggttgcactatagttcagatgcaaccaaagcgccaagtatagaacggagctaacgaacaaaggttgtaaccctttaataaaggagatgacccgagacatgccgttacccataatcaatttatttagggtcagggggccggaagcaagtaattgcgtacttaaggataggccctaatcaaaatttgtaggggaaatatatgnntgtgtgcttgcacacacaaacttccaacttttccatcacattgttccaatttcaatcaaacttccaattgtagcgttaactaaacacacccgtacacaaagcatagcaacagattaaattcctaaaagattggacaggacacgagcaactgcagtcatacacaaaccacaacaaatgggcaaacagatcctcagcttcggatgatgatttgtattaaaagcagacgattttcagcacggtaaacataaattcagaggttcaaattttgctcatatctccctggctcgcacttgaaaagaattcttatctcctagcaagccctagaaccaagcataaattaaaacaaaaggtacagaatgtcgagcacacgttctggatataagaatgctatatctagtgcgatttgacatagtcctgcactatgttaaggccctcagactcttcaccatagtcctgggaaatgaaaatgaacagccaaacattacaaattgccatcttcaaaggaataattccaagtgttaaggtgagggatcgattagttaccttgacaacgacgcaggagcagcccacaaccttccttgccttgccctcagagtcaatcttgcaaagctgcaaatgacaatatgtattgttaaaaccaggacaagaaggcttttcatataactgtnaattaaaagaaatacacagaacaaaggaaggtggacaatgataaatcataaatatacgtgccacagaaatgttcaaagtttccccacaaataaaacgaatatactacctccatccctaaatatatgacggtggttagttgaaaaatgaactaaccaacgtcatatagaaaagaacagagtataagaatatcaatattaacatatagtaggcacattctcctttaaacactggtgaaagaatgtctactcatcaattgaacctacatcctatatggccctcagtgacagagacaagagacaagagggccagtggcctggccccctccaacaattttttttcacataatcatttaagtagttaggtaattaagctaagtgacagtgtattcggccccctccaagagtcttaggcccctcccatgtttaaatcctgactccgccactgatgggtgatggccatataggcaccagttaacacaaacaaaggacaacaattaacaaggtatagctattaggacataggcagcagactaacacatatcaagaaaaacaattgacaaagtacttagaagaatcctgtaactcacccctggggtacgagctgaattcgccctaagtagatggaaaagaaaatcaaannnnngggcgcat

SEQ ID NO: 93171 - DNA, 664 bp, Oryza sativa
ccgctctggccctgatgaagaactctgttttttacgatcgaagtaagcacattcaaacaaaatttcatttcattcgtgaagccggggagaatggggaaatcacaccgagttacatcggcatagaagggcaacttgcagatattctgacgaagccgctttctcgaatcaagtttcaggagctgcgggaacaaattggtatgtttcctgtataatcggcacatcaagcttagggagagttttgttagcagtaatcttgtgtgccacggttagttagttgattagttatctgcatgtttccgtttttttctgaataaacgcatgagctcacgtgttgtgtgatagccatcgtgtggagtctgttatgagggtatccgagtttagctcgttgcccgcgtcttgtgctgggagctccgatcacgctctgtggttgtggggatggacgcacctagagcatggcgtgagaagtggtcttggcggctagttgtttcccctggattcgctcctttatatatgtaagtaaacagaaaaaccactgagaaaagcgctgcccaaaatttgttttgttcctctggtttgcgaaattgcaggctttaggcacaggacgcatgcgttgtgtcgtctggtttcctgctagccatcgcttgggaaaatccttacataatta

SEQ ID NO: 93172 - DNA, 1086 bp, Oryza sativa
  unsure (1)..(1086): unsure at all n locations
caagattccagcccggtctgaaggagtgtcaccttgtggccatgaagagaattcttagatatttagtgcacactcctaaccttggtctttggtatcctaagggagctaggtttgatctcattggctatgccgatgcggattatgccgggtgcaaagtggataggaaaaacacatcgggtacttgccaattcttgggtaggtcccttgtttcttggtcttccaagaagcaaaactccgtcgccctatccaccgccgaagcggaatatgtttcggcggggagttgttgtgctcaacttctttggatgaagcaaaccttgagagattatggcctcaatgtatccaaaatcccactcctatgtgacaatgagagcgccattaagatagccaacaaccccgtccaacactcccgaaccaaacatatagatattcgccatcatttcttgagagatcattccacaagaggcgacatagacattcaacatgtgagaaccaacaaacaattggaggatatctttaccaagcctctagatgaagctaggttttgtgagttgaggagtgaactaaatattttggattctcggaatgtggattgatctattgtatgcatgtttgcttggtataataggttttgcatagcaccttgtgacaaaatggtcattcaactcatggatgggcactggtcacttttgtggagaacttgaatctatgtgtatggggatctcatttttcaatgaattttggtcctagcacaacttgaaatagattcacacattccctatctcgagggtgaattatcttgtctcatggtaattccctctcttttgatccctcggatcatccatttgacttgtggctattgttttgtgtgattgattgtgtgctagtcacaagttcaattggagcatatagtgctcgaccatccctccattcctaaatcctatccaaatctttgcgaaatgtgtttttgtcaaaaatttcccggagctagtcccctgcaaaattcctttaaaaagtttggaaaactgtttcttcaaaattccttgcaaaatgngttttcagaaattttcgctttctgaaaatttttga

SEQ ID NO: 93173 - DNA, 1650 bp, Oryza sativa
  unsure (1)..(1650): unsure at all n locations
gaccatcaatttttaacggtattggggtnacaatggtggggtggtaattaaatggtnccaatgatatatattgatagatnntgtttcagancagtatagcgtttccagtgtatgctctccacatagattctggtgtatgtgcatgctgaagctcattcctctcttattacaagttcggctggtgcatcatcaccacttgcacaaacaaatgcagctagcatagattggttaggtggtgagccaatatccaaagtggaatcatcatcccagattgctccacatgctcctcggccttctcttagtactaatgctgctggagctgccgtggcaatagcagattcacacttcacaggggttcatttcaacgtggaaattcatcagaaattcgtttgcagtgatgatgagtaatactctccggtctcgacacaagcaaccagcacttgcattagatggatggggctctggaggtggtgtgcaactgggcgtcttcgaagatatccacatcctctagcttctcaggcttcaggcaagccgggatgtaggaggtgtagacggcatccatgttcggcgtgtctttcacgttgtgctgaaccacctcgagaggggtcttggcgaacgccgggtagaaccgcatatggcaaatgtaggcgaagatgaagcttattgggatgaggggcacaagaacaggggagtacaagaacttcttcagcaggatgacaccaaccatggtgatctggtaaatcagtagagctgcaatgatccttgtgtgcatatgtggccacattcgcccgttgctctcgtagctgggaacataaactcggagaaccttgcgtaaaagaaaggttaccccgtcacaaagtttatctagcaatggctatcatcagagactcaagagtattaaaaaggattgaaagcggatttcagaagttcatgctgaagtaggtttcataacctacattcgacaatgggaaactactaattaatttgtcctttccaattcagtttcaatattagtgtgttaaaacttcggttaaagcaagtaactcttggctcacctgatttttcactataatccatccaagagcaaagtaagcaacaccaaatggaataatcagaggtgcaatgacagagtagcacagcactattgtaactatgagcatgtcattcggaaccctggtgttatatcctaggtcgcctggagcccaagctgctctcacttcatcctcggtcttgcataggtacttcctcttcaggtggaaaatgataagagggaccaagcgagagagctcaagcccataaccaacaaagaatctggcaacaaaaacaaatgaaaagttactttctgaattgtacagacgtgtaggatggaaatagctgacaataccaggtacataatgtgagaagaaagcattgcttacttcagtgcaacaaatgtaaggaagaaagttgcacttcctggaaagctgctggcaagcatgttcacaatcccaggagggttattgattatggttgtcaaagcactgaacaatgtggaactaatagtaaccccaaagaagacattgaacacaatgaagtagaagtactttccttgttgttgcctaactgtatgaccctgtgaagggaatcccctccagcttgagaggaacatta

SEQ ID NO: 93174 - DNA, 699 bp, Oryza sativa
aagaaacttacctgtgcttatcttgcctacagaaacaagagattggatctgttcaactctttgggatccatgtatgcagcagtccttttcattggaattcaaaacggccagactgtccaaccaattgtagacgttgagcgaacagtgttctaccgagaaaaggccgctggaatgtactccgctctaccatatgcatttgcgcaggtaaatggtcatagctgcatatttaaacaaaaaacaattgcagtgtgcttcctttattatacggaaaaaaatctaacaatttatcctttcaacaggttcttattgagataccacacatcttcctccagactgtcgtgtatggtctgatcgtctacagcctgattggctttgactggacagttgaaaaattcttctggtacatgttcttcatgttcttcaccttcatgtacttcacattctatgggatgatggcagtcgccatgacaccaaacagcgacattgctgccatagtctctactgcattctattgcatatggaatatctttgccggcttcctaatcccccgaccagtaagtatctgatattcattcattgtccataccaacctttaagtcttttttctatactgttgatgctgaaatatacatggctggtttgcagaggataccaatatggtggaggtggtattcctgggcatgcccagtggcatggaca

SEQ ID NO: 93175 - DNA, 696 bp, Oryza sativa
ccctgttgcgcaacaacccttatcccaatccaaaagcttgatcagcatgtcatcagatgatgacagcacaaaaggctgggttgggtgaacagccacacacctgatgtaatccgtatgagcttcaaaaaccttgaccttatccatcgtattgtaattgtacacacgtatgaacatatcgtcggcaccagcaactacccattgtttccgtgtgataaatttagatgaccgaactgaaatggggatgattatattagcaagatggtatatcaaacagaagtaagcgatgaggtgggaaagcatacctggtaactctgtgacttcaaatgatttcaccatcgtctgaggatagatgaatatattataatcagtttaactttaagagtaactatgctgaaaatatgtatgtttctttttccgtccatcgatttctagattttacttttatgttttacctcctcctgttttgctctaaatagtttgcaaacctattaagaagtcccaattatgtagctaacactcacacatctgaaacaaccatctagaagttcattgactccttgttacttctattttgaccatattcctttctacaatgcatcgaagacttcctcgataggttttaagaattcatcattcatcgctatgtttgacccccccccccctctttttctttgttttcgggtaccgagctcgaat

SEQ ID NO: 93176 - DNA, 3857 bp, Oryza sativa
gaagcgagtccagttagggcagcgttggtccaccaaggttgatagtaagatgaaggtgcaaaaaagtaaggcgaacaaacacactgcaaggtgttttgataagcagaaaaagacatacgagttcacagagaggggtggtataacgcgtggtggtgttagattcggcgcaagagccttcaaagttgaaggtgaggggaacttatgttcttgccaaaggccattgctctaccatatgccttgctcacatcttatacacgtttatctgattcatgcaattgatgaggaatctcccaacagaatgccgtatcagttctcttcaatagccgttgtgaacacatgggcaagtcgctttgagccatacctcgaccccacatagtggccaccgtacgatggtgaagaatttgttgctgacccaaatttgaagattaaaacaagagggaagaggagatcgaaacgattcaagaacgaaatggactcgggtctgggtggttctggaaggaaaccatcttcatgcgttcaacttgatgctgcgccggtgcaaaatagatgctcgttgtgtcaccaggagggtcacaagaaaactaagtgtcctaagcgtccaaaaaagaagaagtccaaaaaaaaatataagtgtcagggaggtaaatattttgttttcctactcatgttctcgcattcattttcttttaatatatgtcacattggtaactaacggtgaatttattactttttcatgtaggatggccgaggagggacaaccgccgacttacccagccttggaggcgtactacgaggcccgtcatcgcggggctgcgatcgaggcggggagggtatgaatcggcattgattcacttgtgcataagtatcggtagcgtgtatttgacattatattaactaattgatttacaattgctaatgtaggtacttcaaccgctccgagtcagagctcatgcccctcccagtgttcgacgataggtacatcccgtacctaaaggctgccgggttactcggggtggccttggtcgtgagcagaggaatgccagtgttcaacgctcctgcgttgacagcacttgtggacagatggaggcctgagacacacagcttccacctccccagtggtgagatgaccatcactctacaggatgtggctatgatcttggccctcccattacgggggcatgccgtgacgggcaggacagagactcctggatggcatgcacaagtgcagcagctgtttggcattccactgaatattgagcaggggcaaggggggaagaagaagcagaatggaatacccctgtcttggctgagtcagaacttctcacatcttgacgacgatgctgagccatggcgtgttgagtgttatgcccgtgcatacatcttgcacttgttgggaggggttctgtttcctgatgctgggggtgacattgcttcggcgatatggattcctttggtcaccaaccttggtgatctgggccgtttcagttggggctcagcagtgttggcgtggacatatagacagctctgtgaggcctgttgtcgtcaggcaccatcatccaacatgagtggttgtgtgctattgattcagatgtggatgtggttaagactaccgattggaaggcctaagtggaggcaaagcttcactccttggccctacaatgagccagacatggagaagacagtggcctacctttttgagagtactgccactgcacatgctcaccgggatgtggcatacaagcattatgtcaatgagatggactgcttacagcctcaacatgtaagtacttccaatatcacttctagttagacatttacttctttaattgagatactaaccaacgacatctcttcaacttttgcagattgagtggttaccataccacacaaatgaggcttcaagcctgaccctgaactcgatgtgcaatcgagactctgactatttcatgtaccagtgcccattgatttgtttctgggcagttgagtaccaccttccgcaccgtgtcatgcgacagttcgggaagaaacaagattggccggttgaggacatctcaactggagttgaattacacaagtaaatatttcttatctttgtttgctttcattatcaatgttcaattttgtaccatttaacccttgtcgatgctcactattgtttcatcaccttctacttgtctaggtatgacagggtgagaacaaagaaggtgaaagactgggggctagagcataatagatacattgatgaatggaggacagccggaaggaacgacaggtacatcgagactatacaccaaaatcatcttttctcagagtaccttcgttggctgcataggacatatagactgttcctccgccctacttggacggaagccgacatagaggatgaccgcgactctgatgaggggcggaatccctatgatgtccggactagagttggatatcaaatggagcacgccccacttagagacagagtcgtaagttttcttgcatttgtcaaagttatttccatttgcaccctagaccctaacatatatcttctcacgctttcagtcgagagagctcctcaggagtgtgaatgaaatggggcatgccctccaagctccgaggggtggtgaggacacggagaacacactccgcaatgttttagaggtaaaatttatttagcactttgcattacttgagttatgcctaacaaacttctttttttttttgaaatgcagaaagttcgtcaaaggtgccggaaacttgcagcaagattaggttgcaggtcggttggattggacgacgtgtaccaactggggagattacgaccaccactacctcaatccgcgcgtccaagtatcgctcgacactccatcaggatagaagagcgtgaaggagttggtggctcgtcgtcgtcacgcattaagcaagagaggggaaaggggaaggcgccggctccacctagcgacgacgatgacgacgaagacgaggaggatgaggactacgtcgtaccagacgccgaggagatagacatgtcacagcttcccgacgcgcctcaggggacgcaacccacgcaatacaacttgcgatccactcgggcagcgaaaaagaggtaaaatgagcttaccattctcaaatgttatttgatttcccttattttgtttttaaaatgttttaaacattggattttcaaatataggtacactccgggctcgcaagcaattcggcgccaacggaagaagtaatttgtatgaagttaatctattggttggtagtatgacatatgtggtgcactatgtgatataaaatgtgatggactatgtgaggactatgtgatggacttttgacattgtttcatgtgtggaatataggatggacttttggcattgtttgatgtgtgggatatgtgatggactttttgcattgtttgatgtgtggaatatgtgatggactatgagaggactatgtgatggacttttggcattgtgatttgtgcaattggaacctgttttagtctgtacgaatctgtgaattgtgatttgaattgcgaactgtgaattggtacatttgtgcaatatggatcttcaatttgcagggaggcagagggcggcgccaaccaccctggcgccgcggttggggagggcggcaccagccagtgccgcgaggcagaagggtttcgggctgggggagggcggcgccagctaccctggcgccgtggtccatgagggcggcgccagccgaggcccggaggcagaagggcttcgatggggggaggaggggagcgccagccaccctggcgccgcggtcggggaggggcgccagccgttgcccggaggcagaataaggcgaaaatttttaggggggagaaagttggt

SEQ ID NO: 93177 - DNA, 2163 bp, Oryza sativa
gcgtaagcgcgtttcgcctctctcactctccgtgcacccgtcgtcgctgcccttgttttcgctgatctgccccaaagttttcgctaatctcgcttactctgcttttgtctgtttagacggcggcgatgaggagcccgcaggagaggaacacgcggctggagaacatgtcgtggaggatctggaaccttgccagaaagaagaagcaggtatatgcatgttccggtgaatcgacagatgagccacttctcttattatctactccctcttcccaaaaaaacaaaccctggttgtcctgggtttcccttctcttatatgaattttttttataattagtatttttattgttgttaaatgataaaacatgattaatactttatacgtgacttgtctttttaatttttttcataattttttcaaataagacggacggtcaaacgttggacatggaaactcagggtttgtctttttttgggacggagggagtaaatattttgcccagcatactgcgcctttaataaacatttctacgacagttacattgtatagtgacgctggtttgactggggggagtgtcaactctctgcaccctggccttggcatggagattgtgttaactgccgttggtaaaatactgctagttgtggccttatgggttgttaccatgttagcctttgttgcatgcagggaatacttcatgctacttgtgctgcatttgacttgactcttctggtggtgttgtagattaccatgatagtatcgtgggtatccacattttgtctcaagtgcctgctagctgtgtgttatttttttttttgctgattctagtatttgctagaaaatctgtcttttggtgtatctggaggaatttctctcgtgccagagaacacgtacatatccctgcttgaggaggtacactgtacaagtgtgtatgtacaagagtggaactccattgtgtatcttggcgttcaggttgaacgaagttgctttagctgcattgattgtttatatattatatacatcaaataaaaacagattagttgtgaatgaaactatatgcatgttcttgcctttctctaatttatacagtgcagttttcatccaaatagatggtttcatgtcactgcttaaactagggtactacctgctgatgagtaggattacagttgtcatgtagttaactaatgtttttctttctaggttttctaatgcaattcatgatgcttaaacccatcacgtgcgacaatgttatgttatgagaatgctttagtgaacagcttgaactggtaatttttgcagaataatattatcaacaaagttttgaaaaaatattaaattaattattgtgcctagttttgacacctacaatactttgatggttgaaattcaccagcacacatgcaaatgcaaaattcctttggaaaggatggactatttgttactgacattgttctaaaaattgtgcatctagatcactctatcagatctgttactgataaaattgctatttccaaccgtctccattattccacactgaactgactagacctgtgtctgaaaccatatttcatcaaatttccggacaaatctaaagtgacttgacctaatggtgtacttgagttttgagcaaagaagataatttcaaaaacgttattattgttctttattctccagctgtaaatgttaagtgtttctgttacattaaaacttgataaaattccagcattttgtttcattaccgagttttaatttgcttaatacagattgaaggtgaagaagcctcccgtttagctaaacaacgtcttgagcgtgagaaggctcgtagatatgctgctgccgatatgtctgaagacctatctgagggtgaaaagggagaaaacattaatgaatcatcatctactcatgacgagagcacaagggggagaatgcctaggataggttcaacagatgctattgaggcatgggcaagtcagcacaaggataaaaagctatacattgttctgataaggtatggtgctaattgttctgctcttgagatgatattgatcttggtctatttgttctcttttatattcaagggcgtatcgtgctttggtgcatggaatagatatagaatctgtccatcagtcaattggttagtgtttgtatattttgttatatgtgacc

SEQ ID NO: 93178 - DNA, 687 bp, Oryza sativa
  unsure (1)..(687): unsure at all n locations
aggagaagagagcattcatcatgtcgtttggtgtattctgctacattaagatgccgtttggactaataacgcaggaaatactttccaacgcacggtccaaggggcacataacgattagctcgggaacaatgtcgaggcctacgtcgacgacattgttgtcaagaccaagacaagcgactcattaatcgatgatcttcgggaaacgttcgacaacctccgaagataacgccttatgctcaatccaaagaagtgcacgttcggagtaccatcgggcaagctactcggattcctcatctttggaagagggatcgaagcaaaccccgagaagatcaaggcaatcgagaacatgaagtcgcccacaagactcaaggaagtccagaagctaactggatgcatgacggcattgagcagattcgtcgctaggatgggagaacgaggacaaccctttttgctctgctgaagaaacaagacaaatttgtgtggacacaggaagccgaagatgcattcatcgcactcaaatgctacctgtcaaatccccctgtacttgttgccccccaacctaatgaagaattattccattatattgccgccacaccatattctgtgagcgtcattattgtcgagagagaaaaggtgcaaagactagtttattacgtcagcgaagctcttcacgacgcanagacaaga

SEQ ID NO: 93179 - DNA, 1656 bp, Oryza sativa
ttgtcggcataactcttatgatgagattgagccactcgcaatctttcctgaatgattttcaccttttcttctgcttcccttaggatatctgtcccgaaaacctgacgttctcccgtttgatcccacaaaagcggagtgcggcacttccgaccatacagtgcttcgtaaggagccatctgaagactagcttgataactgttgttgtacgaaaattctgcatagggtagattcttatcccaacttccaccgaaatctagagcacaagctctcaacatgtcttccaaaatctgattcaccctttcggtttgtccgtctgtctgcggatgataagcagtactaaaattcagcttagaacccatctcttcctgaagcttcttccaaaagtttgaagtaaactgactgcctcaatcagacactatcttcttagggacgccatgcaaacacacaatccttgccatatacaattccgccaatcgacttccagaataagttgtctttaccggaatgaaatgagccactttggtaagtctgtcgactattacccaaatagagtcatggcctgatgacgttctgggtaaaccagtgataaaatccataccaatttcttcccacttccattcaggaatcttcaaaggctgcagcaaaccggcaggtttctgatgttctgccttgactcgctgacaaacatcacatactgctacgtattctgcgatttaacgcttcatacttgcccaccaaaatctttccttgagatcctggtacatcttagtactaccagggtgaatggagtataaagtatcatgagcttctttcaggattgcatcttttaaatctttgttgtcggggacgcagattctttcacccaaccatacagttccttgctcatcctccaagaaaccgatagcttttcctcttctcatattcttcttgatttcttgaatatcaggatcattaatttgggcttctctaacttgatcaattagagtgggcttcgcttctaaggctgcaacgaaacctctattgacaattcccaaatttaatctttcaaattccttacataattccaatggcaactgtcgtccttccgtagctttgcaataacctttcctgctaagagcgtctgctacaacattagcctttcccgggtgataatgaattcccatgtcataatctttaattaattccaaccatctcctttgtctcatgttcagatccggctgagtaaaaatatactttaaactcttgtgatcggtatatacctctgtacgagtaccgaaaagataatgacgccaaatcttcaacgcatgaactactgcggctaactcaagatcatgagtagggtagttcttctcatgcggacgtaactgacgagatgcataggcaaccaccttcccatcttgcatcaaaacacaacctaacccaagtttggatgcatcgcaatacacttggaaacccttctttggatcaggtaaaatcaaaataggagctaatattaagcgacttttcaactcttgaaaactctgctcacattcttcagaccacttgtacttcacatctttctgaagcagtcgtgtcatgggcttagcaatcttggaaaaattctctataaacctccggtaatatcctgcgaggcctaggaaactgcgaatctctgaa

SEQ ID NO: 93180 - DNA, 2468 bp, Oryza sativa
ataatctttaattaattccaaccatctcctttgtctcatgttcagatccggctgagtaaaaatatactttaaactcttgtgatcggtatatacctctgtacgagtaccgaaaagataatgacgccaaatcttcaacgcatgaactactgcggctaactcaagatcatgagtagggtagttcttctcatgcggacgtaactgacgagatgcataggcaaccaccttcccatcttgcatcaaaacacaacctaacccaagtttggatgcatcgcaatacacttggaaacccttctttggatcaggtaaaatcaaaataggagctaatattaagcgacttttcaactcttgaaaactctgctcacattcttcagaccacttgtacttcacatctttctgaagcagtcgtgtcatgggcttagcaatcttggaaaaattctctataaacctccggtaatatcctgcgaggcctaggaaactgcgaatctctgaaactgtcttcggttgtttctagtttattacggattccacattactaggatcaacggcaactcctcctgctgagatgacgtgaccaaggaacttcacttcagacaaccaaaattcacacttgctgaacttagcatacagttgatgctctcgtagcttctccaatgcaaggcgaagatgttcttcatgctcttctttggttcgagaatagataagaatatcatctataaagaccactacgaacttgtctaggtattccataaacaccttattcatcaagttcatgaagaaagcaggggcattggtaagtccaaaagacataaccgtacattcgaacaatccatacctagtggtaaaagctgtcttaggtatatcttcctctttgattctcaactggtgataccctgatcgaagatctatcttggaaaaaatggtagcacctttaagctgatcaaacaaatcatcaattctgggcagcggatacttattcttgatagtcacatcgtttaatgcacgatagtccacacacattctctgggtatggtctttcttttccacaaaaataaccggagctccccatggtgatgaactcggtctgatgtatcctttctgaagcaaatcgtccacttgcctcttgacttctgccaactcattggctgccattcgataaggtctcttatggattggagttgttcctggtaccagatctattctgaactctatatcccttttgggcggcattccaggtaaatcatctgggaacacatcgggatactcccggactataggaatctcttccaaagttatttgattcagtcttgaccttaaagactcagaagacaatgcatgaacagttaccactcgaccatcattactggtgagagttacttttctgttggcacagtctatcacacctctatgtctggctaaccagtccatccctaggatgacatcaaggtctttggattctaacaagataagattggccagaaatggtactcctttaatttctattctgaccgaggggctacgttgcaaagagagtgcttgattccttggggtactaaccatcaaaggatgtctaagatcttctacttccatcccatgatttcccgcaaaactcatagataagaatgaatgtgtagcacctgaatcgaaaagtactgttgcaggaactgagttaacagggaacgtacccaaaatcacatctggagcatcttgagcttctgcagcagcgacatgattgacacgggcctttgatgctggtacagcagagttactctgggcaggtacaaccttcacgcgacggggcttcggacacttgtcagcataatgtcctgggtctccacagttgaaacacaccacgggcttgctgccttgctccctcttggcaggctgttgctgtgttggagctgcaacaggacgtggagcttgattgcggatgttgttgccagcattgttgttgaagaactgacgctgcggacgaacaacagacgaagaacctccctgtggcatagactggggtcctaaagtaaaacgcggcttctgattactcccttgttgtgccttgaagtgagcaatccgacgtttcctctgctccatgcaattgtacttgtcctcctgacgtatagccttatccactaatttctggaaatcaggataatctccaaccatgagtgggtaagaaagctcgtcattaagtcctcccaaaaacttctcctggtgctcttcatcattgcgcacatcttccggagcataacgagcaagacgattgaactcgtgcagatactccgtaacagagcgagatccctgagtaagcgacctgaactccttcttcttgagagacactactcctgatggtatatgcgtcttccggaaagcagcggtgaattcaagccaagtgataggttcagcagtagtcctattcaggcggaagtgatcccaccattcaaaggcagagccatccaactgatgtgatgcaa

SEQ ID NO: 93181 - DNA, 5505 bp, Oryza sativa
ggatagagaattactttaacttttattgatcttaactgagtttcattattacaaactgaagactctcacaccactaaactcaccaacttcctaacactcaaaagcaaacaaacgcatgcaattacatcccaccactgatgtaaatcacatgcgagccacacacaagcaaacttaaagcaaacaaactaacacaacgatctaagacaacgacttaacaagtcactctagttcttccaagcatcggaggtcgattgaaggctcgttcggctcgtcttcatcatcttgggttgctacccactcaatcttggaattgttgcgcttggattcttcttcttcatcacttatgatgatgaccggaggatccgcttgggatggggcaacttctttctccaccacacgaacctttggcgccaattgatagcgagggacgaatagagctctcttccttgcggtgaggcgaatcctggccttctgcggcggtgcttctccctttaatgcagctagttccttctccaaacgatccaccttgtcttctagcttgcaaatcttaccacgattccggtcttcacgatcttgagccgctaacacagtctccgcacgactttcatccatagcccacagcatctcaaccaaatgccttgtggtagcatcattctcaattccttcagtttcaaggtagctgccacggtcacttccctggggttggcgaggatggtagcgatactcagtgtcggccaactgatcactgtagctatcacggagttctcctatggcgatccttgccacttcctgacatgcatggacgtagtttcttcctccagcttcgaacatcactgaggggacctcttcactattgctgtttaaggtgactttgactcggcacttttcttcatgacgatcatgaggaatctgggcataaaaaggggcagtcccaaatccaatggcaaaggacatcgtacgcaactcctggacaaaaccctcaacaccaaacaggtactcaggcctgtagcgcggcatctaaagacaagtgaaaggagagagttaagacatctatccaattaacagcacaagtttttggattaacttgaataaaatttgaaaatcaaagtaaaaggtaagtaaataaagtaaaccaaacttgcaagataatttgaaatagttgaaaacaaggttacaaattttgtactttttaacaacaggtttcaaaagaaataaaagaaagttataaaatcatcatgctaaatttattttattgtagcaagattaaataaaacaatattgtaaaacttttgctgataaatgagccattagtacagtaatggatgtacagtactaataacactggaataaattttgaataagaaccattaaaagagattatgaaatgcatgtgccattagtttggtttaattaaaagagaaagggaggagaacagttctacttttccaatatttttagagggcttctatgggtaaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaaacaataaagatctaagcagcggaaaataagataaacggcgcagacggctccactccacaggcagcttgaccaaggctactcctaatcctccactccatcagcctcattgtagaactcttcctctgatgaatgattgcaaggtgagtatatgacatactcagcaagccacgtagcaaatatgcaagtgcacaggataacaaaggatggcataatagggtttcatttgcaaaagcagcatttagcaaacatttcagaatttaacaaaacagttaagtaatttaacaatattaatccaacgctatacaacataccctgttgtataggcccaaccattctgaacaaccatcccagctgcacagttctatctccaaaccaggaatgtaccattccataccaggagctaatcaaattatttccaattatagcatcatttactatggtgagaagtgtgaaactaatcacgaaagacattgttcgacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcacataacacaatccactgcagcgcacctttctggatcataatcacccccttataaacaaggcatggactccccagcgacccccgtgggcttatctccgccacttctcagtctggtgccccgcaatgaaccatgctatacaaaagataaagccgttgcccatgttggcttgtggttggcacgataaatgtttcacaaccgaaactcgtgaaccggtccttaattgtcatgagcacgaccatcaaaaccatgtgctcacaacccaccattatcaggttttagttggcacattaattaattaaccaatcacgattgtccatcgtgaactatcaataagccatcatgaaataatagtgaatcattagttatcccataagtgtgctaaggtttctaagcagggctaagcaattatatctaatatctagttgaaccaatataaataaagctcaactagtcaaattattataacccaaggtatcaaggaataaagtaatcaagaacaaaagggctataacaatcaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaaatagttatgaatttttaaagatttaatcggattaaaacacttaaatcggttaaaattgaattatgacgcaataatgaattatttttgaaaaggaaaagagggtttattgcgtcagcggctagggttttggtggaccgggcgcacgggcggcggttcacgcgaacggacggccgagatcgatccaatccaaaacggacggctgagatcgaacggtccacgaccggctcacggcggacgaccccgatgacgtcggcaatgacgtcaccgacagcggcggcggctcggcggagcggacggctcgggcggcgcacgctcgccggcgaacggcggcgcgaggacgcaaacggagggcaccagcacgtagaggacgacgcggcgaacacaccggtgaccaaaacggcggcggaaaaacaacgaacgacgacggcgacgaggaggaaacggcggaaaccttcgggttgtcgacggcgacgaagctccgacgatctccggcgacggcgaaggggcggacgaggacggcgacgacttggcgaccacgacgacggtcttcccgagcgacggcgacgtctggaacggcggcggagcacggctggagcggcggcggcgacggcgaagctagggcacacgacgctagagcgattccgacgacgagaggcgaaggcgaaggtggcgacgggtagaggggacaccgggggtccttttaaaggggctcggaggcggcggcgaaggcccacggcgacggcaacggcgaaggaaagctcgggaagaacaaatccgagacgaactcgaatccaactctttccaaagcgatttagccaaagattccaaaggagaaaaggtagaggagatcccggagattgtttcccctctattgattcggccggagaaggaaaggaacggccggatttggaagggaaacagcggcggcgcgaaactagggtttcgggcggcggcggccgaaggtagacgacgactgacaggtgggccccacctgtcagcgacagcgagggcgcgcgcggctgcggcggactgggccggctgggccgaggagagagagaagagaggttttgggccgactttcggcccaaagccaaaagaagactttttaaaacctttttcaattaaaattatttcttaaatgcaattccatttattaaaaatactttcttagctcaaataaatcccagaaaaatctaggaattatagaattaagcaaagtatttaaggaaattttatctgggcccattttatattggaatttattaattaaaaaattagatcttcttttcaagatttttcaaaataaattctagaaattccaattaaacaacaatttatatattttgaattttcagggtgtgacaaacctaccccccttaaacagaatctcgtcctcgagattcagaagaactggcgaacagatgcggatgagctgacttcaattcatcttctcgttcccaagttgattcttcttccgagtgattactccactagactttgcaaaaacggataactcgatttctggttcttctctcacttgtttccaagatacggattggtttctcaacataggtcaaatcctcttggacttctatctgttcaagattagcttcttcggtaggtacccttaaacactctttcaattgcgacacatggaacacattatggactcctgccaaagattgaggtaactccaactgataagcaacctctcctcttctactgacaatcttatagggtcccacaaaacgcggtgccaattttcctttggtatgaaaacgatgaactcctcgaaaaggcgtgacacgaagatacacataatctccttcttcaaaactcaaatctctacagcgattgtcggcataactcttatgatgagattgagccactcgcaatctttcctgaatgattttcaccttttcttctgcttcccttaggatatctgtcccgaaaacctgacgttctcccgtttgatcccacaaaagcggagtgcggcacttccgaccatacagtgcttcgtaaggagccatctgaagactagcttgataactgttgttgtacgaaaattctgcatagggtagattcttatcccaacttccaccgaaatctagagcacaagctctcaacatgtcttccaaaatctgattcaccctttcggtttgtccgtctgtctgcggatgataagcagtactaaaattcagcttagaacccatctcttcctgaagcttcttccaaaagtttgaagtaaactgactgcctcaatcagacactatcttcttagggacgccatgcaaacacacaatccttgccatatacaattccgccaatcgacttccagaataagttgtctttaccgga

SEQ ID NO: 93182 - DNA, 560 bp, Oryza sativa
gcgtgtgtctttctaagccctcgtcctctttcgtgtgcgccaagcttctcccgatcagcccaatggccgaacgggcagtggcgcacatcctctctccgagcgctagcggtgacgacggggagcagaacccgcgccgccgagctcgtactccaccgtccccctctcgccgaagtcttggccgggagtaggcgctcgagaaggtcgaaagatccgcgacttcgccgcccgcgggtgatgaagaagcacggcgagacgggaaacgtcgcctcctcgtctacggcgatggcagcacgccccagggcgcgctttaggctgcgggcgcgctcttgcgtcacccgcccgtcgtccccgatccagagactccagcccaacgttggctagacgacatgaccaatttggtcatgacggcgcagcagcgcctaggtgccggcgggcggtcctccgccaccaaggcctctagcgctgctaccgccggctccgtgtcgtcaaggcggagggcgcggcgagcgacggccgttacccgccgttcgtgggtaccgagctcgaattcgccctatagt

SEQ ID NO: 93183 - DNA, 550 bp, Oryza sativa
acgccactggacgcgggcgaggacgcgtctccggtgctttctccgcgaaacgcagggctgaccgagggatagaaggtggctgcgaggccgagggagaattcggcgcagccggagggtgcacgggtaaggcggtaggtgcggctgaaggtggccggcgcggagaaaagaggagggcgacggcgggaaggcagctccgggggtcacctcgcgaaacggagggcaagccggggtggaggaggtgacggcgacgctggaggaggcgacggcgcggccggccggcgcacggtcgaggcggcaccggcggctggaggcggccggcgacgtgggagagagagggcgacggtggggagggagctagggaccacggggaggctcgggatggggctaaaacgagagaacgggggatgaggatcccattttataggatgggggagggagccggccacgggaggagcgggaacggcgacgggaatggtggccggcggcaaaggaaggcggccggacttggcgcggccgttcccggcgattgggggcaccattcaagggggaa

SEQ ID NO: 93184 - DNA, 904 bp, Oryza sativa
aataaatttaagaataatagtagtcgtgggtggttagttttaatcgtcagctctccttctctgtttgctggttctgtgaggggttttcagatggtgacgaccaggagaaatgttaacaccggtgaaggtaaccaacccgaaggcagcaaccccaaccaccaaggcaatccacctccgccaccaccaccagacaccaacgccattctcacccagatcctcgcccaacaggccaacatgatgaatgctttcctccaccaccttcaaaacccgccacaacagaatgctcccccaccacctccccaacactctaaactcgccgagttcctccgcatccgcccacctaccttctctagctccaacaaccccgtggatgcgttggattggttgcatgccgtggggaagaagttagacactgtgcagtgcagtgatgaggagaaagtcatcttcgccgcccatcagctgcaggggcccgcatctctctggtgggaccacttccaggctacgcagccagagggacagccgatcacttgggcccgcttcaccgccgctttccggagaacccatgtgcccgctggagtcgtggctcttaagaaaagggaatttcgggagttgaagcaaggcaaccgctccgtgatggagtatttgcatgagttcaacaatctagcccgttatgccccggaggatgtgcgggaagatgaggagaagcaagagaagttcttggcaggaatggaccctgagctgtccgttcgtctagtctctggggactatcctgattctcaacgtctggtggacaagagcatccgcttggaagccaagcacaaggagctggagtcgcacaagcgccgcttggcgaatttccgcaatcaacagggtgctaaccagagggtccgctacaccaatccct

SEQ ID NO: 93185 - DNA, 2283 bp, Oryza sativa
tattgcgtcagccgaggggagagggcgcgccgaccgggtccacgggaggggggcccaccccgcaaccttaccgtccaacggggacccggcccaccttggattccaccggccggcgccgtgggccccacacgtcaaccccaccaaaaggcccctgcggctgacgggccggcccccacgtgcaaccacttcgcacgcccggggcggcccatgccggcccgggaggtggaagcggcgcgcgcgcccctatggtcgctggcggcggctgagagaggggaagggaagggggaaaagaggcggcggtccacggctcaccctaggtcgacggcgacgacgaaaaaggcggccggagcggaggaagccgacgccggggcgacgacgggggtgaacggggatggcgacggtgctgcgaagccgaagaaggcgacgccggggcgacgacggcggtggaccggagctcggcggcgacggcagggagagagagcgacgtcgcgagctcgaatccggcgaggaggaagggcggcgagaggtggaaacggacggagaaggtgcggggagggtttaaataaggttggaagggggagagggcagccggggaggaaggaaaccggcgcggcgttctcgggctccatcaatggcaccggcgggattaggggaggggttccaaacgaatccaagggagagagggagggaaaattggggggaaagggagagggaatcacggggagtatttccccccccactttattgcacgcggggactgcgggatgtggcggatttggcagcggcggcggcgcttggcgcgggcggagcggcaggagcggcgggaggtcggggatgacgggtgggccccacccgtcagcgagggtggcaggcgggcccgcccgtcagcggcgcgcgcgcagcgagggaggccgaatgggccgcgggggagaggagagagagagaggggggagagagattggccgggccggcccaagggaggggagggggacttttatggtttttctttttataaaactttttcaactttgtttatttcttaacaattattatttgtgctctgaaaattccactaaaatttatttacacattttaggcttttaggaaatacacaaaaatcctctaagccttgtttgacttttactttgcacattgtaatttttggaggctttcacacggattttaattattctaggcataatttaaaggatgtattttagagtcgttttgggatgtgacaaacctaccccccttaaacggaatctcgacctcgagattcggaagaactggcgaagagatcgggatgggctgccttcagctcgtcttcacgctcctaagtagcttcttcctcggcgtggttgctccattggaccttgcaaaaacggattactcggttcctggtcctgcgctccatggtgtccaggattttcagtggtctgtctacgtaggtcaagtcttcgcgaacttcaatctgctctgagtcagcctgctcggacggcactcgaaggcatttcttaagttgcgacacatggaacacatcatgcacgttgcccaaggaggcgggcagctccaactggtaagcaacttctccgcatcgagcaatgatgcggaaaggacccacaaaccgaggtgcgagcttccctttcgtctgaaacctgtgtacgctccgcaatggcgtgacccgaaggtacacaaaatcgtccactgcgaattccaggttacgacgtcggttatctgcataactcttctgccgggactgtgccacctttagattatcccgaatggttctgaccttcgtttcagcttctctcaggatatcagtcccgaatacttggctttccccaacttggtcccacaatagcggtgtccggcatttgcggccatacaacgcttcatagggtgccatttgtatgctggcttggtagctgttattgtaggagaactcggcataggggagactcttatcccaggtcttcgcgaaatctagaacacatgcgcgaagcatatcttcgaggatctggttcagacgctcggtctgcccatctgtctgcgggtgatacgtggtgctgaaatttaatcgggtatccaactcttcttggagcttcttccagaagggagaggtgaattggcttccccgatcagatacaattttttaggaacaccatggagactcacgatcctagcgaagtagagttcagctagtttgttccctccataggtggtcttcacgggaatgaaccgagctaccttggttagtcggtccacgactacccatatagaatc

SEQ ID NO: 93186 - DNA, 704 bp, Oryza sativa
atcttcgccagagaagatggttggagctcatcaaggattatgatgtgggaatccactatcaccctggtaaggccaacgtggtcgctgacgcgctgagtcgaaaaagccgttgcaacactcttggcgtccggggcattccaccggagcttaatcaacaattggaagccctgaacctaagcatcgttagccatggattcttggctacgctggaagccaagcctatcttgctcgatcaaatccgcgaggctcagaagaatgatccagatatgcatgggatcctcaagaatatgaaacagggtaaagccgctggtttcacagaagatgaacacggaactctatggaacggaaatcgtgtatgcgttccgaatgacaaggaacttaaacagttgatacttcaggaagctcacgaaagtccttattccatccaccctggcagcacgaagatgtacttagacttgaaagagaaatactggtgggttagtatgaagcgggaaattgcagagttcatggccctttgtgatgtgtgccaacgtgtcaaggcagagcaccaacgaccggccggacttctccaacctctccaagtaccggaatggaaatgggatgaaattgggatggatttcatcaccggacttccaaaaacccaaggcggatatgattctatatgggtagtcgtggaccgactaaccaaggtagctcggtttatt

SEQ ID NO: 93187 - DNA, 3883 bp, Oryza sativa
tataaaacctatttaactttgtttatttcttttcaattattatttgtgctctgaaaattccactaaaatttatttaagcattttaggcttttaggaaatatacaaaaatcctccaagcctcatttgacttttatctttgcacattttaattgttggaggctttcacattgaattttacttattcttttgcacaattttgaggatagattttagagtcgatttgggacgcgacaaacctaccccccttaaacggaatctcgaccccgagattcggaagaactggcgaagagatcgggatgggctgccttcagctcgtcttcacgctcccaagtagcttcttcttcggcgtggttgctccactggaccttgcaaaaacggattactcggttcctggtcctgcgctccatggcgtccaggattttcactggcttctccacataggtcaagtcttcgcgaacttcaatttgctctgagtcggcctgctcggatggcactcgaagacatttcttgagttgagacacatgaaacacatcatgcacgttgcccaaggaggcgggcaactccagctggtaggcgacttctccgcggcgagcagtgatacggaagggacccacataccgaggtgcgagcttcccttttgtctgaaacctgtgcacacctcgcaatggcgtgacccgaagatacacaaagtcatccactgcgaattccagatcacggcgacggttatctgcataacttttctgccgagactgtgccacctttagattatcccgaatgattctgactttagcttcagcttctctcaggatatcagtcccgaacacttggctttccccaacttggtcccacaggagcggtgtccggcatttgcgcccgtacaacgcttcatatggtgccatttgtatgctggcttggtagctgttattgtaggagaactcggcataggggagactcttatcccaagtcttcccgaaatctaggacacatgcgcggagcatatcttctaggatctgatttagacgctcggtctgtccatctgtctgcgggtgatatgcggtgctgaaatttagtcgggtaccaagctcttcttggagcttcttccaaaagtgagaggtgaattggcttcccctatcagatacgattttcttgggaacgccatggagactcacgatcctagcgaagtagagctccgctagtttattccctccataggtggtcttcacaggaatgaatcgagctaccttggttaatcgatccactattacccatatagaatcatacccaccttgggtttttggaaggccggtgatgaaatccatcccaatttcatcccatttccattctggcacttggagaggttggagaagtccggccggtcgttggtgttctgccttgacacgctggcacacatcacatagagccacaaactctgcaatttcccgcttcatgctaacccaccagtatttctccttcaaatctaagtacatcttggtactgcccgggtgaatggaataaggactttcgtgagcttcctgaagtatcagctgtttaagttctctgctatccggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggctgggcttctagcgcggccaaaaatccacgaccaactatgtttaggttcagggcttccatctgttgattaagctcgggtggaatgcctcggacgttgagagtattgcaatggctcttccgacttagagcatcggcaaccacgttagccttaccagggtgatagtgaattcccacatcataatccttgatgagttctaaccatctcctttgccgaagattcagatccgactgggtgaagatgtatttcaaactcttatgatcagtatatatttcacagcggttcccaatgagatagtgccgccagatttttaaagcatgaaccaccgctgctaactccaagtcatgtgtagggtagttgccttcatgaggtcgtagctggcgtgaggcataggctaccacatgaccgtcctgcatgagcacgcaccccaatccttggcgcgaagcatcacagtacaccatgaaatccttgcgagtatccggcaagattaacactggcgaggaaaccagcttttctttgagagtttggaacgccttctcgcattgcgggctccacacaaacttctcttctttcttcaacaactgtgtcatgggtcgagcgattttggagaagttctcgatgaacctccggtagtatcctgccaaacccaagaaactgcgaatctgagtgactgtcttgggttgcttccaatcggtgacggcggtcactgtttcggggtccacagcaactcctttagcagatatcacgtgccctaaaaatttgacttcggacaaccagaactcacacttgctaagtttggcatacaattgatgttcccgcaactttcccaacaccagacggagatggggctgatggtcttcctctgattgtgagtaaccaaaatgtcatcgatgaaaaccacaacgaacttatccaagtattccatgaacactttgttcatcaagttcatgaagaaggcaggagcattggttaagccgaacgacatcaccgtgaattcatacagcccgtatcgcgtagtgaatgcggtcttcggaatatcttcttcacgaatacgtaattggtgatatccggaacgaagatcaatcttggagaatacagtggcacctttgagttggtcgaacagatcatcgatccggggaagagggtacttgtttttgatggtgacttcattgagagctctgtagtcaacgcacatcctcttcgtcttgtctttcttctctacaaagatcacaggagcaccccatggggaagtactcggacgtatgtaccccttttctttcaattcttccaactgtgtctttacttcggctagttcatttgctgccatacggtagggtcgcttgtgcagaggagtggttcctggagcaagatctatccggaactcaatctctcgcttgggcggcataccaggtagttcttccggaaacacgtctccgaactctctgactatggggatttctgacagacctatctgatgcagttctgaacttctgacagaggttggaggtgcaaagaaaacaaccggctgttccggccctcggtacagagtgacagtgcgcctcgcgcaatccactaccccttggaattgggccaaccaattcatcccaaggatcacatccaagttcttggtgtctagcagaatcagatccgagggaaaaggaatcccctgaatttctatagggacggcaggactataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgcttggccttgctggcgcctcggcttcgggcatttatccgcaaagtgcccgggctcgaagcagttgaagcacagacgctgcggacctgaagcgtccctgcggccttgaccagactgcgcagctggcgtaggaggacggggcacacgggtcccttgctggctctgctgttgctgcggctgtgggacgcgcaccacgaattgaggtcggggcgcgga

SEQ ID NO: 93188 - DNA, 685 bp, Oryza sativa
gaatggaaatgggatgaaattgggatggatttcatcaccggacttccaaaaacccaaggcggatatgattctatatgggtagtcgtggaccgactaaccaaaggagctcggtttattcttgtaagaccacctatggagggaacaaattagctgaactctacttcactaggatcgtgagtctccatggcgttcctaagaaaattgtatctgataggggaagccaattcacctctcacttctggaagaagctccaagaagagttgggtacccgattaaatttcagcaccgcgtatcacccgcaaacagatgtgcagaccgagcatctgaatcagatcctagaagatatgctccgtgcctgtgttctagattttgggaagacctgggataagagtctcccctatgccgagttctcctacaataacagctaccaagccagcatacaaatggcaccttatgaagcgttgtatggccgcaaatgccggacaccactattgtgggaccaagttggggaaagccaagtgttcgggactgatatcctgagagaagctgaagctaaagtcagaaccattcgggataatctaaaggtggcacagtcccggcagaagagttatgcagatacccgacgccgtaacctggaattcgcagtgggcgattttgtgtaccttcgggtcacgccattgcgagg

SEQ ID NO: 93189 - DNA, 664 bp, Oryza sativa
ccccgtggccctttgtgatgtgtgccagcgtgtcaaggcagagcaccaacgaccggccggactcctccaacctctccaagtaccagaatggaaatgggatgaaattgggatggatttcatcaccggacttccaaaaacccaaggcggatatgattctatatgggtagtcgtggatcgattaaccaaggtagctcgatttattcctgtgaagaccacctatggagggaacaaactagccgagctctacttcactaggatcgtgagtctccatggcgttcccaagaaaatcgtatctgataggggaagccaattcacctctcacttttggaagaagctccaagaagagctgggtacccgattaaatttcagcaccgcgtatcacccgcagaccgatggacagaccgagcgtctaaatcagatcctagaagatatgcttcgcgcatgtgtcctagatttcgggaaagacctgggataagagtctcccctatgccgagttctcctaccataacagctatcaagccagcatacaaatggcaccttatgaagcgttgtatgggcgcacatgccggacaccgctcttgtgggaccaagttggggaaagccaagtgttccggactgatatcctgagagaagctgaagctaaagtcagaaccattccggataa

SEQ ID NO: 93190 - DNA, 790 bp, Oryza sativa
cgtcacagtacaccaggaagtccttgtgagtatccggtaagaacaacactggccaagagactagcttttctttggaaagttgggaccgccttttcccttgggggccttcacacaaatttttctacctttttcagcaactgcgtcatgggtcgagcgattttggagaagttctcgatgaatcttcggtagtatcctgccaaacccaaaaagctgcgaacctgagtaactttcttgggttgtgtcgcgtcccaaatcgactctaaaatctatcctcaaaattgtgcaaaagaataagtaaaattcaatgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttaaataggttttataaaaaagaaaatcctaaaagaagttctttttccccccccccttccttcttgggccggctcggcccattccctccctctctctctctctttcctcccgcggcccatcggcctccccgcgcgcgcgcgccgctgacaggcgggcccgcccgccactctcgctgacgggtggggcccacctgtcatcgccctcctcccgccgccgccgcgcccgtgccctagcgccgccgccgccgcgaatcccgccgctcccgtccgccccgcgtgcaatcaagaggggggaattattccccgcaatcccctctcccgattccccctcttt

SEQ ID NO: 93191 - DNA, 2173 bp, Oryza sativa
ttggagttatggggaacctacagagatgctgagtccaaaaattcagagaattttgggcatgatatcggtgaaagcagtggtgcttatattgtgaggataccttttggaccaagagataaatatatccccaaagagcatctctggccccacatccaggaatttgttgacggtgcacttgtccatatcatgcagatgtccaaggttcttggagaacaagttggcagtggacagctagtatggcctgttgttatccatggacactatgccgatgcaggtgactctgctgctttgctatctggggcactcaatgtcccaatgatattcacaggtcattctcttggcagagacaagttggagcaacttttgaagcaagggcgtcaaaccagggatgaaataaatacaatatacaagataatgcgtcgaattgaggctgaggaactttgtcttgatgcatctgaaatcataattacaagcactagacaagagatagaacaacaatggggattatatgatggttttgatttaaccatggcaaggaaacttagagcaagaataaagcgtggtgtgagctgctacggtcgctacatgcctcgtatgattgtaagtacatctgcatcaactcttttcagtttgaatgcagttcattgctttaacaataacatttctgatgtttattgttttattaaattattaggcagttcctcctggcatggagtttagccatatagtgcctcatgatgttgatcaggatggtgaagaagctaatgaagatggttcaggttcaacagatccacctatttgggctgatgtgcgtggttcctttatattctacaataggatatctaggaataactttggtgatgtgccacatgagatccttgctatatttactcgctatcttgtttgaaatattttcagataatgcgattcttctccaaccctcgcaagcccatgattctagctcttgctcgtccagatcctaagaagaacatcactacactggtcaaggcatttggtgaacatcgtgaattgagaaatttagcaaaccttgtgcgtgagcttgtctaatgtggtttgcctagttgccctcattcttatttttctcattatctagtggtctagttagtaatgaagcttctatgtcctttctaggtgatcattctttttgtagtattttttatactctctagatgatgcttgttctcttcatttattttttctgcagacacttatcatgggtaaccgtgatgttattgatgaaatgtcaagcacaaattcagctgttttgacatcaatactcaagttaattgacaagtatgatctatatggccaagtggcataccccaagcaccataagcaatctgaagttccagatatttatcgtttagcggcaagaacaaaggtagtcaaatattatatcttcatatgttgaaatgtttcatatggtttctgcaataagtattctagtggactcttgacatgtggttcttgagattagttgtatggtgatccagataagtgttgacaataggatttatgatgagccatatgcattgatagttacataattgtcattttggatatttgcttccttttacctatcccagttttactttcagcaaggaactgattatgctgcttctatgcttctttatgccagcctcaatcacatcttcatgtttgaactaattattgtttgaatcttatcaatttcagggggtgtttatcaattgtgcttttatcgagccatttggactaaccttgattgaggttatgtactgctgtgggatttcctgttgttgctcaactttatatgtgaattaatatgcttatgcaatcttaacatcttgttggttggcaggctgctgcttatggtctaccaatggttgctactcgaaatggtgggcccgttgatatacatcgggtactgtggcccaatccttattatacatttttgctgaaactaaatgctccagttgttggtgtcatacatatttctcttattctgatcatgtttgtttgttcaggttcttgacaatggtattctcgttgatccccacaatcaaaatgaaatagctgaggcactttataagcttgtttctgataagcagttgtgggcacagtgccgccaaaatggtctgaaaaatattcatcaattttcttggcctgaaca

SEQ ID NO: 93192 - DNA, 875 bp, Oryza sativa
tacctcctgtgaaagagcttaggaagacaatgagaattctagcactgcgctgtcatgttttgtacaggcatgatggtagcaagttgaatgttattcctgttttagcatcacgatcgcaggctctaaggtcgactttttttgttcaactgctcttccattttttctcctcatgttgccatgttcctcattggagcaaaatattatactcagttttccactaaataaagtttacatataattttcattccgcaaagtaaacaagtaaagacttagataacatatattttttattgctatatttggtcatatatactcccatcaatatttatttttgtgagtgttaacatcatatactcagtttccaattctaaagtttgatcactgtctttcctgataataaatccataaaaattaaatgtataactacatgaacgtatttttatgaaaatgtactaatcatttttttcatgtataaaatctaacctttttgcatatagtagcaagttaagattttgaggattagcctaaagagcgaaaattaatcttagtggaaatctgtcacaaacaatattttgtttgttcttgtaagagcatgtattgtagtcccgtctgaacatgcaagccattattgacttttcatggtccccaatcaaagactttgacaaaagttctgaattgtgctttaccagtaaaaataataggattttgctagacaattttagtactatttgttctcatatactccctccgtttcaggttgtaagacattttgactttggtcaaagttaaactgctttaagtttgaccacgtttatagaaaaaagtagtaacattttcaacccaagataaatttattttgaaaatatattcaatta

SEQ ID NO: 93193 - DNA, 1089 bp, Oryza sativa
cttggatatacgttgtatactgatatggtataccagtgcgtatacggatagtttctgtatgcgttaaggaaatctatcacgaaatagatacagaatccacggatggaaggagttctactcggacaagactaggtttttgccataccgtgtggggtccgatatcttcgagtccaacttagagatcaactgacccgcggtataaaagggaccccctgggcaggacctaaggcattgaatctcaccgccaacacatccaccacagcctacgaagccagagcttacaggagccaagtcgccgggtgatctagtcgaaccaactcgactacggtctcgtcggtatcatcgagttccattattccctttgtaatctttaatttccatcacataatcccataccaactggattagggctattacctatcaaggggcctgaaccagtataatccttatctttcgtttgcttgatgtcgtattacgtagatcctcgttccaacgtaccccaatactctctatatccggtctacgggtatcccccgtcgacagtggcgcgctaggtaggggggcttggtgctcaaggttctactactatgacttcaagccttctcgacgacaacgccaaccccggcatcaaccaaggatcttcgacctcaacgatactggtgtggacccaagtcggcgaaatcgttttcccggtctataccacgatgccgatctcgactggcccagcaatggccggaagtgagagtgacgtggttacgaccttgacagactccatgtcgaaggatcctcccgcagaagcggaaaacggaacatcgacaacgtctgagcccgagaaggatcctaatgcgacccaatcttgtccctccgacaagaagtacgagccgacaaggacaacttccgaggcgacaaggtcctagtgtcctattcacaaaacaaggaaacacaccttgcaagcttgctgggttcttctcaacgtacaagccgaaatccgtgcctgcagagagcgcggaattcaacgtatttctccaacccgtgatgtctattgtcctatccacaagacgaagaatcatgacctctcaagctacaagg

SEQ ID NO: 93194 - DNA, 1626 bp, Oryza sativa
gaaccgagtaactcatcgtcatcgtcatcatcctcatcatcttcgtcatcagacagacatccacggaggacatatgatcgccgacaacccaccgcccccggcggcggatgcagggctttcagtcgtgctctacgagatgtccgatggcctgagagatttcgaccgggagcgatagagaagtacgatggaagcaccgaccctaaggagttccttcaggtctactccacatactctacgctgccggagcagacgacaacgcattggcaaagtatttgccggcggcgttgaaaggatctgcacattcatggctagtccacctcctgccctactcgatttcttcatggacagatctgtggcagcagttcgtcgccaacttccaaggaacatacaagcgccacgcaatcgaggacgacctacacgcgttgacacaaaatccaggcgaatcattgagggactattcggcactttaatgagtgcagaaatacgatccccgagatcactgatgcttctgtaatccatgcattcaagtctggcgtccgagatcgctacaccacccaggagttggcgacaagacggatcacaactgctcgtaagctattcgagattgtcgatcgatgcgctcacgcggacgacgccctgagacgcaagaacgacaagccgaagacggggggagagaagaaatcagccaaggatgcacctgagtcaagcaaaaagaatagtcgcaggagtgggaaacggaaagctcaaacagaggtcctcgctgcagaatatgcggacccacccaaacacccagactcacaaggcgacgatacgaagaaaatatggtgccctatacacaagtcggacaagcactccttggagagttgtttcgtcttcaaaaaggcgctcgcgaagcaactggcgttggagaagggcaagagagtacgtgtagtcgagaaggccgctgaagcagctactcaggactcagactcagcatacccagactccgacctccatgtttcacacatcttcggaggttccacggcgtactcctcaaagcgagagtacaagaaagtggagcgtgaagtttgttcaacatggcagggggctgcacccacaatgaagtggtcagagcagaagatcgagttctcagaggccgaccaccccaagaccgctgtcatcccagggcgatatccgatcgtggtcgagcccactattcggaatatcaaagccgcacaggttctaatcgacggcagcagctccattaacctactcatcgccaacaccttggacgcaatggggatcccacgaagcgagttgacgcccaccgatcagcccttccacggaatcactcctcagtcatcgtccaagccattgggcaagattacgctgcctgtgactttcggccaagcaaacaacttcctaacagagcagatcacctttgatgttgctgagttcgacacagcatataacgccatcatcgggaggactgcactcgcgaagttcatggccgcatctcactacacgtatcaagtactcaagatgcctggactgaagggaacaatcactattcaagggaatgcgatgctagcggtacagtgcgacaagcggagcctcgacatggttgagcacacccccaacccaccc

SEQ ID NO: 93195 - DNA, 4627 bp, Oryza sativa
caagcatgcaattcacctcaacttcagggcaaccaacaacatagccgagttcgaaggactactcgctgggataagagcagcaatcgcactaggagtcaagcgactaatcgtgaaaggggattccgaactagtcgcaaaccaagtgcacaaagattacaagtgctctagccctgagttatccaagtacctcgcagaagtcagcaagctagaaaaaaggtttgacgggatcgaggtctgacacgtataccgcaaggacaacaccaaaccagacgacctagcatggcgtgcatccagacgagagccactcgaacaccttcctgggcgtcctgacgaagccatcggtgaaagcggcaaatgacgaagatagcacagtcgtccccgacatcggctcaggggctacagaggcagaacgcgctgttgccgacatcgagaccacagacgactggaggaccccactcatcaagttccttagtagtgacgagttgcccgagaacgatgcagaagccgagaaaataacccgacaagccaagatttactatatgatcggcaacgatctatacaagaaggcgccaaatggggtactcctcaaatgcatctcgttcgacgacggcaaacatctcctcctcgacatacatgaagggatctgcgggtcacacgccgccggtcggacattagtcgagaaagtcttccgacaagggtttttctggccgaccgcgctcaaaggcgcttgcgacatggttcagcggtgtgaagcctgccaattcctcagcaagcatacaaggctaccagcgcaagcgctacagactatccctcttatttggccattctcgtgctgcgggctcgacatactcgaaccattcccacgaggacagggtggctacaggttcctattcgtagcgatcgacaagttcaccaagtggattgaagcgacgcccacgggggaaatcaaggccgacaacgccattaagtttatcaaagggatattctacagatatggattgcctcaccgcatcataacagataacggctcccagttcatcagtgccgacttccaggattactgcatcggattgggagtcaagatctaatttgcctcagtttctcaccctcagagcaatggacaggtcgagagggcaaacggcatagtactacaagggatcaagacctgtgtctacgacagactcatgtcacacggcaagaagtgggtcgaagaactcccctccgtcctatgggccgtgcgtaccacaccgacaacgtccaacaaggagacaccattcttcctcgtgtatggctcagaagctatgctcctcacggagctacgacatcatagcacacgagtacagtactccgacgaggaccaagaggagcagcgaagcgacgatgtgaatctactcgaggaacatcgagaaagagttgccatcagagcagccagctaccaacaggctcttcgctgataccacgagaagcgcatcagagcacgcacacttttgatcggcgattatgtcctccgacgcgttcaaagccaagcagggcgcaacaagctctcacctaagtgggaaggaccatacacgatcacgcaagtcttgcggctaggtgcattcaagattgcagacggcgatggtcgcgagttagcaaattcctggaacattgatcaattaggtaaattgtcacgtccggaatttctatccaaaatttcaaacgcttacatgtgtgtaaaccctcgtccaggaatcagtcgaggcacacaataacaaattgataatagagtgcaattattactctaattaataagcgaatataaagtcattacagaggtagatagttcctctcaaacaataaagttctaagcagcggaaaataagataaacggcgcagacgactccatcccacaagaagcttgaccagagctacgcctaatcctccacaccatcagcatcaatgtagaactcctcctctgatgaatgattgcaaggtgagtatatgacatactcagcaagccacgcaacaaatatgcaaatgcaagggataacaaaggatggcataatatagtctcattttcataaacggcatttaataaatatttcagaatttaataaaacagtaaggtattaattaaacaatattaatccaacactatacaacatacccgttgcataggaccaaccattctgaacaaccattcccggctgcacagttctatctccaaaccaggaatgtaccattccaaaccaggagctaaacaaattattaccaaatacagcagcgcttattatggtgagaggtgtgaaactaatcacgaacgacattgttagacccgcccataaccgcgggcacgactattcgaatagttttactctggccagaggtgtaccactgtacccacaagacacaacctagcgacccccgtgggcttatcttcgccacttcacagtctggtgctctacaatgaactatattatacagaaagtaaaaccgttgcccacgttggctcgtggttggcacggttaatgtttcacaaccgaaaatcgtgaaccggtccttaattgtcatgagcacgaccatcaaaaccatgtactcacaaccaaccattatcaggttttagttggcaaattgattaattaaccaatcacgatcaaccatcgtgagctaccattaagccatcattaaataatagtgaatcataagtatcccatttatatgagctagtgtctctaagcatggctaagcatcctaaacactttagctaaaaccatataatgttcaagctaatccaattattaaccaagtgacaaagaataggtaatcaatagcaaaagggctgtaacaaaaacaataggttattcccacccaatgacattcaaaaataaatacaatagttgaatagaaacaatagctttaaacgggatcaacatgctcaaagggttgtttgggatctgtgtgacttgccttgctggctttggaactcttcaaagtcttctcctgcaaattcggactctccgggaacgttgtaatcaaagcagaaaagaacaaaatcaccaaaacagcacataaacaatcatgaacagtacatgtggatatttttaacatgtagatctcaattttagaaaaatttagagacttgaaccaactaaatccgagctaagatgaattagttatgaatttttaaagattaaatcggattaaatcatttatatggattttaattgaattatgacgcaataaagaattatttttgaaaaggaaaaaggatttattgcgtcagcggctcgggttttcggtggaccgggtgcacggcgacggtctacagaacgaacggccgagatcgatctaatccaaaacgaacggccgagatcgacttgatctaccgcgggtctacggctaacgtcagcgctgacgtcggcgatgacgtcatcaccggcggcggctcggccacgcatgctcgctggcgaacgacggcgcggcggcgcaaacggagggcacctacgggtagcgggcgacgcggcgaactcaccgatgacacagacgacggcggacggtcaacggatggcgacgacagcgaggtcgaagcggcggagacgatcgggttgacaacgacagcggtgctctggcgagaaacggcagcgacggaggggttgtcacatcctgattttcgtttcaggatttataaattatttaataaattattaatagaatttatattaaatgttctttaatttacaagtgaagttaaatgtgggaaataaaatttcttaaatctaaagcatggatggatttaatttttattaaattctccatgattaagtcaactctctgaaattttctcggatttttcggagctcaattcttaaatgatacaaagaacagttcagtaattatttgatcattaatgatctaatgataattgttaagagcttttcttgtttaaaatccttaaattataaattgttgtttaaaaggaataattagaaatgattttaaaagcttaaaagagaagatctaatttttaatttgctaaatctcaatataaaattgggctagataaaattttgttaaatactttgcttaattctataattcctagatttttctgggatttatttgagctaaggaagtatttttaataaatggaattgcatttaagaaataatttaaattgaaaaaggtttttaaaagtctgttttggctttgggcagaaagccggcccaaaacctctctccttctctctctcttccctcggcccagtccggcccaggtcgccgccgctctcctctctctctcgctgtcgctgacaggtgggccccacctgtcagtcttgtcttcttcctccggccgccgccgcccgaaaccctagccgagccgcgccgccgtcgctttccaattccgtcgctcctttccatctccggccgaattgatagaggggaaatgatcttctcgatctcctcttccttttctcttatagaaactccggtcaatttcctttggaaataggcggattcgagtttgattcggattcgtttttccccaatctttccttctcgtcgccggccgccgtgggccttcgccgccgcctccttgcacctatataaggacccccgagctctcctctacccgtcacctcccttgcctt

SEQ ID NO: 93196 - DNA, 1227 bp, Oryza sativa
taaggcatcgaatctcaccgccaacacatccaccacagcctacgaagccggagcttacaggagccaagtcaccgggtgatctagtcgaaccaactcgactacggtctcgtcggtatcatcgagttctattattccctttgtaatctgtgatttccatcatataatcccatacaaaccggattagaggtattacctatcaaggggcctgaaccagtataatccttgtctttcgtttgcttgatatcgtattacgtagatcctcgttccaacgtaccccaataccctctatattttcacaattacattactctactctatgcaatgtaattgtgaaaatatactcatgtgttgctaccagataaaaatgcctaaagttaaattgatcgacacatctaaatcgtggcatatcaaaattatatttttcttatatttttcttgtactctatctatggttgtcctcattgggagcccaaatttgattatagctataatgatttattagcgatcaaaatatattttacagataaaacatttatatatgtgttcttagtgaattaaaaaacaatgctgaaaaccaaactacataaagaaaactttaaacttatgttttaaaaattaaattaaaattcaaaattatattagagaaaatattttttccatttatcaattgcatttgaggtcaaatatctagatatagacagtgaaaataaatagaagtagagcagatagggaaggaaaaagatctgaaattcgatgtgacaggaacttaaaatttaaattttaaaatttaaattttaggctgagtttagttccaaaatttttcttcaaacttccaactttttcatcacatcaaaactttcctacacacataaactttcaatttttccgtcgcatcgttccaatttcaaccaaacttttaattttaacgttaactaaacacacccttagtactggatccaaacatcacattactcctgtttagtgagcataattttgtaaagaggatggatccatatatactcgtatggtagtaggcttgtttgatcaaaccgatgcgacgcagagagagagaggttgggaagcacaacaagcaactgatccaccgatccatactcagccttatctcttcatcggttcatccggtgcctgttgtctctttcttctctctcacatacagtctctctcctcttgttttttcttcttctctcctcagcggcaggcgccctc

SEQ ID NO: 93197 - DNA, 596 bp, Oryza sativa
ccttaaaaaaattaactaagaaaaaaattaagatttataatatgaaacggagggagtagcatcttaaacggatcgagcaatcgatcatgggtgaatcatcagctttgcacagcaaaaaacgatcatagttgcttgcattttattacattttttctcttaacagagggctagtcctgcccagccacgtcccagcacaccactcactaagattttatggctttttcggcccagtaaaaccaacagtattggagaaaaaaactgggcctgtaagctgggccgcggggtggaagcgctagtcgctgcgggccgagctgtacttgagcccgaactcccggaagccgatctccatgtcggcggcggcgacgagcagctcggccgcctgcgccggctcgaggatctccaccgcgcgcttcacggtgcgcagccggagcgcgtcggcgcggccgagcacgccccgcacccggcccactatcccgtcgacgtcgatcccgccgccgacggcgaccgcgccgtggccctcctgcaccagcgccatctcccgcgacagcccgtcctcctcggcgacggtccggcgctggaggtcgtcgatctgcgcc

SEQ ID NO: 93198 - DNA, 1220 bp, Oryza sativa
cagcgacacttgaatttgcttacatggcctgaaatattgcgccagtttggtttatctgctggtcttggaccacagttaaggaaaaggaatgctgaaaatgtcaataatcatgatgataatgaggtatttgtctgttgaaagtgtccaatgcatatgcatttaaattagtttattcctgatagctgcatcataatcatgtgcaatctgtgtagttctgttggaggcaataacttgcacgattgtagattgtattgttgtatcaatatctctggtattttggttcctgagcaattttcgattcagagaaaacgcctactgtttagtcttatagttggctccatagaatcctgaggtacaatggtatttatgcttttgatggaaaattcaaacatagaagctatcagtaccgcgatcctatgatcttgctaggctattttgatcttggtccttccaggattgtagttaggaattacaatataaaataacagcataatcctaaatatttggaatcatagttctcgaggcattggtaggatcatggtcctacgaacaagggattatcctatcttaaatactgaatgtggtccttgaatgaaagtataattggagaaacttttgtaatctgaagcaaaaaagcagattagccacttcacagttttattctctttatggcaagaaataaaattctctcaaccctaacagccctgaacaactcaaaatttgcaaacagggtcgtaatggtgaggatgttatttccatactgagaagtggctcagcagctgtaaatgctgctgctaaaatgaaagaaagaggctacggtaatcgccgcaggtctcgacaccgtctgacacctggaactgtaaagtttgctgcgttccatgtgttgtcacttgaagggagccaaggtctcacgatattggaagttgcagaaaaaatacaggtatgccgaccacatccaaaaaagttcaattgtaacctgttgctatcttattgattttgtttattgatctcttcagaaatctggactgagagaccttacaacaagcaagacacctgaggcatctatatctgctgcactgtcaagggattcaaagcttttcgaaaggactgcaccttcaacatactgtgttaaaactccaaaccaaaaaggtcctggtgattcaaaggctgtgttggcaacagcaagctaaaccattaaggttgtttaagggggttcttta

SEQ ID NO: 93199 - DNA, 1628 bp, Oryza sativa
agtgctttacactacatccatcctcccacccctcatttcatataaaaatcttcaaaccaacatgtgtgatctccatctccatggacctaaccatttgcccaactttggtgctcatttaaaaacccgtgtataaatggaagaattagcaaatatgctttagtttagagaaaatcaaatccacatgtaaattatgcactttacaatacacctttttcaccattaactaaatatcctaaaaggagctggaaatcctaggaggaaaaatacaaaagttatgtaactagaggtttgtgctatagtcatcctcttacattcccattggcttatgtattcatcattagtatagaataataatttgcccaacatttttgtaagtccaaatggaatagacaatagtttagctaagcatagttaaggtgctgctattagagcacaaaaattcagtccacaccactttgctactcaattctcagttactgcttatcaaaatgtcaatgtaaagcacaacatacctctttcacatgcttttcgaggcaacggaagttaatatttgcttcaccatggtaatccatcacatcacttcgtaattctccaattgacctttccagcttatagcaatacagctccaactgtgatagcctcccactgatgacatccagtgtattcaccaagttgtctgcttgtttcttcatgcagctctctatagcttccgttattatttctctggaataagtttcttgttcatggatattaacaagtgacctcagcagccggttgtcctggaaatcctgctttattgaagaaaggaaaatatgctaaggaccagatgttttgagcctatagaatcatggcaaggaaaagaaaaactatatagattttgccaaaagcctagcaaacgtgatttaagctaagaaatataatacgttcatatgtgttgataaagggtgaacatcaccaagttgactccagatcttcatctggttacaacttacaagttacaagaaatgtatattgatagctaacacacccaacgaatgattacttcccggcgtgtttaaatctaaacagcagaagaagcaaattcggaagatgtaacagtagaacgaccaaaaaaatcttaagataacagaagtgatatgtcacgacaacacctaagattgattataaacacgatgagaagtaaatcaaaagtagcatatccgcagcaagcacacaggacaaatccctcaaaaatttgcagctaccgttttgcacaaggaacagtgaaaccctagtcgtaacgaaacacccgcaaatcccacaaatcggccaaaattaagacgaaatctccacatgaaaacgaaaagtgggctgtctcgttcatttctgaaattcaaatcggtcagaacaaatcacatagaacagtgtgcaacctcgcacatcatcgaaatggttgacgagctcgcagatccaccggtacgcacaaacaacagacgagaactcccaacctttccccgcatctccacgaaatcagaagcagacagcaaaaagctgcacccccccccccccccaaggcgagagtcgagccaccggtctcaccaacacacacccagaacgaagcaaaacatcaccgaacacaaagagatctc

SEQ ID NO: 93200 - DNA, 3670 bp, Oryza sativa
gtcggtggctgatcttaaaccatagtgctgacacgctggtgtcgcgatgtatggtgctgatatttttcctggccacagtgtcatctttttcctggatgctagcctgctacgctgctcttggtttctttcctcctggctctgagcacgtatcggagctcctgccgctctcaactctgagcacactttcaacaataccaaaacttaataaagatataaactacatacatttcaaccattgttgcctactcttaaaactcttatcaaaatttgataaagacaacaaatcatatgaagacaatgctaccaaattttaaaatgttgattcagacaacaaagtgaataagccccatatcttcttgttataaaatccattgaagatttcaccaacgtaacgatgaaacaagaactgagaatgaaacaaatgcaaatattataactgccggctggggtatgaaacagacttaaaaagagcccagctatcgtttgaacagaaacaagacgagttaactgggagcagcggagcacatgcacagggcgactagcaacgaagcaaattcagatcagtaacagtttttggctaagcccttgtttagttccaaactttttcttcaaacttccaacttttccatcatatcaaaaacttttctatacacacaaacttccaactttccgtctcatcgttccaatttcaaccaaactttaaattttgatgtgaactaaactcaccctaaaggtgagtggcaattgagggagccagaacatccacaaactactactcctccctccgtcctataatataagggattttggttggatatgacatattaggatgtgtttcattcacctaaaatcctttatattatgcaacggagagtatatattataaccaataacttcaactgttatcgtttggtcgctttatatccacagcaaaacgcttcaaaattactcttgcaaagaaaatgccaaattatatccaatagctgttttgatgttgtgtcaacgcaacatcaggggcttatacacgattactgttgcagaatgctcccagaacttccgcagaaagttgctactcctacacgattcaaggcgatcaacaacgacagggaaagattgcaacaccttttgtcgatacacttttttttaagaaagaaaaataaaacaggaggtcagagttacatgcctaaaatgtcaataaaacaataggtaaacagattaacaacccacaggcaccaatgtcaacattgctttacactaggaacttctagtcttcaatttccatatactaccaggctacgaactacaatgaatcgctgccaagtgccaaaccagtcttcccatggtcagcaaggccatctaatgaacttcacactgataatctgcaccaaaaaaaaaaggggaaacattaagcaatcaatcgtgctagtaaatagtaatgaccaaatgggtgccttcatcacgtgcaacaagaagaacatgatccatttcaatagattaagcattttcaacagtttcaacagacaagtcaaacagacccctagagtctggaagtctattttatctttacctgcaagattcaatttatggtatcactcttgcatttatcacttgttactatattggtttaaattttatccagcatcttcaagttgtagtgacactttacaggaatagtagaacacaatggagttcaaccaatgatcaacaaagctcctcacggaatcataagatagccgagaaatatggatgctcaaaaagaacagacataaaaacatatgtaatagaacctgtccattccgatatgtctaacagaaaacacacaatacatactaacaaaggtctcagcaccaatttaacagagatagactagcaataacatatccaatgtggcttgtatctactattccagggccaagggtatgaattatgaaatattccatcatgaacaggccaggttgtcggtaaaagtctctagcgttcatgtgataattttgtctgttggaaaaaataacttcaaatctacaaaccaacacaccaatctctgcacaactgtcaaatcaaacttttccaaattgtgttgtaacaggaaaataggttttactatgcaatctaatctaccacaccagtacagacattgaaaagtaacaggcgtagcacatacttgagctcaaatgtttgttgtcaaaccatgcatatggaaaatgcaccattcaaagccactaacacactagcataaatgcatatatgttcatgagttattaagcccaatcaagttgcacttgaccttgcttcaaccttagcgaacctaggcaatcttgttcaagtttgtttactcattactaaggatgatagataatatatcatcaggacatttgtatttaccaagatagatgaaaatgccaaaagaccaaatatgtgtcatgctatcattcatgattggattaatgatacaaaatctaacaattagagcagctcactaccaggaacaaatgcaatgttaaacttctaactattgaaattcaattgcatacggggattatatggggggattaaaaatcctggcccagacacataatattcacaaaaacaacctttcctgaagcataccaatcttatcatcaatcaataaaaacatcatttcacagcatccccatcccacaggactatatgccagcaaatccaaagcacatatatataactacagctttataatattataactgaacaattatctattatccacaacaacattaattgaaaacaaaaatgctaggtcggtttttacctcaacatctcctcagcatcatatgtaggtggaggtggagaggaaaggcagcgcagcgacagaggaaaccaattccgctgcgccaataccatcgggtgcagtccctgcatgcttcttgatgcgctttgccctggcaagcttgacatgtgcatccacaaagttctccatgcgcttgacctccaactgcttcaggaagtctattcgctgccgctcaatctccagtgcctgcttttgcttcgcactctccacacgctcatacatctccgcaaatgcctcgatcgcccttgccagctccctgaaaccaccatcaacttcctgacggctgcgcttgttgctattgccggagcgcgatgacacagattgcgacggtgaccgctgcgcgttgtgattgttgttatcgccagggccttcagagtcctccgaatcagacaccgcggcagcggctgcagccgcggcctcctgctggataagagcggcggcggggagcggagacccgcgacggtagctgggcagcggcaacgccataggaggcggcggagagggcgacggcgaaggcgaggggggcttcctcaccgcggaaggatggatgggcatggcgaagtaagggggcggcggcaccggcgacggcgacggcgagggcctcttggaggcggaggcggagagggtgggcccgacgaggcggtcgagctcggggaagaaggaccaggtggatggcatgacgcgggcgcgctccgccttgtacttcttcttgagggtgtcgacgcggttcttgcactgcacgtcggtgcgcggcgggcggcggcgcgcggccgccccgcgccgcgagttgacggcgtccgccacctcctgccactgcttctgccgcaggttcccccgggtgagctc

SEQ ID NO: 93201 - DNA, 2902 bp, Oryza sativa
cagattgcagacttgagtgtttggcaggaagtggtttccgacggcaaaaagtcgacagcgaataatgatcatcatgaaccaatatctgctagactggcagggaacgtttacagttttggcatactgcttcttgaaatcatctcagggaaacccccttactctgaaaacgagggctccctggcgaatctggtaatcacagcagcctgcaaagtcaaatgcttcaacagtttaacttacacaaaagaaatccaattcaacatcagattaaagaaaataaaactgttttttatttttcttatcttacaggctttggggtgcattatcaaaggtcggagtatagcctccatgcttgattcagtactagagtcacacaaagaaaatgagctagatgtgatctgtcagataatcatggaatgcatccagagtgacccaacgaagagaccaggcatgagggagatcaccacaaggctgagagagaccatagccatttcgccggatgcagcaacgcccagattgtctccgctctggtgggctgaagtggaggtcctctcaccagtggagccaaggtagaaacaatgataaatgtgcttctgaaaaaccaacatcctgcaggatgacgatcttgctgtgcatactgctgttcgtgcaacctttaccttgtgcaactccctgcccatgtttgatactgcccttgtgcaactctgctgcaaatgtcaaagatgagtactttctgtgtgtcatactccatccgttttcaaataactgacgttaggcaataggcactaatcattttgaaaatttggccactcgtcttttttacaaaaaaaaaagagttgcaaatacgagaaggaatattgtgccacactatcataatgtattgcatcctaaaataagcatgatgctttaattcatcatagattattcagtctaactatttgagattaattagtggttaatatcgaaatagtcattgtcaaccgtatcagttattcaaaaagggaggtagtaataccagtgatgatcaggtaagctttggcatgcggttggtacaaccaagcagccaaatgaggagcagctaactgacaaagaagcagtaagctctgaagtccaaaacctttgtactccctccgtcctataatataagggattttgagtttttacttataacgtttgaccactcgtcttatttaattttttttaaattattatttattttatttatgacttactttattatctacagtactttaagcacaacttttcattttttatatttgtaaaaaaaatttaaataagatgagtggtcaaacgttacaaataaaaacttaaaatctcttatattgtgggacggagggagtatacttgtataaagcaaaagggcaaagtcagagcaaaactctatacgttaacatgagtcatgagagcaaggtggccttggtcaggtaaggccacgccgccatattcgacatagagaactccattattgacaccagaaagcacaatattaatctgacctcgtgagcagtagcagacaacagtatccacattgtcgcacactccgacttagcccccccaaaatgttcctatcctcacaagtcacaccaccagaaaaaccatatgccccatttttaatctgcagaacacatgatctgtgtgcgatgttcttgaagctacggactccatcccgaacatctgcagccagccagatggaacccagccaaaaaggcgttgctcaggtggtgtttggatccatgaacttagctttagtccatatatttagacactaatttagagtattagatatagactacctacaaaactaattacataaatgaaagctaattcgtgagacaaattttttaagcctaattaatctataattagagaatgtttactgtagcatcatataggctaattatggattaattagactcaatagattcgtcgctcgaattagtccaagattatggatgggttttattaatagtctacgtttaatatttatagttagtgtccaaatatccgatatgatagtaacttgaaagttttagtccaatctaaatagggtctcagaccggccaaaactcccatgtgcatcaatgatttttgatcggtttcccggctggtcatcgctcacgtcaggcgacagatatttccaggcccaaatgatcatcgcctcgtcagtttaattttgggtttgctgctgcaaattaatcgagcattgttagtagcagtattgaacgtagcattagtactctttctgtttcttaacaaatgataccgttgactttctaacataaatatagttattcgtttggtttaaaattttataaaaataaattatatttaaagtattttaagtgataaaacaacttcaacaaataaattataattatgtaaatttttaagtaagacgaatatttaaaggtgtgataaaaaagtaatgacgtcgtatgctgaaaaaatgagttatacatcattttcgcaagctcaaatcaaatcccatccatttcgtgcaagatttgggcaacgaacgattgccgatgacgtgacatgtatgaacaggagggcagtattgcagtagaatattgctcgcgtgatcgttgagaggggaaaaagaagaggaaagaagaaaaagcactgacctttgggcaggccaggcgggcaccccactggcggttgggccacatgtcattggctcccagcagccagccaccctcgccgcggcgtcgtgacgtcgtcgccgctcgcggccggtctcttctgctcagtggctcacacatgggcctcctgcatgcgcgccacctatcgcctcctcatacgccgccgcggcgcgcccccgcgaccgtccgttcgtcccgaatccacggccctggatccccttcttccgccgcctataaaa

SEQ ID NO: 93202 - DNA, 7934 bp, Oryza sativa
gtagatgcttctgaagaatcggaatcaacaccatctccaaagctttctgaacaaggagagactcttatcagctcaactgagtcacctgtatccaaggctgaggtttctgagcaactagcaacaccaaaaactccaaaatcactttcagcaacagaagaaaagcctagtcattctactgaatcacccacatataaaggggattcagaagcaccacaatctcccacagatccatcaacagcagaagaaaacagtggatccactgagacgggtaatacaattgagacgggaaaccaggatcatcaagagacaaaatattctggtcctaatgatgaagcgccacaaagtcagattggagaatctgacagaggcatacctgatggtacaaagccttcttcacctactgaattagatcaatcaggtaacacgggaacaactgaataccttcatgctggaacggaaaacatagatgataaaaatgccatacaatcacaaccactagattccattctagccagttcagatgatgtaaatgaagctgtgaaaattgttaaaggagctgatgatcgaaatgaaataagcagttcacatgagaatactgacaccgttgaccaagctagtcatgtggaagtcatagaacatgatgagcatactaatgctgctgaaaatgatgaagaagctaatcgaacagaagcacaggtagcaactgttgttgaaagggaggagaatacaatggtgcagcttgaagaccttagctcaatgtccataattgtgagcaatgattcaaactcgcaaaatgagtcggtgcccacttctgcagatgtgcctgttggactggtagaggttggttccaattcaaatgatttgagaaaagaagaaaatatccagggctctgttacaactagcaatcatctggaatctgtcggtgctgtcgctgaacttgagaaattaagacgtgaaatgaagatgatggaagctgcattgcaaggtgctgcaagacaatcccaggtatcatttccacgtggtctactagcaacccagttatgcttgtacggtcgaaactgtatgttgagaaaactaccacatgattttccacttgtaacaaaacttcctttagtttgtgaatgcatatttgttctataaatgaagatccataaatgtttctgtgacttatggaaatatgctctaaccctgcagaacgctagttgatgaacaatatctgatttgattttgatagtagcacaatgtttttctaggaaatgaactgctgctagactggatctatctgctcaattaattgcattcaagtttcattcttctatttttggtgcagcatttttactgaaaaagagaaataaacagagacacgttcatctaatattttccacatgctcagtgagcattcctatttttgtcttatattcttggaatgcattaaagcatggacagctatttaaaactcttgtctttcatatttgcctgatttatatgaggaaacaaatataattccatgagtatatgatgctcatatgtattcagcatacagtcagaggtttttacaactaagtgcatcttttacttccatattctatcatttctgcgcaacatacatacctgggcccttcacttgtctcacaacacttcttcctgcagtccaaagctgatgaaattgcaagactgatgaatgagaatgaacaactgaaatcaacaattgatgatcttaaggtatgcttgatagcagactctgtgtttttccttctctaaaaaggtatttaagatgttatatttagcaattgctggaggttttagttaatctgtatgaaactgaatgacatgaatattatacaattatcctaagttactcagtagtgctataagcatgtgatgaacttggattgttttgttttgacatggcacagagcaagtcagctgaagccgaaatggatgcacttaaagatgaatatcaccagagagtagcaactcttgaaaggaaggtgagacacgttatcacttattaagacagtagtccgatagacataattatgctaagactatactctggtgaagttcttaaatggcactgcctagttcctgcagtcaaagtagtaaattgtttatttttcaaagtagcaggatgctattttcaccacaaaaagttattaccatattaattgataaactattttacttgttggatgcaccttacatattcatgtatttatctaaagtcggttttatttattcgatacttaattctaatagtttggattaaagcatgatgtatttattttttaaatacaggctaaccacattctttcttggtacctagtgcatctaaaataagattattcttatcgctgatatgttttatatttgcatgcttcaatgtttataggtgtatgccttgaccaaagaacgggatacattaaggagagagcaaaataaaaaaagtgatgcagctgctcttttgaaagaaaaggatgaaattatcagtcaggtcatggcggaaggtataatgaaccaacattttctttgtctcttctattatgattgcgtataaatgttaaatttgcaatacacaatgttcgttccgttgtaatgttgagacagtttgaagtgttgatccacaaatatattgcactgtgccgaataccctctgttcataacaatcatcatgattacatcacacaagcacatattagcaacattagaactatggacatggataatcgtagtgcttcaccagtaaggttgactctggttgccattggtaggcaaataggcatagacatttctctgtgaaaagggcctggaatttatataggtttgctaatgtttcttcttatgccccttttatccagctttacactttagagcccatttgattttttgcccccttcatttttatgtttagtaggttttgaggcatttatttggcatcaacaatttttttacaatgaacaggtgaagagctatcaaaaaaacaagctgctcaagaagctactatgcggaaacttagggcacaggcatggactgcaactcttatcattaagcatattttgtgcaaattaaatattttaccaatttcactttcttccattttgttttctttcaggttcgtgaacttgaagaagaaaaacaacggctgaactcaaagatccaggtaaaaaggataccaactttgggtatctatgaacattatacaaattttcttatctgctttaatgatgaaaaatacttaactttactttctttgttagacataatgaaaaatatgtctatgtttgcaataacgcaaaatcaaatttgggcctcctttagctggtttgttctgtcgtgcttgtttggtgtataccataatactgtgatattctactagacaatcacttgcttcacctgtgtaactgtgtccaaactcatgatttggttacaacagatatactcccccacccttgcacccccaccgcccaaaatcttgttagctagatagctttgagacattgcttccatagaataatggagttacttcagcttcctaaatggagtacctatattcccagtatcatatctatttgctgtcagacattgagtgtagtaatgtatttagcacttttctgatacaacaggttgaggagacaaaggttgagagtattaaaagagataaggctgcaacggagaaattgctacaggaaacaatagaaagaaatcaaactgaacttgcagctcagaaggagttctacaccaatgctcttaacgcagctaaagaggctgaggcattagccgaagcaagagtcaacactgaagccaaagttgaacttgagagtcgtttaagagaagcttgtgaaaaagaaaatatcttaattaagacgattgaggagttgaggcatgctctcacaaagcttgcatgcctgcaggtcgactattaaaatatcccctgcattggtatatctacctttcatcattgtcagtagaaatagtcgacaatatgtgctgatccaatccatgccttaaggatttgtccagttaggagcctactaactgtagatactttttgggatgttccaggctgcattcagggaagaaaggctgaaaagggattatgatgatcttcaaaggcggtatcaagtaagcatggcccttctaggtttgtttgtatattgcactgtaaaacagtcatcagctaatacttactattattcgttatttaatacttcagtccagtgaacttcgttacaatgaactggtcacacaagttcctgaatccaccagaccacttctaaggcaaattgaagccatgcaggtactggtgcatttgttttctttcccttgggctgcaattactttgctttcttcaattatttggagtctggataacacttctgcaatttgtgagttgacctcttttttctgttgtgagctggttaattaattgtgtgctaacattaacaggaaacagctgctcgaagggcagaggcttgggctggtgtagagagaaccttaaactctcgacttcaggtctgtttgtgttctgaaattatctgtttaacagtgatcccataacagcaatgaagaattctagaacaacaagaaggggcatttgttattattgtagaatgcacatggttaatgacaacaaaagatattttttaaatgtacttgagagaccagtcctttcacattggttaaaccttttgtaaatattttttataattaatatattcttactgtgggggcttcccctacatcgcaatgatattggtaacactgcaatgatatggcaagcctacagactcctctagttgtggcggctaccttctgatttcgcttttttttttttaccaaagcaatcatattagtaactgccttgccttagtgcagtaggcaaaaattcagaaacactaaaataaatatctcaatgacataatactttgttactttgctctaatatgcaggaagcagaagcaaaagctgctgctgcagaagaaaaggaacggtctgtaaatgaacgtttgtctcaaagctcatcccggataactgttctagagacccaggtttgtgcatcaagttattctgaaataaatcactattaacattaccataggtttatggccaaggtttagttttagtcagaaaggtgacttcttacaaaaatattttgttcttatgcagattacaattcttagaacagagcagacacagctgagtcgatctcttgaaaaagagaggcagagagcatccgaaagtagacaggagtacctggcaattaaggaggaggcggcaatgcaagaaggacgggcgaaacagcttgaagaagaaataaaggagcttcgtactaggcacaaaaaggagctgcaagatgcagcagaacacagggagctgcttgagaaggtagccaatctgctatgctattttttttttcaggaaaagagctggatgtatgtcattgttttgattggtttggtaacttttatggtataccaatgttgtcctgtcaagttcattaatgtgtggagccttggggaaactgtttttaacctttttaaaccgaccatcagctacaggtccgacataaacattgaactttggaatctctcttacagtaggtccttctcaggatttaacaaaagggtttgtttatgtgtgtgggtactgatgatgcttttgtatttactatgttgtttaccgcacgaggaagtttttcgactccctctgatcccaaatataggttgctttagacttgtgcacatgaattaaggaagcaactccctttcatttatactgtataggaaagatgaatcatttatttattacttgtgagaagggtggcatttatttagcaagggcaaacagggaagaacagctgcaaaagtgcgtagaagttccataacgatttactacatttggaattggatggggtatatggcatcaatcatctcttctatgaaatggcgtagttgaccataccaatcaataattgtgatcaacctacttattttctggtttatacatgaccaactcggaagaatttctcgccttacatattttattttacgaattacgttttcaggaccttgaaagagaaaaggctgccagggcagagcttgagaaaacatcttcccgtgatgcaccaaaaattccgcttccagatcagacaagtatgctgtttattcgtttttgactaatttgtacgagttcaatccaacttctttgtatctgttgcctacttgccttacctgtcgtttgtttcctctttgcatctcatgaaggaaatgctcctctcagaaagctctctagttctggcagtatcaatagtctggaagaaagccatttccttcaagcatcattagatttgtcagacaacgcttcattagagaggagaatgtctgctgaaagtaatatgtcgtattatcttcggagcatgactccaagtgcttttgaatcagcactccgtcagaaagatggagagctagcttcttacacatcgcgtttggtatgtcctttggagatttcctgaaagtactaattctcattttggatatttcttatttaagtacccttgcatgtgttcttgttaattttcgtcgtatttgctattagttgagcttgctggtgttagcacgacatgcacatgcccatcactgaactaatgctactctatattacaggcctcattagaatctattcggaattctctggcagaggagttggtgaaaatgactgaacaggtaaatcctgatgaaccaacggaagtttttttattcaactaccaacatgtgtgcaaactaaactaaattttttcaatgcagtgtgagaagttgcgtaccgaggcttctgctctgcctggtttaagggctgagctggaagctttgaaacaaagacactttcaagctctagaactaatgggggaacgtgatgaagaggtacggcttccctagaaggcaccatgactttatatttgattattttctatggtatataaaagaaacctttttccatgaattggatttatatggagctcgtatactggaattttttataaagtccctatatgatcgccaaacccacaattcctgtgccatgtaggttgcgtagctaccatcttttaaggcacaaaaattatctgaatagagataaagacaattaataagcacatgcttataaacctttacctgttatttcgtgtggatttgctctgaatttctgtactgtgcttgcagttggaagagctaagaaatgacattgttgacctaaaagagatgtacagagaacaagtggatcttcttgttagccaggtttgaagcttatcagttgaactttattttttcatttgataaatcgttgttgccataagtccctaacccccggcttccattttatcagctccaatctttgggtgctcgtgtatagtgctgctgtatgtcagtatgtagcttcggctgccatccatttttttttcgcatcgcgctaatctactaagccccatacagcagatctgaagcttggcgtgtttcttcgaaattcaagccgtgacaaataccgaaagttcatagccataccagtgtgaaaatattcgtttttgtacatcttgaagcacaagtctttttggacagttgagcacccttgtttaatttagtaggttactctgttgtatactagtttggatagctttacggtttttaagcctattgtttgcaattctttccagtgaagtgtatcaaatttgtaattcgattaaaagtgtatcacagcggaatgcaaccccaataatatgagagctcgtttttgtcattttcctcaggttcgaccattttccgtgtacctatcatatattcatatgtctttgtgtgcgaagtataaaccgcatcataatgatgaaaaaaaatcaaaaccaaatctgttctattcatatgtctttgtgtgcgaagtatcataaagga

SEQ ID NO: 93203 - DNA, 1059 bp, Oryza sativa
ttttctcagatgtaacatattgttgaccagacaaattttctggattagcactaaattcctgccttacaccgttcctttcatgaaccacgctgcaagcattaggctgactctgctgatcgacaggcaactcgttgtttactaagctgccatttccattactgtctttaacaaggttatgcaccggtgtaagattactttcggcgagagtattttgttgatctacatcggtctttaaacccataccagaatcatattgcattttactagaaaattcctccctcgaacgtcttttatcaagttgtgcttctgcccacatttgctttttcaaagcacttgctgcctccagccgttcctgcaaagatccttttggttcagatgatgggaaaatgacaagatatcaagatcatgcaagataattacctcaagaactgcacgtatagaatttccttcagtggcaacaccaatcaatgcaaccaatgcattgaggcgctcctcaacactgagatcacagtagtcaccctccgctagcccctgtacccaggactccccctggttactttcgtcaatctctgcgtcttgagcactgtcggaagcaccttcatgattatccgatgagatttcagctggtagatcacttgtagtacggacttgtacagacttgtccagagtgcgcaatgagctactctcagaagatttagtgtggatgagtggtgtcgttaatgagttaactatgctatttgtttccttctttatgtcaccaactgcagttggcatgccaccatcttgtgccttaaccagggaagtcttgacatctttttcctcaatattcacttcatcaccatcaggatcatcgtcagcatcatcacactcagaatcttcatccctctcagcatcatccacatccttctccacttcttcacactcagaaatagtgttctgaaacacccttattttttcacgtgctgctgccaacacagcctctgaatcagcaggatctttcctgtatggagttttaacacagtatgttgaaggcgcagtcctttcgaaaagctttgaatc

SEQ ID NO: 93204 - DNA, 622 bp, Oryza sativa
atcttaagaaccgaattgaagcctctgtggtcatttggcagaggaaaatggtgcacaaggaaggtaaattgtcatgggggcatggtgtcaaatttgagaagcgggagaaatttgaagcaagagcagagaatgtcctcctcctcatcaagcacagatttcccggcattgctcagtcagctcttgatataagcaaaattcagtacaacagggtataccatgagaatcatctgcttttcatgttgtcttttcggatttgctacagtacgtatgtttactcattgcaaaaattctctgctatttttccccctcaggatattggcttggccattttggagagctactccaggactcttgaaagtttagctttcacggttatgtctcgaatcgaagatgttcttcatgctgactccctcgcgcaagcttctaatactagaacccaagaatcaatgagaatggccagcttatcaagatatgacactgataaggttgtcattgatgctaaggccgaggtagagagactgggaagaatggaaccagtttcagcgacactatttgactttgtcagtcctcgagatcaagatgttgtggcgacgaagatggactcaaaagaaaagggatgtag

SEQ ID NO: 93205 - DNA, 668 bp, Oryza sativa
tcgatcaaaacctgttcccataggttcagtttcttgtttggtcttagcaggagtatatcttggcggaagcttctgcatagaagtatcaacacaattacacaaagggacagctagaagggtgtgattcaaaaagaacaaactgctatataaatcacatttaatgaatgaataacagtattttacgctatctatttattttccttgcgtaaaaacctcaatacaatgatcataagaaataagactcaccatgaactctccagctccccgctccttgtttgatcccaccttctgacgaagagtgtatgagatggcagaatctaggtctaacaatcttaagacaacagcagcaacagtgtcaggaacccatggaagtacatcagcagatccagaacgtggaacagtatttcgagaagctgaatcttgcgtgcttaaattaagtaactcagttgttgtctcaaagtcagatgacaagaaatcccgtcttatggcaccttccagaatggttagcatctggcaaagcatgacaaagcacaattcagaagctgataggcatagccaatatatacgaaaaagctgctatcaaattgccaagatttccattttaaaaatcaaagcattaatcttgcagaatcaatttgtcacggcaggttttttaacgacccattctt

SEQ ID NO: 93206 - DNA, 706 bp, Oryza sativa
  unsure (1)..(706): unsure at all n locations
aaacagcacttgtaagaaggttgtgttacctttctaacaaaaggccaaatgcctatctttccatcaaaagtgcagttaccttcatcatcaaacctaggtctcgcaaccgccgacaagaacattaccttctcaattgcattcttgttttggacagtcctatacggctccggctcaagaggatgtaggtagtaagtcttgtcctttttggtggcgttgaaccatttttcatctatgtggataatgttttccatttcaataaacttggggttgtttggcaacgtacgatggtctaacataccaacacaccaccgcagcctttcttttttattggcttccttcaaataaggcttcaatgagttagagtgacgtcgtagatgcccttctttgaacaacctatgcaatgtgctttttgacacacctagcgcttcagcaagtgaccttatagtgcttctttgccgcaatggaattgctgctacaactgacaaatctatttcaaccttcttgcgcccacaattataacgcttccttgagtcaacattgacttgtactccctgtgcaatgcanagttgtgctctcttccaaatacgttggactgtacggatgctcacattgaacacttcagcaactacacgtgtgctgcctttttctaggtatccatccagactttttgtaagcaacaattcataaatgcttcggctttgtgggt

SEQ ID NO: 93207 - DNA, 684 bp, Oryza sativa
gtgcacttctctgcaagagtagagctcaagggatttcgacgacttgatggacagattcgatcggcctcgctgaagcagttgtctatcatcaactgctttatctctgttgcctttttggttgatgctccgaaccttatctcgctctgcttcatcagacctctcagctttgagagaaccaaggaatccatttgctcgtctgataatcgtaggtggccatccccagtatggaaggatgacaacgatggatttgatcatggtgatatctttgcaattgctagtggcgaacactttgatgataagagagagaatgaatctgatcaagactatggttttgatgatggctctgatgataacatagccagtgaatctgatcatgatgatgatggtcccccttccccatattctgtttcctacgatggtgacaatgaatgcgagtcttatgaacccggcaataaggaggagtctgatcgtacagtggcctatggtgagattgcagatgagtactccagtaatggtgatcccggtgatgaatatcggggaaattatgtgaaccatgattctgcgaattacggtagagctaataagtttggaaatttgaacttcccagtgaagtcaattgtggatgcgtcagctcatgaaggagaggtaatatttaatcaccttgctgatactatcgtgttctca

SEQ ID NO: 93208 - DNA, 1542 bp, Oryza sativa
ggttcgtcgaagtcatgcttgtcaatcattatcactatctcgctcgctccatgtcgaagttagccttctatcatcaccagaagctccacgtcggagctgatctttgtcatatcaccagctccccatcggagttgacatcatcatcaatcattgaagggccgaagaacagtttgtgaaggtccttcatctcgtcatcatcaccgtctctgaatcagtgaagagccaaagaacagtttgtgaaggcttttggtactaagggctgaagaacagtttgtgaaggctcaggtctacttcattgaggataggatggttttctcttcttctaattcattcaagagcaatgcttcgacaacatcttcaaacatggactttgtattaatagtagggggtcatttatcttgtgtttagtttcaaatgcaatgctattgtatacacattgcatttgagcaggggtgttgagtattatgtgtttaggggtatattagtaatttcctatctctattgtactcatatatgccctttgggctaacacaatagcaactgttcattctccaatttcccccaaattgtgacaactcacactggccacaggcactattgtgcttgatgattcacttttatgtgctggttttgattaccagtacaaagacttcgatgaggatgcaattgatggaatcaatagcgatgatggtgaaggttgcacgagtgattctgactacgatgatagtgacgcgaatacctgtgaatacagtgagattgcagatgactatgatgatgaaaaacaacgtcaagagcattgtgaggggcataatccgattgatgattatgatgatgaaaatcaacatgaagagcatggtgaggaacataatcaaattggacttgatgaagttcttggtggccataatgttcttcacatcctatcaaatgctgaaattttggagctattagctgatggtggagaggtatagctatgaatcttcttctgctccctgttacataacattttcccttaatgcggatacattaattattttcatcattacataagaaaaaagctttctcaatttctatgcactgaacaaattacttgtatgttctatatgaaggtgattcttaatagagcgctgaaaacttgcccaacttttagaaacctgaagacgttgtcccttggtgaatggtgtatgggtgctgactttgatccactagttacattcttgcagcattcacctaatctggagaggcttttccttgaacttaaattggtgcgtgtatttatattataatatatcggttgcttgatgcttcacatttttcatattttgacacgtgagttttagcacatgtccattgataatttatcttcttctgcaaacaaaaacaaaaaggattactacagcatacaggcaatgaaaggagttaccaaagcagtgggaagatcatttgtttgcacacaccttaaaatggtgaagatcaaatgttctatgaatgatgctagggtccattggttggcacagttgttcaggactaatggcttacctattg

SEQ ID NO: 93209 - DNA, 1681 bp, Oryza sativa
atggtaattgaaatactgaatcaacttcacatcatgcatacaagtgatattcaatacattgagaataaaaacaataacttagtgatatattgtgagcagattatcacctactcctacaaagtgtattttcttgaacaaaattgtacagatgggaatttctatgggaatcttaactaatgtcaaaagataaattattgtgacaacaaaaaacagcaagctatttcaaaagataagaacaatactttcccaaagctgcaaacttgagggttttaatagtatattgaatgcctaagacagatgatgggaaacccagaatgcctccactagtagctattgttaattgatactgcagtgcagaagtatcagatgtgctaactggacacccagagaccaggtgagtggtaaaagaaaaactgtttcttcagcatgttgaaatggtgattgcatacctctccagcaccagctaacagctccaaacttctagcatttgaaaggccgtgaagaaaattatggccaccagaaatagttttagtctgctgacttgtcccaactccctgaacaatggtactggaattctgggcatactgctgatctccatactcttttgcaatctcactatattcataggtattgtcatcactctcaatatcactaccatagccataatcatccttgttaccagcaagcccatatcctttttgagggaaaccaaatccataccctgtcttgtaagtcttcttctgatcatcaatatcatcttcatcagtggtttcatcaatatcatcttcatcactactgtgttcataagcatcacccaagaaaaagtcatcaagtatgacagagcatgacaccagcgactccaagttcttgaacgatggaacttggatgtaaggtgtgatcagattcagcaatacgaggtttggagcagtgattgataagtccacattaatcttgcacttatccatcttcaaaatcttcaaagaagcagatgagatctcatggccggtcatcgcgcagtccttaagatccagttcttccaaagatttgcaccctgaagaaagctgcttgaggatcttgtcatcgatcaggacataggacagcttcaagatcttgaggtgggtagagaccaaggccctgtgctttaacaccccgatctctgtacggtgtccagtgagatgaatgaatcgagcattgcggttgatggcagtccggatccacgcgttggcatcgtcgttgtcaaacaactcgtccgggtcgctggactgcaggcggagcgtgtccaccggcgctgacgcctccctacggcggaagaggcggttcacgaaatcgcgcagctcctccggcggctcgctgtcaacgtcattgtaccggacgcggaggtcgatgcagggcgcggacgcccaggtgtggcgccagcgacgcgagagcacgcaggtgcgcaccacctcccaggccttgaggaacgacatgatgtggtgcagcaccccgtccgagagggcgctgagccggtcaaccgcgtcgccctcgccattgccgtcgccttcgcttccctctccacgccgggacgtctccccctcgccacggcgcggcggcccgagcatggcgtttctcccgagcattccgccgaacaggctgcgcgcgccttctcgtcgaactggttctcagtaacctccaacctccg

SEQ ID NO: 93210 - DNA, 922 bp, Oryza sativa
aattcgagctcggtacccaacttgtagctgggtagtttatgtattcagacagtttttatcagcatatgttctgatgcgattggattgctggtagttataaaatccctgtgctatctttgtagggcctcctgtttgaagagccttcggctcatctcatgcttgggtgtctcaaatgaaggaattgaggaggcaacaaaggaattccctcttcttgaggagcttgagctctcattctgctacaatgttactcatgaggcgtatgcggctatcggcgcggcatgcccacagctcaagcgcttcaggcttagcaaacgatccttctatgattcaggaggtatccgctggaaaaacaacgatgatgctggtggaatttcaaagatgcacgggctacgctccctgcagctcttcgccaataacctcacaaatgaaggtctctcaaccatcttggataactgccccaacctggagtctcttgacattcgccattgcttcaacatcgacatgggcgccgactccctgcgagcaaaatgtagcaggatcaagatgctgaggccacctgatgactcaactgatgactatgacttcgatgtgtacactcccaggaggctccccatctcccccggttttgtgcggtattattcggtgtattctgatccggaatattccatgtactcggatgaatggacgtctgaggaatttgatgatgatgatgatgattattccggtccttcccgctacgaggaagatcttgacaagtatgataacgcgcttcccaggtgcatgaggacgtttctgaaatgaagaactgcatgatttgatcaatgcgagtggaatttatgttggagttcaactatttttttctgggaatattttctccctttagattcatgtaagttcgttctgcactcatgttagttgatga

SEQ ID NO: 93211 - DNA, 4163 bp, Oryza sativa
ctaatgttgctctagatgcgacgatattcaatcagttggccaatgcatgcccagcattgcaaaatatgctgctgacagactgcttactggaggtagaagaaatttcatcaagctcattgaagaatctggatataattgactgctatattctcaaggacctgagcatttgtactcctagtttggtttcattgtgcatcaagaatgaaagaacagacaattcttcgttcagaaactcttacctaatattcgcaacggccattatcattgatgcttcaaatgtcagtagcatggagttgttagctatggatagacaggtactgtactgcttgccctgtagcactgatcctttctcccaaacactctgtacattactatttgtttcatagttttactatttgtttagtatatgcatttgtacattactatcatacattttcatgtgaatatatttatgcaaatgaattttctttcataacaaggacacaacataaaacattcattttgcacggtatgtatatacccgatttcaaatcgacacatacttctctgaccaccttttttaccacaattgttttggatttcatagcattaacagtatttaagacttaagacatgtttttttcctgtgtacatatgaagttcacattcgtggagaaagacgggggcgagccaatgttcaagaatctcagaaacttgagcctaggtctatggtgcattaacaacatgttttcgcctctacgtcgattcgtccggcattcgcctatgctgaggatggtgactctgaggatcagtccggtcagtgccatccattgcattgcatcatccccatgcttcctgtgtccagcttctttttcttttttttttggttactatcattgttgaaagcctagagctctaatgatgctgcaaacctttcaacttcagctggattggaagtcccatctcacgaaggaacatcaggagatgctgatcagcattcgtgatcgtcgtggcctgattctttatatcgattggtattgaaggccaagggcttctgcggtgctccaatggtgaataaaattgctgccaaattaagctggttgctgaaacattgagaccaatttaagtttcttttcgttttaatcgcagtggatcaaacttgttgcagtaataattacctgttacttgactgcatgtgtcagcctggagtctggatgttgtctttgatgtggtgtcattgttacttatactgtttcattatatggatgaaccaatgagtctttaagaacctcatatcataattcacctgttagaattcatgcttgcttagtattcaggtaatgtcataaatctgcccagtttctagctttgcggcatcaaacattttttttttcaaacataatgatcctatttcacattctggaacttttacttctggtaactgtttgttagttctggccaactgacagccgacgctgtcaacttggcgcggatactggtaacattttgtggtcttgttttgatatgtactcatatttcagaatgttttgtgttttgatttgtcctaagttaaacttcatcaaagtttgaccaaggttataggagaacgttttttaacaccaaaaaagtatattataaaaatatattcaatggtggatttagagagattaaattgtgttgtaaatgttttataattttttttataaacttgaagtaatttgacttaggataaaaccaacaccttacattctgaaaggaagggagtagcgattagagttgattccgctgaactaatattttcacaattccaaagagattaagcctaatcatggtctatattttcaggcgagttatgaaattagtttttcattcgtgtctgaaaactctttccgacatccggtcaaacctccgatgtgacacccaaaaattttcttttcgtgaactaaacagacccttagatgaaagagacacacacactactacactcaaacacatccatagaaccttcctcctcttagtcaattgttccaagctatttattagatttattgtacataatatttaatatttagtattcatccctataaataacactatcatccatcaaccttttaactgcattccttccataaagaaaagaccccagcatgactttttaccccctccgtcctagccaaaaatgcatgtcttgaaattagaacactgtctatatagccaaatccccaataatagaatgagaagtttcattatatgccacctttgctgctgaggatactaattcttgttctgtaccactccgtcaattctagcgcgctgtccgccaacgtttttctgcttcctctgtcatgttgctgggcaccaccaccgtcgttgccgctcagtactgccaaaatcgatagcgtcaacctccccctctcatcaccctcctttctccgatgtcccctccaattttgcattctcttccccttgctgcaacctactccttgacccccaaacggagcccaagccggagctccaatgaccaaaatcaacctcgcagctccaccaggtatagctcctcgtgaaaaacccaccctgcatcgaatcagcgacactactagtcatcactattagcagccactataacgatattcacctgcaagctccacaacctccacctctttcaccgacaagctgaccagcaagttccgcggattatgttgtgctgacttcctcagccttgacaaggccgcatcaaccagctaccgcactccacgggtgcccttcgatgggatggcgataggagggagcgattgggagagggaaggggacgagggtgtttggaaaagggtggtgagaggggggctcgatgatgcagcaacaacaggggcaacagatggacattgatggactagcgtgcttggattgatggattgactcgaaacgaaagaattcgcatactcggcgataaatgataaaagacatgcaaattgagtggcaaaaaatttcgagagatttgcaatttgagtggcgtgtaataaaatttcttaagtagaacttgaagcctctcgtttgctactttttgtcatgcagattttcatcaaatttggatgaaagctttacaaatagtattgaataagatgttttccctttttttttcttcggtatctataatatctgatgaagtttaggccgtattattttttatctttaaaaaaaaaacctgaaacccgtcctggtgcttcgaagcaggcccgtcctcgattcgccaaaaaagcaagtccccaatctctccgtgagttctcttctcccacctcgtccccctcgatcgcctgctccggtgagaattctcgcgatagaattctttcttcttggttgatttcctccttgcgcgcgtgatgctgtcctcgtagctagcagaatcgcgctttggtggttgatgcggtggatcgctgtttccattgcaggcaacctgttcgacggaatgcagcagggagcggcggggcaggctgggccgtcgggtggtggtggaggcggtggcggtggcggtggcggtggcgcggaccgcctcagcgcgctcccggacgcggtgctcttccggatcgtgtcgcacctgggggcgcggcaggcggtgcgcacgagcgtgctatccaagcggtggcgccacgtgtgggcgtccgcgccgcgcgtcgacgtccgccacccctgcgcctgcgacgagagcgccgaccaggagaggttccacggcttcgtcaccaccatgctcctcaggcgccgcccgttcgcccccatcaaggcgctccggctgtgctggagccacgacggcgacgccaacaactggatcgctcatgctgtcaggcgtggggccgaagaaatcgatttctccgcgaggcatcaccaagatgatccgaaaccggagctagagtacacgagcttcatttctcacaagatcaagatcttgaagctgacgcgtgtccggatgggcatcaagtttatcacgcagatctgctataggtgcacttttttggaagaattagagctcaagaatgttaattcactgaagggcagattcaatcgacctcgctgaagcgcttgtctatcatcaactgccttatctctgatggatttttggttgatgctccgaaccttatctcgctctgcttcttcagacctctcagcggtaagagcacggagggagccaatca

SEQ ID NO: 93212 - DNA, 6253 bp, Oryza sativa
ctgccgcgcgctcctcagcgccgctagctgttgcctaccgcgcgctcgctcgccgccgctgccactccgctcggccgacgctacctctccgcctgtcgcgcgctcgtccaccgccgccgccgccccgctacactccgccgcccgccatcctcgccatctccgccgctgtcgacgccaccccgtgcgagcacgctctgagagagaaaagagagaggggtgaggagagatataggagatagagctgacatgtgggcccaagggcatttttgatatttcacatgatttatctctcctccccaaccggaaagtattattttaatcggcgcggtgtccactgataaattaccacgtttatgaagtgttttcccccaaaagttagtttggacagtgttctagggctaaaaccacacataacaagtctcttgtagcaaaatttgcccttgaaaaaacatcatcgatgactcaattgtacacctgcacgtggcagccagttgctttcatttcattttttactccatgtgtcaggcatacagtgcttcttaccgggtattacctatatgaccagatagtagttatttatcaccctcacaatgcttcttatcaggtagtaaggatacattgaatgcctaatacttgatttctagcaacattatggatgcccttagccagttattgtacccactctgacaaactctccaggcacttttggcgttatcaaattgtttttaaatctgagttaaaaattttttaaatctaagttgaaagtttttaaatcttgacttaaaaatttgcaaagctaaccagaaagttttcacatataagtctaaacttttaaatctatacttgaaagttttcgaatctaaattgaaaagatttcaattcttgatttcaaaattttcaaatctaagttaaaagtatcttttagtcaaaaaaaaaaagaaaaaacacgcacgggaggaatgctttttaggaaaaaagaaaaggaaagaaaacagaaaactcgcacgggaggattttttttcttgatgcggaacgaaaaacttaacagaaaagagaactcaccgcttcctttgcatctggtgcacgctatgttgaatcctatatttttacaaatgctatattgtttataagttgcatgcgatatcgcaaaatgtgagattttggtagaactcttatttggtgcacttatcctccgtgactattgattaccttactgttggcacatctaggatgcgttgtgatactgtccaagtgccaacttgggtatattcgcgctactaatatagctattgcttagccatgcttagagtttcgtatgttacaaatgatggatcattcactcttcaaaatttgggctatttaaaaatattggacagaggtgttgcccctgatatttgtgaagttgaaaactaaaaagtggtgattttagacttgggcggcaaatgttgtgcatatggtggtagttacataccgatagggggagtgttcacccgagtcgattaaggaccaagctatgtgtcaccaactaaaatatatcgtgcaaccacatgtgttatttatggggtaaccttagcctactatattgcttattacttaaccttgcattggaaggtcaaagtagtagggactagtctgagcgatggttcataggagctaccattgtgcctctatggaaatggagtttgttccccatatgccttgggcgtctgagcatgtccaatataacgaatggtgcctcgttaagggaacggatgtgtttgcctcgcgatgttgggattaggatggggtccacctttcgtagcaacattggttcatggccaatgtggagaaacactctccgtgctcatgcaagttaatctttgagtaatgtagtggtttcgtcataggctagcaaaaacgggtaccggttggtatcgcatggcatggttaacatgattgctagtatatgtcatgtgggtatagtgtacaaactctgtagagtttaaactaatcgattagccgtgctcacggtcatgagcgacttggtgaaataatacaagtttagtgttggtcatttaatacatgttttgtgaaattggcatggtgggaaattggtgatgattttgttcggtgtgggttgagaataaaatggttacttgctgccatggagggcacaaggatgatattaatatggtgcttatgttactattactattttttatttattgctttataaatttcgttgcaatatattattacttactattgtgaatcaaaatttgctttatgctgaaatttggtccacaaacatagcctactttgatctcaacttgcaaaagacataggcttgccaatacgtttgtattaacccacctcttgttgttgtttttagacattgatgcaggaaatgatatgtctagtgacgcgtactttgcaccgggtatcggaggtttcgaggatggttatttctaggtcggttgcctgtggtggtttgatagatgggcataccgaagaacttatatattttgttactgttcccgctgcgtctaaactcttccatttggccggtcagccctatctatattgtatgacttgtgcactcgctaaattatgtgaaccatgctatctatttgtatgtgtattatgtgtggatgtgatgataaggttgtggatgcatgtactagccactgattctgggagtagtacgttgtacgctccgagtattcgggaattgcatccccgggtgccgacaatcaatatgactcacttaattagaatatactagtacgcgatgtgaagttggtacataaaggaggggggtgatgcatattatttcttgattttgtggatcgagagaagacaagaaggtagaaatgaacgaactctatcaaggagaaggtttgagaggttggttttgtccatctgtgtatcgatccatacattttttttatcagtcgatccttgcagattatctcccctacccattatcttcaggataattatctccaggattgggaggagataatctttagctaccatatcccaaacccaccagaaaagaaaagaaaagctatcacatcaatgaaggtatcgaccagggaactgaaaattaatactgaccaatataagtacctgaatattgtcttttaagccttaacgaaactaatatgagcttgaatatcgtcctcaagcaatatgaaaactactaccgagtaaaagactgccggtactttctgagaactggagtaccataggttcaaactatcaattgacagacatgggacatgcaacgcgagcttcagagagttgagcgaaaaaggcgagcatctaagcacttcacttcctggctccacacttggatggaattcacatcaggagcgcacgcaggccattgagcatcatcctggcttcatcatccagctcgtcctcgttgatatcatcatcaaagcattcattctcctccgagaacacgacgcagtgaaggccgggaaccatgtaaccgtcatccatgtcatcagaggaattgcctgaatctgcaaaaacagggctgaaaacctgcaagtcatagtcatcgattgagtcatcggggagcctcagtgctttgattctggcgcacttcgctcgcagggtgtcatccatgaagacattgaagcagtggcgtatgtcgagggattcaagatgggggcagttgtcaaggatggcttccaatccttcattggtgatggtattgccgaaaatctgaagggagcgtagctgagtcatagttgctatccccagggcttcatcatcatcgtgcgagtcttcgaaactgtgaaagccatgttgactcagtctgaagcgcttaagctgtggacatgattttccaacagtcctgaacacatctgtcccaaaaacatttggactgagtgaaagctccagctcctcaagcagagggaacttctttattgcttttccaaaccctttgttagagacatcataacaagagatgaggcgaaggctcttcagacctggtgctctgcaatggtagcagaagttggatattaattaacaacaaatgaatcagcgaatcaaataaccaacaagaattctgcaaaaaataaccagcatttatttagctgcacaaatgcaggcatcgtagagaagcggtgtacagaaaaaaattggcctgtcaatgattaaatttataaaactatcagattttgtccaaacatatttaagtggcaagaattggctggacgctggagcctgcagttgactggagagagtagcataaatactgaaatttggcatacattcaactgaattcattctgtttcaggattaaaatattttaatatcatctccaatatgtcgtttcaactggtaatgcttcaaatcccagaaatttactcacatctgcattctacttcgaatagaggaagagacatttcctttgtctctaagctaaaatgtcaggagcctattatcaatgcaatacataaatacaagtgtgccagtaagtttaagagacaacgatgcttttgtttttcagtgtggatgacttggcaagtggaacatattagaaagacaatcaaagatctgtattatctaattgcggtgtgaagggaaattcagcagcaaattttgaagaatgttacagtgatgggttattcctattgatttacccacatatttgtagaatacttcttttttttcttgaagtttctgggcctaggatctaatgaaagtgctcaatctggtgcaaccatgagaagccatcaccttctaactagtagtaaaacattgctaaaatttcgatgaatgcgcacaaaaaaacagccatatacaccaatggttaggacagcattgaaagatgtaacggtaccatgaggggattcggaataatcaatctactatagtatccatgtaaataaacaacatgctcctaatgacgaaaacatgtctaaatgtagtcaaatataatacaccaaaaatgaaggcgctaattaagcgtctaaatgtagtccaatagaatacaccaaaaatgaaggcgctaattaagcattagaccaggagcagaaatgcagatttgaacacggggtcttccggctagctccacaaggtggtgggctagacgacctgggttcgaagcctcaccccttctaattatttgatattaggtccttccctaatattcgtggttttttttcagatttgaacacataacacgcgtttgcataacgaatataaagcatgtaattaaaggcccgaaaatcaggggatccccccgcgacgcgaacacaatagcccaccaaataattcaaaccaaagcatcgcaatctgacgaaacgcaagcaatcacggaggacgaatcatgtaaatgccctaacaaaacaaaaaattaggggattgaggggatcgaggtctcacgcgcggccgaggaagaggaggaagcggtcgcttccggccgactcgccccagaacgcctcgcaccgccccgcgctgcgcttgacggcggcctgcgccatcccgtggaggttcaccccccgcttggcgtcggcgttggcgtggccgcgcatgtcgacgcggcgccacaggcccggatcgtcgcgggccgcgcggcgccaggagcggcacacctggccggcgcccgtgaggatgtcgacgtggtcgagccccccgaggacggccgagatcgcggccggcggcagctccgcccagttcctcgccgcctacgccttcggtgcccccgagccgcggccccggcggcgattgccgtgatggcctcggcggcggcgggaggaggacggcatcgcgtcgcgcgccgcggcggggattgggattgttagggtttggaggaggaatggaaggcgggaggggaggcggttttctgggcgagtgtggggtggagtgctgcgtttagtgttgagagataatatagcaactagcaaggcggtttctatatttccggtagtgtagaattagaaatggatattttaaatatagaatttcatgcactgttcctttctatatataattgaacttttgactttgggtattattgttcctttttcataaaggatcaaaatatccttccacaatttcacgtgcgcggatgacatgaaaaaaaggttggataataaataagggcatattgagaaaaaaatctacacaaatacagagggcaagtacgttttaaaagaaagaacgggattgctgtatggcattcgaatgaaatttggggaagaaatcttacggattttggaccattggatccatgccttctcgtgcatcg

SEQ ID NO: 93213 - DNA, 1893 bp, Oryza sativa
ccgaggtggaggattactccacgtgcgatgtcgatgcgtggatccgtgctgccatcgagcggagagcccaggtgatccatatttctcaccatccgaaggacgaggcatttagtaacttcgaccatgtccccatcatctcctgccacctcaaacacctgaagctgtctggctacttgtttcgacaaaggacactaatgcagctctcttctcagtgcccttcattggaagttctagagctcaaaggctgctatctggatggccatcagatatcatctgcctctctcaagatcttgaccattgtcgagtgcaggatcatggagggcttcaccatcgctgctccgaacctcgtatcgctgtgctgcgtcacgccataccaccgtgctcccttgtttgagaatgtggggtcactcacactggatgcagccactatcgtgcttgatgattcgtttctatatgctggttatgaatacgagtatgaagacatcgatgaggatgcgatcgaaggaaacggtagcgaagacggtgaaggttccttgaatgattctgactacgacagtgatgctgtcagtgatgcaagtacctgtgaatacagtgagattgcaaacaactatgatgatgaaaaacagcttgtagagcatgatgaggtacataatcgaagcaaaggcaactatcatggctatgatcacaggtataaagccagaccatataggggctatcgcaagaagaaattcaatggtggtaaagttctaggtggtgataatgttcttcacagcctatcgaatgctagaagtttggagctattagctgatgctggagaggtatagttacgaatcttctgctatgtggcaataccccttaatatggattcatcagttatttgcattgcagacacaaatacctttctcaacttcgtcaaacctccgtaggagtattgcacttgagtgtaatcaaattttacgaagtaaagttattgtataataaaaatgtgtaggctgctgacagtttttttttttgtcattttctttagaacgtatctactaactactaaagagttactaagttttaattttgcataatcacatatttaagcacaggtgttgttctgtgaaattcgtattagaaaggtggttttttttttcattgctgtgagctgaacttttgtgattgcaacagttggatacacatggaatttacatatgtgtatcttcacactattcctacacatttttataccagaaataaatttgcatttttactgaacggtgctggtccttggtagtatagcaccaagctattctttaccttttctaaacgctgaactaattcatctgtgtgtgccatatgaaggtgattctgaatagggagctgaaaacatgcccaacttttagtaacctgaagacattgtcccttggtgaatggtgtatgggtgctgacttcggtccattaatttccttcctgcagcattcaccaaatctggagaagcttttccttgaacttaaattggtacatatatttatatctgtcgaatttgcttgatgctttacacttttcatatttcgacaaatcaattatagcacatattcactaataattatcttcttctgcaatccaaaaaaaaggattatgacaacacacaggcaatgaaagaaggtaccaaaccaaagggatgctcatttgcttgcacacaccttaaaatggtaaagatcaaatgctctattgatgatgtgagagtccattggttggcacagttgttcaggactaacggcgtacccattgagaatatctttgtgcgtcagactagcagcacttgtgagtgatacttctcttgtaactctcatctctgatgaagttgcagtaccgtcatacattattactgtttttgttagatggaaa

SEQ ID NO: 93214 - DNA, 852 bp, Oryza sativa
cgaaacaagaaaggggaacgaacagaacacgagcaaacagcaaacaagctagcggagttcttctagcgtgcgcgcgacgcggagagggtgtccgccatgcgcagctgcgggcaacgccgccgtcgtccccgtgccggagcctctccgtcctcatgctgcactgctgcagcacaacccagcgctcggcgacaaccccagtggcttccttctcggacggccggcgagcttcttctgcgcgcggacggccggcgagctcctcccctgcgcgcggccagccggcgagctcctcccccgcgcgctgccggtcgacgagatcctcctcgcgtgaggacggccggcgagatcatccccacgtgcggacggccggcgagctcctcccccgtgcgcggcccccgacttggaggggctacctcgtcctccacgaccccttctcagacaatgccctggcgccctccggcctcctctgcgtgctcgagccgagccgctccccccgcgcgcgcggcgcggctagccgacgagctcgtcccccgtgcgccgtcgttgccgccctgctgatagaaggtgagaagaggaagatatgaaagagaaagaggggaagagatgagggagaagatgagatgaggtggagactgctgacatgtgggtcccgctggatgacttagcaagtcaactaccacataagcaagtcaattgccacgtaggacaaaaccgcttctaaaaccgccggggagttgatttgcaacggttttcagagttgggggatatacccggttttgcggttgagggatgctattcatgtacggccatgagttgagggaaggaaagtggacttattcctttttaatatgacgg

SEQ ID NO: 93215 - DNA, 3715 bp, Oryza sativa
agagaggaaaaagaaaaagaaaaaggaaaaaggattttccctggaattaaaatattgcttgctcaattttaattggttaaaattatttctagagctctgaaaattccactaaaaatcctgttaatgaatttcgacctgtagaactcaagaaaaagtcccacatgtcaaatccgattattatttgcattactttcttagggttttctcctgatttgcaccggtattttcttagggtcatttataaattacaattttggcttgggagggaaacttcggggtgtgacaaacctaccccccttaaacggaatctcggccccgagattcggaggagctggtgaagaggtgcggatgggcggctttcaactcatcttccctttcccaggttgcttcctcttctgaatgatgattccactgaactcggcaaaacctggtgaccttatttctggttcttctttcgctggtatcaagtatacgaaccggcttctccacataggttaggtcctcttggatatcaatgtgctccgaatcaacctgttcttcaggtacccttaagcacttctttaattgggacacatggaacacgtcatggatgccgatcatgttggatggaagttctagctgataagcaacttctccccttcgttccaaaattttgtatggtcccacgaagcgtggtgccaacttgccttttgtctggaaatggtgtactccccggagcggagtgacacgaagatacacgtaatctccttcctcaaaagtgagctcccttcgacggttatccgcgtagctcttctgtcgagactgagcaattctcaacctttccctgatgattctgactttctcttctacttccgctaatacctctgttccgaacagttgacgttcgcctgtctgatcccagaataaagcgcatatggctgtataaagcttccgaccgtataaagcttcaaacggtgccatctgtagactggcctggtagctgttgttgtacgagaattccgcatatggcaagcttttgtcccaagctccaccaaaatcaagagcgcaagctctcaacatatcttccaagattaaattgactcgctcggtctgaccatcagtttgcgggtgataggccgtgctgaaatttaaacgggtccccaattcttcctgtagcttctgccaaaattttgaggtgaactgactacctcggtcggatactatcttcttgggtaccccatgcaaacacatgatccttgcgaggtacaattctgccaatctctttccgtataggtggtatgcactggtataaagtgagccaccttggtgagtcgatccacgactacccagattgaatcatgacccgatgatgtccggggcagtcctgttataaagtccattccaatctcctctcatttccattccgggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttagtgctgcctgggtgaatggagtactgggtctgatgagcctcggtgagtatcagatccttcaattccttgtcgtcaggtacacacaatctttctaccatccagatcgtgccatgctcatcctcaaggaaatcccgagcctttccgactctcatgttctttttcagctctgctatttccggatcatttacttgagcggctctaacttgatccacgagcgtaggccgtgcctccagagcggctacgaacctgtgttcaacaattcccacgttgagatgcccaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgccggagatttaggtccggttgggtgaagatgtatttcagactcttatggtccgtatatatttcgcagcggttgccaatcagatagtgcctccagatcttcaaagcatgaaccactgctgccaattccaagtcatgcgttggataatttccttcgtgtggacgcaactgccgcgaggcatacgcaaccactctgccctcttgcattaggacacatccaagtccgtgacgggatgcatcacaatagacttggaagtctttcgtcgggtcgggcagaatcaaaactggtgcggatactaatttcttcttgagctcctcgaaactcttatcgcactcagctgtccatttaaacttctcatctttcttaagcaactgagtcatgggtcgggcgattctggagaaattttcgatgaatcggcggtaataacccgcaagtccaagaaaactccgaatctgcgacacggtcttaggtggggtccatttggtaactgactccacgttcgatgggtcgactgccacaccctgagctgtaatgacatgacccagaaattttacttccgtcaaccagaagtcacacttgttgaacttggcgtatagctggtgctccttcaacttctcgagtactagacggagatgttgttcatgttcctcctcggactttgaatagataagaatgtcgtcgatgaacaccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatcctcttcccggattctcaactggtggtagcctgatcacaggtctatcttagaaaacactttagctcctttcagttgatcaaacaaatcatcgattcgcggcaaagggtatttgttcttgatggtgacctcgttgagtgcgcgataatcaacgcacattctcttcgtcttatcctttttctccacaaaaatgaccggagcaccccaaggtgaagtacttggtcggatgtaccctttctgcagctgctcatcaacctgcttcttgacctcggctaattcgttggccgccattctgtacggtctcttgtaaatgggagcggttcccggtgccaagtcaatccggaattcaatctccctcttgggtggtatggtagtgaggtcttcagggaacacttctggatactcggagactatgggtatgtcttccaatttcttcaaattcttctcctcggtgaccactgggacttccatctcgatctggttcaaggagaccccttgctttggcggggctagtgatttgtacactaccgtttctcccttctcgttggtcaaggtgactgtgcgattcgcacaatcgatgactcccttgaacttagtcagccaatccatcccaagaatgacatctaggtatttggattcaagaagaatgaggttggctagaaatggtaatctttgaatttctattagcactgaagggctaaaactgactgaggttgaactattccccggggtatgaaccctcattggtgtgctaagctcttctttccttaacccatacatccccacaaatttctttgaaatgaaagaatgcgttgcaccagaatcaaaaagtactgttgcagggattgagtaaacagggaacgtacctagtacgacctccggtgctgtttgtgcctcctctgcagacg

SEQ ID NO: 93216 - DNA, 2378 bp, Oryza sativa
aactcaagaaaaagtcccacatgtcaaatccgatattatttgcattactttcttagggttttctcctgatttgcaccggtattttcttagggtcatttataaattacaattttggcttgggagggaaacttcgtggtgtgacactagtcctcctctttcgtttgccccttttcccgagctctctagtgcgccgtagagtcgccgccgcgtcgctttagccgccgccgtcgccggccatcctccggccacgctgcgccgccgcgtccgccgtcgttgccacctctcgttgccgccgttaggtgcgcacgggagcggggaagctcggccaccccttctccgccgtcgccggccgtcgtagcgccgttcccgccgttcaaccgagccgccgccgcctcttgcgtcgtcgccggccgtcatcgttcgtcgttggacgctttggtgagtaccgttgcgttcgtgacgtcgtcctctacgtgtagatgcccttggatagcccggccgatctctctatcgccggcgaggtcgtcgcccatgtcatgccggcgatgatgacgtcagcatgacgtcatgattcctcttttccagtttttttctaatagattaaatcttcggaaaatcataactaaataaccgtagcttcgtttcaggtggttcaagttgctaaatttttctaaaataaagatctacatattaaaattgtccataaattgaattaaatttatttaattctttttaatgggctttaattagatttaatcttgtaaaattcatattaaattcatttgaagtcagaatagggccgttcaagtctcataattcatctaaaatcatgttctacatgtttgtttattttatatgtattgtttatttggtttttattagtcttttactttgttttgcgtgttagcttgtcgtttccgtcgttgcgaaggttcgtgagtgcgctggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgtattggatgccctattccttgataccttgggtaataaattgattagcttgaaccttatatattggattggttcagctaaatgctatatgtaagtttgcttagctatgcttagaaacattagctaactaaaggggttaattataagctatgttatattattattaattatggttacattaaatggtagctcacgatggttaatcgtgcgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacaatggtacacctctggccagagtaaaactattcgaatagccgtgcccgcggttatgggcgagttaagcaatgtttttcgtggttagtctcacacctctcacaataattatagatgttatacctggtaataatttgcttagctcctggtttggagattagatctgtacagccgggtatggttgttcaggatggttgggcctatgcagcatgggtgtgatgttcagtgttgattaaaatttctgataaattactccactgttttacttctcttaaatctttgctaaatgctgcttttgcaaaagagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttctttgtaagtatgtaacgttattattaagatggatttgtatattaaattgtcagtttgtgtacctcggctgatgcctggacgaggattttatgcacaaattagttcggaaattattagtgaatttccgggcgtgaca

SEQ ID NO: 93217 - DNA, 1688 bp, Oryza sativa
gcaataatcatcaaaccttagttgaagataaaggatccagaaggagaagacgtttggcttataccccagttgagctgcctgtgggagtggagctgaagccatcgctagaccgttaattccgctgctgttttcttttctttgtaagtatgtaacgttattattaagatggatttgtatattaaattgtcagtttgtgtacctcggctgatgcctggacgaggattttatgcacaaattagttcggaaattattagtgaatttccgggcgtgacatctgccccgcgtgcaatcaatagggggaattattccccgggatcccctccccctttccccccatttttccctccctctctccctcggattcgtttggaaacccctcccctaacctcgccggaccgtggggctgccgcgtgggccccactcccgtggacccggtccgcgcgcccctcccctcggctgacgcaataaatcctttttttaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagacccgctcttcttggaagttgaagcccacgtttgggaaagcgagcaaggcaagtcacatcatctttgaacatattgaatcccagtttgtaaaattatgttgatttaaattattgcattatcgctttatttaaattcccgccgcccgtcagcgagggtggcgggcgggcccgcccgtcagcggcgcgcgcgcggggaggaggccgatgggtcgcgggggagaggagagagagggagggaggtgggccgagccggcccaagagggggaagggggggaggaaaaagacttttagggtttttctttttataaaaccactttaactttgtttatttcttcttaattattttttgtgctctgaaaattccactaaaatttatttacgcattttaggcttttaggaaatatacaaaaatcctccaagccttatttgacttttaaatttgcacattttaattgttggaggctttcacatggattttacttattctttgcataatttcgaggatgtattttagagtcgttttgggacgtgacaaacctaccccccttaaacggaatctcgaccccgagattcggaagaactggcgaagagatcgggatgggctgccttcagctcgtcttcgcgctcccaggtagcttcttcttcggcgtggttgctccactcgaccttgcaaaaacggattacccggttcctggtcctgcgctccatggtgtccaggatttttactggcctctccacgtaggtcaagtcttcgcgaactacaatttgctctgagtcggcctgctcggatggcactcgaaggcatttcttgagttgcgacacatggaacacatcatgcacgttgcccaaggaggcgggcagttccagctggtaagcgacttctccgcgccgagcaatgatacggaaaggacccacgaaccgaggtgcgagcttcccttttgtccgaaagctgtgtacagctcgcaatggtgtgacccga

SEQ ID NO: 93218 - DNA, 903 bp, Oryza sativa
acaacaacagctatcaagccagcatacaaatggcaccttatgaagcgttgtatgggcgcaaatgccggacaccgctaatgtgggatcaagttggggaaagccaagtgttcgggactgatatcctgagagaagctgaagctaaagtcagaaccattcgggataatctaaaggtggcacggtcccggcagaaaagttatgcagataaccgtcgccgtgacctggaattcgcagtggacgattttgtatatcttcgggtcacgccattgcgaggtgtacacaggtttcggacaaaagggaagctcgcacctcggtatgtgggtcctttccgtatcgttgctcgacgcggagaagtcgcttaccaattggagctgcccgcctccttgggcaacgtgcataatgtgttccatgtgtcgcaactcaagaaatgccttcgagtgccatccgagcaggccgactcagagcaaattgaagttcgcgaagacttgacctacgtggagaggccagtgaagatcctggacaccatggagcgcaggaccaggaaccgggtaatccgtttttgcaaggaccagtggagcaaccacgccgaagaagaagctacctgggagcgcgaagacgagctgaaggcagcccatccagatctcttcgccagttcttccgaatctcggggtcgagattccgtttaaggggggtaggtttgtcgcgtcccaaatcgactctaaaatacatcctcgaaattatgcaaagatccatgtgaaagcctccaacaattaaaatgtgcaaagctaaaagtcaaataaggcttggaggatttttgtatatttctaaaagcctaaaatgcgtaaataaattttagtggaattttcagagcccaaataataattaagaagaaataaccaaagttaa

SEQ ID NO: 93219 - DNA, 1203 bp, Oryza sativa
gggtcgtgtgaaccatgtgcggccgagaacgttgttgcaactccagacgtcatcgttgggacgttcctcattcattccatccctgctaccattttgttcgactctggagcttcacactcgtttatatctgtgccattcatggggagaaatcagttgggaatagaaaggttagaaaccctctgctcatcaccacccctggaggggttatgacagcaaagtactatagccctgccgtccctataaaattcaggggattccttttccccggatctgattctgctaggcaccaagaacttggatgtgatccttgggatgaattggttggctcaattccaaggagtagtggattgcgcgagacgcactgtcactctgtaccgagggccggaacaaccggttgttttctttgcacccccaacctcagtcagaagttcagaacttcatcagatagaactgtcagaaattcccatcgtcagagagttcggagacgtgtttccggaagaactacctggtatgccgcctaagcgagagattgagttccggatagatcttgctccaggaaccgctcctctgtacaagcgaccctaccgtatggcagcaaatgaattggccgaagttaagaaacagttggaagagctgaaagaaaaggggtatatacgtccaagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcaatcagcttaaaggtgccactgtattctccaagattgatcttcgttccggatatcaccaattacgtattcgcgaagaagatattccgaagaccgcattcaccacgcgatacggactgtatgaattcacggtgatgtcgttcggtttaaccaatgctcctgccttcttcatgaacttaatgaacaaagtgttcatggaatacttggataagtttgtggtggttttcattgatgacattctgatatactcacaatcagaggaagaccatcagcaccatctccgtctggtattgggaaagctgcgggaacatcaattgtatgccaaacttagcaagtgtgagttctggttgtccgaagtcaaattcttagggcacgtgatatctgctaaaggagttgctgtggacccc

SEQ ID NO: 93220 - DNA, 756 bp, Oryza sativa
acacgattctagaactaaacaatattatttatcaagggcgtgaacccacacgaacctgccttaacccaaggcctacgatgattcagaccgaactggcaacccgaccctgggtcccagctcgttccaatccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacacccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtaccgtagtgctttgcaacagaggcccgaagaccggtccttatatggccgaggtgctactatcaaaaccatgcaccccgagcccagcctaaaaccattttggggattttgaatagagggggaggtgtgaagcca

SEQ ID NO: 93221 - DNA, 653 bp, Oryza sativa
  unsure (1)..(653): unsure at all n locations
atagggattggtgtagcggaccctttggttagctccctgttgattgcggaaattcgccaagcggcgcttgtgcgactccagttccttgtgcttggcttccaagcggatgctcttgtccaccagacgttggaaatccagatagtccccggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcggaattcccttttcttaagggccacgactccggcgggcacatgggttctccggaaagcggcggtgaaacgggcccaagtaataggctgtccctctggctgcgtagcctgaaaatggtcccaccatagagatgcgggcccctgcagctgatgggcggcgaagatgactttctcctcatcgctgcactccacagtgtctagctttttccccacggcatgcaaccaatccaacgcatccacggggttgttggagctagagaaggtaggtggacggatgcngaagaactcggcgagttaaagtgttggggaggtggtggtggagcattatngtgtggcggattttggaggtggtg

SEQ ID NO: 93222 - DNA, 1330 bp, Oryza sativa
gaacacattatgcacgttgcccaagaaggcgggcagctccaattggtaagcgacttctccgcgtcgagcaccgatacggaaaggacccacataccgaggtgcgagcttcccttttgtccgaaacctgtgtacacctcgcaatggcgtgacccgaagatatacaaaatcgtccactgcgaattccaggtcacggcgacggttatctgcataacttttctgccgggaccgtgccacctttagattatcccgaatggttctgactttagcttcagcttctctcaggatatcagtcccgaacacttggctttccccaacttgatcccacattagcggtgtccggcatttgcgcccatacaacgcttcataaggtgccatttgtatgctggcttgatagctgttgttgtaggagaactcggcataggggagactcttatcccaggtcttctcgaaatccaggacacatgcgcgaagcatatcttctaggatctgatttagacgctcggtctgcccatctgtctgcaggtgatacgctgtgctgaagtttaatcgggtacccagctcttcttggagcttcttccaaaagtgagaggtgaattggcttcccctatcagatacgattttcttaggaacgccatgcagacttacgatcctagcgaagtagagttcggctagtttgttccctctataggtggtctttacgggaatgaaccgagctaccttggttagtcgatccacgactacccatatagaatcatatccaccttgggtttttggaagtccggtgataaaatccatcccaatttcatcccatttccattctggtacttggagaggttggagaagtccggccggtcgttggtgctctgccttgacacgctggcacacatcacagagggccacgaactctgcaatttcccgcttcatactaacccaccagtatttctccttcaagtctaggtacatcttcgtactgccagggtggatggaataaggactttcgtgagcttcctgaagtatcagcatacccgaaatgtctaggtacatcttccttaagttctctgttatctggaacgcatacccgatttccgttccatagggttccatgttcatcctctgtgaaaccagcggctttaccctgtttcatattcttgaggagcccatgcatatccgggtcattcttctgagccttgcagatttgatcgagcaaggtaggcttggctttcagcgtagccaagaatccacgactaactatgcttaggttcagggcttccatctggtgattaagttccggtggaatgccacggacgttaagagtgtgcaatggctcttt

SEQ ID NO: 93223 - DNA, 829 bp, Oryza sativa
tgctcttctccactggttctccatcaccggctgcgaagaagacgatggccgcaatcgttgatgagccgcggtcgtttcctcttctcttgcgttccatactctcctcaccatgccgaatatttctccttttgatttcatcctctctggtgcagccaatcggcgggaacgctgccatgcacaccggagctctggagcgcgctctgcgcaccgccgcagcaacatcgtcgccgttgccatcaatctagatcaagccggagcgagccaccacgccaccagcttcacctcaacctcctctccatttcccctcaagaatcttcaagaatggtgctacgagtgtggagatcgtccaccgtcttctccacctccggtcgccgtcgccattgtcgattccgcctcctccggtgagccattgtccgattcttcgcgtatacaccatccctgggacctcactaaccccatgaaaacacatgcatgtcaattcgatgagtggatcgagccgttgccgtcttcccggagctctacaccgtcgccggaccatcttcttctccgctgccgctgtccagactttccggcgcctcgttcaaggttcggtgagcacccttgagcccataggattgcattcatgcatttcattcacttagaattgagcaccaactcaacatgcagtagcagcctaagcacagccgccgctcggactcgccgccggcgttactccgatgtccactgaccaagaaaagaagaggaatggaatcgcaatagcatgatcttcattttgtcttttggtcgcaccctcaaacgagccaccgtttgccgctggcaagcttgcatg

SEQ ID NO: 93224 - DNA, 919 bp, Oryza sativa
acatggcacctaaatcaaaacaaataatataaaaccttatgagctccacataatagtgaaaacaacattttcttcctcctttactctcctctcttccccatctctatccaaatctccagtgtgcgaccaagagaaaggcgaccgacagggagaagggtgcatgacaaccaacagagaggagctgggtggcagcagccgtgtcaccaagctcgacccgcagggaggtccagggatctcctctctcgcctcaccgccacgggcctcctccgctcccgccgcccgtcctccgtggagtcaccatctactacatttttgtgaggaggcaggaggcatgcacagtgtcaccgtccttactctgtatccctgacgctgccatgacctaatcgaaccagccctggtcgaacctctcccatgtccacttggggtaccactcctggctctccatcgggtgctaggtctcgaggtcgcaccaccactcgaggatctcgaacaccaacatgctgaatagctgaagctgtacacgttgcacttatgtgtcactggcaacaatagctacagctctagcgccacgtagccccgcgtgccccgcacgccggtcatcgtcaggtgggtattgtcacggttgcagagcttggcaagccttgatgttagcaccctttgctccaattcaaatagcaaacatatatgcttcaacactcaaatatttggaggaacaaaagaagaaatgggggatacaagttgctagtaacacaggaaggaggaggaggaggaagaagagaagtagatcaacgagggatgcccaccggccgcccaggtcaccgccgccgccgtgagcctcagctcgccaaattgatcaatcgatgcccccatgttttctgttgctgctcatatatgctggtagtggtgcttgcttgggcct

SEQ ID NO: 93225 - DNA, 732 bp, Oryza sativa
aaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatacatcggacttaccgatgttcctggcgcgaactagagccaagtgctcctcgatgtaaggagctaccaatgaagagtgttgcagaacagtgaaatgggctttacggaataaattgttgtctaccgtcataattgctttccttccgagagttccctttccccgtagtctcccttcatggcgtgattccggtaccccgattgggcgaaggtcttcgataaattctacgcaaaattcgatgacctcctctgttccataacccttggcgatgcttgcctctggacgagcacggtta

SEQ ID NO: 93226 - DNA, 697 bp, Oryza sativa
gtagagcaaggtttccgagaaaatgattgctgccatcagggcaatcaccgtcatcctcaagggtgcatcatctccaacaccaatggcaccaccccttccagtgcacaccaactgtttgatggaatgccccaatgatagtagctcgagcacaatatcgagatccatctacatcaacgaggggactgctccgactgtcatcctggagcatgaggatggtgagggcaaggatcacatgcccttcattgtcatcaaggaccttcctgagttcacgcccactatgtgttcgatgatatgttctagctccgacaccaagcctgatctcactgtggctgttgtggttacttgtgccacttctgtggagtcatcaatggagatggtagctactggcagcaccaccgacgacacccacatcgacacccttgatagtaccaaggtgatgcccgccagctgttcgacggttggccttgatgtcaagggtggcgcagaccataccagggtcacgtgtcggaccatgatgggtgtgcccgagggcgttctagtacctgatgcatcatccaaagtcttctcgccatggttgatggctgaaatggatcttattccattgctgcccactgggtgttcgatgaaatgtcccaaagacaagaagctgctaatggggaatgctaagagaaattcatggccaccggttgggtggagt

SEQ ID NO: 93227 - DNA, 1187 bp, Oryza sativa
aaaatgaaagtgacaagtcagatccccttatcaatgaaaagaaagaaaagaggcataagtacttgatgctgcttgcaattcttgctgcatccattgcttaccaagctggtctgaacccacccgggggtttctggtcagaggacagtcgtgatggctacaaggctggcaacccgctccttaaggacatacactccagacgctatatggtgttctatgtttctaattccatctctttcatggcatctattgctgtaatcatgcttctgctgagtaaatctgtgagaaagaataaggttccactccaagcattgttgttgatcatgatactagacctgttggctctgatgacagcttatgcagctggaagctgcagaaaggtcagacatcaatatttgtcttcttggtagtatgcggggtggtgctataccttatgattgtaattattttattgagtggtatcgcaaaatggctgaaagaaaggaaaggtaggtggcctctgtgctggagaataacaaggagtaacaaaataacaaggagctgagcagattgttggaacaatgttttcaaattccttgatcatttggttcaagaaatcaaaaggacagtaataggtggaggtagactgtgtcttgtatcacatataagttctcttaagtcattttgaatagttcagtgtgcttgtcatttcgttttagttgtttcccaagtttggctagggggcagtagtcgcacatgttctcaattgtctgccccattcttttacttcttaatgctatgatgtgcgaacgtcttgcaggttgttgaaaaaaaaaactcctttttgccactgttgtgatgtctttgtattttagatgaaaatcatgtctttggtttttgttcaggactacaggatatgatgttctttgttgctgaacaaaatattcaacatttttcatttagggagataagattccagacgcagcagccttttttattcttctccttggttgaatatgattagaattttgatcatgtttagttgtatgtaactgattggtttcatgaggagatgaataatgcttgaaacatgcgaattttcttttcgttcgttataatacaggtggctgttcacatgaaaatgaattggacagttttgcatgaataggtttggggaaacatctcgttggttttatctcaggattgggtta

SEQ ID NO: 93228 - DNA, 5800 bp, Oryza sativa
tgaggaatttatttggaagcactcaaatagaaaaggaaattaatagtattcctcaaaatatttttgggaatatggtaggaaaataggtggaggcaaaaggataggatttgaaccctaatatatatggcataggtttcaaggaattgtttgaggctaaaaggaaatttaggtgacaaggatataatttattttcttagcacgagagcaattattcacaatatttgtaataataatattcttgtgccgagaaagaaatcaagccacaggaattaaattagcggctagatcaaaatgaagaatttagatatttggcgataaataagaataggccggtttggaatcaaaggataggtttaagatcaaaggacgggtcgacaattgaatccaattggaatcatttggtttaagttataggataatagtggagaatttattggaccataattcataaaaaatagaaaggggttttcaaactaaatttgaataaaagaatttttgtcaaaagaaggttttaaaccaaatcaagaaatacctcaatttaaccaaatatatattttaaaatgaaaaacacaaaagagattaaatactatagaggttttgtgcgagttagttttaggaggtccctctaattatactgtcctaagtttaggaggttattaaaaacataagaatcggcatgatgcaggattagaaaatgacacattttcaggatgttacatttatgccgctggagcagatgacaatgcgttggcaaactatttaccaaccgcgttgaagggttctgcacgttcgtggctgatgtatctcccccctactcaatttcttcgtggtcagacctgtggcagcagttcgtcgccaatttccaaggaacatacaagcgtcatgcgatcgaagacgatcttcacgcgttaacacataactcaggggaatctttgagggaatacgttcggcgctttaacgagtgcaggaacaccatccccgagatcaccgacgcttatgtaattcgcgcctttaagtttggtgtcagagatcgctacactacccaggagttggcaacaagacgcatcacaactactcgaagactattcgagatcgtggaaaggtgtgcccacgtggatgatgcactaaggcgcaagaacgacaagccgaagactgggggagagaagaaatcagctgcagacacatctgagtcaaacaagaagaaaaatcgcaaaaacgggaaaaggaaagctcaagcggaagtcctcgcagcagaatacgcgaaccctcccaagcacccggacccacaaggaagcgaaacaaagaaatcttggtgccccatacacaaaacagatagacattctctggaggattgccttgttttcaaaaagtcgcccgagaagcacatggcgtttgaaaaaggcaagcgagtacgcgttgtcgagaaaaacgaggagtcacctcctcacgaatcggacttcgcgtacccagactccgacctccatgtttcacacatcttcggcggctccatgacgtactcctccaagcgagaatacaagaaagtggaacgcgaagtttgttcgacatggcagggggctgcacccaggatgaagtggtctgagcagaagatggagttctcggaagcagaccatcccaaaacctcggttatcccgggacggtatccgatcgtggtcgaacccactattcggaacatcaaggtagcacgagttctcatcgacgggggcagctcgatcaaccttctttttgccaccactttggatgcaatgggaattccacaaagtgagctgacaccaactgatcaacccttccatggaattactccccaatcatcatccagacctttgggcaagattacgctgcctgtgacctttggccaagccaacaacttccgaacagagcagatcaccttcgatgtcgctgaattcgatacagcttacaacgccatcatcgggagaactgcacttgcgaagttcatggccgcatcccactacgcatatcaagtgctcaagatgccgggaccgaagggaacaatcactattcaagggaacgcaaagctggcggtgcagtgcaacaagcgaagcctcgacatggtcgagcaaacgcccactccacccgccatgtctgagccacccaagaaagtgagcaagccaaacaagacgccgaagccggacggcgccatcaagatcgttccgctctctagtgctaaccccgacaagactgtcaaaatcggggctacactagacgagaaataggaactcgcgctcatcgccttcctccgcgacaatgccgacgtgttcgcttggcaaccgtccgacatgccgggggtccccagggaggtgattgagcacaaactaatggtgcgacccgataccaagccagtaaaacaaagactgcggagatttgcaccagatcgaaaacaagccatacgagaagagctcgacaaacttctcaaagctggcttcatcagagaagtcctccatccagagtggctcgtcaacccagttatggtgcggaaagccaatggaaaatggagaatgtgcgtcgacttcacagacctcaacaaggcgtgccccaaggatcactttcctctccctcgaatagaccaactggtggattcgacacccggatgcgaactattaagcttcctcgacgcttactctggctacgaccaaattagcatggcgaaggaggacgaggaaaaaacaacgttcatcacactgttcggggtattttgctacgtcaagatgcccttcggattgataacagttgggaatactttccaacgcacggtccagggcgcacttagcaatcagcttggcaacaatgtcgaagcgtacgtcgacgacatcgttgtcaaaaccaagacaagcgactcattgattgatgacctccgggaaacgttcgacaacctccgacgatatcgcctcatgctcaatccagagaagtgcatgttcggagtaccgtcgggcaagctactcggattccttgtttctggcagaggaatagaggcaaatcccgagaagatcaaagcaatcgagaacatgaagtcgcccacaagactcaaggaggtacagaagctaaccggatgcatggcagcattaagcagattcgtcgctaggatggtagaacgaggacaaccttttttcgccttattgaagaaacaagacaaatttgtatggacacaggaagccgaagaggcatttattgcactcaagcgctacctatcaaacccccctgtactcgttgctccccaacctaatgaagaattattcctttatattgccgctacgccacactccgttagcactgtcattgtcgtcgagcgagagaaagtacagcgaccagtctattacgtcagcgaagctctccatgacgcaaagacaagatacccacagattcaaaaactgctctacatagtcattatgacatcaaggaagctacgccactacttccaagcccacagggtcacaattgtttcctccttccctcttggcgaagttgtcagaaacaaagacgttgtcggccgcatcgcgaaatgggtagtcgagctaagccaatttgatgtccacttcgtgccgcgaacagccattaaatctcaggtactcgccgatttcgtggccgattggaccatgccagataacaagtcagataaccaaggcgacaatgagacatggacaatggcgttcgatggtgcactcaatagccaaggagcaggcgctggatttatcttaacatctccatccggagatcaattcaaacacgcaatccaccttaacttcagagcaacgaataacactgcagaatacgaaggactacttgccgggatacgagatgcagccgcacttggcgccaagcgactaatcgtcaaaggggactctgagctagtcgcaaaccaggtgcacaaagactataaatgctctaaccccgagttatccaagtaccttgcagaagtcaggaagctcgagaagaggttcgacgggatcgaggtccgacacgtctatcgcaaggacaacgtcgagccagacgacctagcccgacgcgcatccagacgagaaccgctcgagcccagcacctttctcgacatcctgacaaaaccttcggtaaaagaagtaagcggcgaagttggcccaagcaccctcgacatcagctcggaggtcatcgcggcagaacgcgccgtggctgacattgaaacaacggatgactggcgcaccccattaatcaaattcatcagcagcgaggagttacccgaagacgacacagaggccgagaaaataacccgtaaagcaaaaatctactgtatgatcggcaacgacttatacaaaaaagcgccaaacaggatacttctcaaatgcgtctctaccgacgacggcagacaactcctcctcgacatacacgaaggcatatgtgggtcccacgccgccggtcggacattggtcgggaaagcctttcgacaagggttttctagccaacagccctcaaagatgcatgcgacatggtccagcgatgtgaagcctgtcaattccacagcaaacacacaaagctacctgcacaagcgcttcaaacaatccctctgatttggccgttctcgtgctgggggctagaaaaacttggcccattcccacgaggacaaggcggctacaaattcctatttgtagcgatcgacaaattcaccaaatggatcgaagcagcacccactggagaaatcatggccgacaacgccatcaagttcatcagagggatattttgcagatacggactaccgcaccgcatcataaccgacaacggctcccaattcatcagcgccgatttccaagattactgcatcggcttaggagtcaaaatatgcttcgcctcggtctctcaccctcaaagcaatggacaagtcgaaagggcaaacgacatagtactagaagggataaaaacccgcgtctacgacagactcatgtcacatgacaaaaaatgggttgaagaactcccatcagtactatgggccgtgcgcactacaccgacaacgtccaataaggaaacactcttcttcctcgtgtacggctctgaagccatgctccccggtgagctacgacatcaaagtacacgagtacagaagcattccgacaagaagcaggatgaacagcgagacatctatgtaaaccttctcgaggagcatcgtgagcgagttgccgtgcgagcagcaagctaccaacaggccctccgccgttatcacgagaagcgcatccgagcacgcatactttcgatcggtgactacgtcctccgacgagttcaaacctaagcagggcgaaacaaactctcaccaaaatgggaaggaccctacatgatcacacaagccttgcggccaggcgcatacaaaatcgcagacggcgacggtcgcgaattagcaaattcatggaacattgaccaactacgtaaattctatgtatgagtcaataccattgtacctgtaagcacccttacagtatcaataaagactacttcttggtctcatataatgaccaaagtgttttcacccaacaactcctcactctgacgacgcctagcgttgaaacctgtccttatgtccgtttacaccgtctcgacaaggcctccgaggaacccaagggatcttcggctggagatgcccagagccgataaggccttgtcagatccttcagagacgaaagaccatgtaagatctggtcgtgtaagagttctcgccgtgcgtattaaccaaaccgtgtaatcggaaaccaatctttccaacttcacggctgggggctaggatcagagcttattcaaccaagacagg

SEQ ID NO: 93229 - DNA, 1658 bp, Oryza sativa
catttgttaaagatagatttctttattcacaaaatattccttacaatttgtacataaatattttgtcacattacatcttttcccaagatatcttgttgcagggtacgaatcctaccaagaaggccaacgccagtccattgattggaaaatcttctcggccaacggcgacatcgatctcgcgagatggtctatctccgccggatccctccgagaacgaccaaaaccttcgcggagaaattcaagatccatgcgtgggcagtgatctcgtatgcaagccagcacatgtcctccggcatatcggctcgctcgacaacactcttgcttcaaggcctcgtcgatacgcttaccaatgccatcgagttgggcgcaggcctcgttgagccacgagatgtacccggccgccgatttttcaggatcaccgcgggctacccgaagatcccgacacaccctctccatcgaggtgcaacaactcttcaagtaagatgagaaccacacctcgcggcctcggagcgtttccacagcttgatctttcttcacggccagcattgccctctcgagttccaccacttcaaattttgtcttccaatattggatacgacgatcttgggtcgcaagggaatcctcgagatctgctaaacataacgactactaagataactcggaaacccccaaaacagcatcaaggttgacaggatcactcactcgggccagttgctgtcacttcgacctccgcgtcaagagtttggtcctcgacgttatgcgatgcgtgcggttcaaactcgagtaccggaattattgccagcgactcaggctgcccgcgctgctggacatcctcatcatcggcatctctacaatcgacaagatagacttccgagatcaacggtgaacaaagatggcaatcatgcgcataagggtaaccagagtttaaaatttacgagtcagaaaaatacaagaggtcctactcttcaaagtgggggaggacagattcccccagatcactgacttcctccatcacctccttccgcgcgtcgcttgccgctccctgatccaagacctcacgcaggttgagctcaggacgcgacaacttcatgcaagcgaggatgtgacacgccccggtatagataccgttagacgactcctccgcgatcctggccgcgtgcttggagggaattttccccatcgccgtcgctagctccgcaagagaagaggtcaacgaaaactcgtcggggttcgccggaatcgtggacttgatgccacactcctcggcaagttggtggagaccggtgtaggtgacccgcaacgaacctcggatctcggagaggttatccccgagttccgacatgcggtcctcgagccctttgcgctagcgctcgttgccggccaccagctccctcatcttcgtgaagtcctcacgggcttcggccagttcccgcaccaagcgctcagcgcgcgcgttggccgccgccgtctccgccctagcttacgagacctcgcggccaatgccgcgagcaccggcctcgagaagacgccccatctcagcttggagctcctcccaggtgaggatagcctctggcagaccacggcctccagcgggatcgctggcagggccgctgggcgtcgcctcccgactcccgatcgcgggaatgatgtcggtagat

SEQ ID NO: 93230 - DNA, 568 bp, Oryza sativa
ttcttgaaaggaatatgcagctcacatggtgtccgctgactgatgtcatcaacgggacaggtccattcgtcctgtgtttgcatggcgtccatgctctgcgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtcgggtcggaacgtgccctgagaggaggctcccactgcatctgttagtcgttgcgcaacctctcgtatctgaacgccgaataccagtgagccatcagctgggttgagcgttccaccgtgagcatagtaccaga

SEQ ID NO: 93231 - DNA, 974 bp, Oryza sativa
atacaagaaacatctgctaagtcacgagacatttatgttttaacaatctaagtcatgtatgctaagtgtaaatgtcgtacattagaaccctacacaaaccctacattagatatctttagtcccggttgttgagaacaaccgggagtaaatatcttttcccgctatttcgaaattctttttaaacccggttagggttaagaaccgggactaaagattatagcactgcatatgattttctcttacatatgtgtttataaaatagaagttaatgcattaacattatttaaagtactaaagattaatgacaattacttcgaaaaattatttttgtctgtaataaattaagtggataaatcgtaataagcaaatatatgacttataattaataaaaattccaatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatataaaattgccacttgcgtgatttaaaacttttaaaaatacaatagtcaattataattagcatatgaatgctagtaaattaaatgttaaaaactctaattaacgtacatatgaaattgccacctgtgtgatttaaaacttttaaaaattgtaagtatcacatataactagcatatacatgatttgaa

SEQ ID NO: 93232 - DNA, 1585 bp, Oryza sativa
gtgcttattattcgcttgatattcgtggagtatccagacggtacctatatgctctccaagcattcaaacatactttccttctctgccttgataagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccagggccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcctcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctatcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcgtactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagctctgtggccctccaacatgttgtccaatctatgggcctccttttcactttcgcagtcctccctggcgt

SEQ ID NO: 93233 - DNA, 2410 bp, Oryza sativa
atggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgacaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgccaaggaggccatcaagctatcgaactatgagcgaacgctgaagaaagcatcttctggaaagtccaaaccagtccctcagcttggagagcaaccaaaacaggagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaaattccatcagctgtacatggagatgagcgccgccggtagagagatgatcggagcgaggatcagggacacggacttcttgcaaggagatgacattctctggatcaatttcaagggaatctacgaactataccagctggacgccctcgacgtctctattatgagttgctggattttgtaagtatatcgttcggttagatttcttactatacgtctcctttaataaattaggtccttgtatataagtagactatagaaaataatatactcccttttatcgttgtagaatggagattcaaagggcccgacggcggagggttttcgatactggattcatcgaccctcggagagtaaacgtcgcattgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatatatctatatacatatgcattaatttgcataacatatatatgtgtataaatacatatatattatgcatgtatatacatataatataatataatatatatatatatacatatatatatatgtatgcatatatatgtattgaaacatatatatgcatggtttatatatatatatatatatatatatatatatataaactatatatatatataaaccatgcagcaacagggccatgcaaaaaaaaatggtcagctcgatctttagtcccggatatttac

SEQ ID NO: 93234 - DNA, 701 bp, Oryza sativa
ggacaaatttatcccggcagtatttacacagagcttcttttggctcattagctgtgctttacttaggtggtgtttacatccagggacttaacttaagtccctgtctttagacactaatttagagtattaaatatagactgcttacaaaactaattacataaataaaagctaattcacgtgacaaattttttaagcctaattaatctataattagagaatgtttactgtagcatcacataggctaatcatggattaattaggctcattagatccgtctcgcgaattagtccaagattatggatgggttttattaatagtctacgtttaatatttataattaattttcaaacatccgatgtgatagggacttaaaagttttagtcccatctaaacagggccttaggcccctcacagtggcttagtcatgccacgtaggttttttgccgccgtggagggagggaccgcgccttagctaggttcgtcgtcccctaccttagcgacgcaaagcctcgccaaaacgagggcgcgcagcgaggagaaaaggcgggtcacgcacgctgtgggcggcgcagcctcgtgctcgcgtggcctagcgcccaaaatcccctcacgcggcagcaaaattcctgattcaccctcccaaaatcccctcccgccacaacattctttctcccgccacagatcggattgatagataagca

SEQ ID NO: 93235 - DNA, 1013 bp, Oryza sativa
tcaaacaattcggccggagaaggaaaggaacggccggatttggaaaggaacggcggcggcggcgcgctagggtttcgggcggcggcggccgaaggtagacgatgggtccgacaggtgggacccacctgtcagcgaccgaacgcgcgcgcgcggcggctgcggactgggccgaactgggccgaggagagagagagcggttttgggccgactttcggcccaaagccaaaagagactttttaaaacctttttcaatttaaattattccttaaatgcaattccatttattaaaaatacttccttagctcaaataaatcccagaaaaatctaggaattatagaattaagccaagtatttaatgaaattttatctggccccattttatattggaatttattaattaaaattagattttcttttcaagacttttaaaattatttctaaaaattccaattaaacaacaatttatatattttgaattttcagggtgtgacaaacctaccccccttaaacagaatctcgtcctcgagattcggaagaactggcaaataggtgcggatgagctgacttcaattcatcttctcgttcccaagttgattcttcttccgagtgattactccattggagtttgcaaaaacggataactcgattcctggttcttctctcatttgtttccaagatacggattggtttctcaacataagtcaaatcctcttggacttctatctgttcaagattagcttcttcggtaggtactcttaaacacttcttcaattgcgacacatggaacacattatggactcctgccaaagattgaggtaattctaactgataagcaacctctcctcttctactgacaatcttataaggtcccacataacgcggtgccaattttcctttggtgtgaaaacgatgaactcctcgaagaggcgtgacacgaagatacacataatctccttcttcaaaactcaaatctctacggcgattgtcggcataactcttatgtcgagactgag

SEQ ID NO: 93236 - DNA, 820 bp, Oryza sativa
ccgggactaaagatatctaatgtagggtttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtacaagaagtatatactgaaggggcagacaccgaacttcgacacattcccaaagctaagggatcactgggacgagttcgttgcatataagacaggtgaacaagggcaggcgatgatggaaag

SEQ ID NO: 93237 - DNA, 830 bp, Oryza sativa
gcgatgttggtgaaggtggtggtgcagcggggcgacgagccgacgaggaggaaggagaggccggcgcggagacgatggcgttccggcgaaattcgggcgacgccgtggcctggccgggagagaggacggcactccggtgccgggggaggtggtggcgacgtcggccggcgcaccggggacgcggcagaggcggccggaggtggaacagtggcggcaacgccactgttttgccggcgagaacgcgtctccggtgttttccccgcgaaacggagggctgaccgagggagagggggtggctgcgaggccgagggagaagacggcgcggccggacggcgcacgggcgaggcgggagaggcggctggaggcggccggcgcggagaaaagaggagggcgacggcgggaaggcagctccgggggtcacctcgcgaaacggagggcaagccggggtggaggaggtggcggcgacgctggaggaggcgacggcgcggccggccggcgcacggtcgaggcggcaccggcggctggaggcggccggcggcgtgggagagagagggcgacggtggggagggagctagggaccacggggaggctcgggatggggctaaaacgagagaacgggggatgaggatcccattttataggatgggggagggagccggccacgggaggagcgggaacggcggcgggaaccatggccggcggcaatggttggtggccggacttggcgcgtccattcccggggattgaaggcaccattcaaggggaaattaagggggaaagagagaggagggaaaggggattaattcccctcaatcaatttgggaatccca

SEQ ID NO: 93238 - DNA, 2293 bp, Oryza sativa
tatagccgaaccaagcgatgggtcggattgtgttaatgatttatgcaatgatgccatagcaattatagccgaaccaaatgttggttcagattgtcttgctagcttggataataatgcaacaaccattatagccgaaccaagtgttggttcggattgtgttactagtttagacaatgatggaatagccaattcaagtgatgattcggattgtgttgctagcttagacaatagcatcatcgaagatatagccgaactaaatgacagtttggattgtattacaagcgaaagtgaaatagcattgtcacctaagaccaattcacaaatcggtcatgtggatgttggaaaagatgatgataatgtcttgcgggatagtaatgagatagaatctaaaatagttatgcatacatatcaaaggccgtatcctgaacacatagattcggtcccatacccgcaaggatttgaggtgcccaacttcacgaaattcacagatgaggatgctagaacaacaatggagcatatcggccgatttattgatcaatgtggtaaggccagtagcgatgatttgcttaagttaaagttgtttcccctttctttgtcaaactttgcatctacatggtatagtttgcttgctcctaattcaatttctacatggtcacaaatggagcataagtttcaagattatttcaaagatgcaagcttgatggagcaaagaccgattgatacttcatcggtcacttgtgaaacgatttcagttacatctatgcctaagaccggaattgatagtaatcctctccctattagtcctattgatgttaacaaaaagaaaaggaaaaatgttattattggggatcctcggcccaagactagaatcaataatgcgaaggccaaagatcataaagttgcaaatgatgagtcatctagtttccaaaagaccaaaaagccgaagctcacttttgagatgcttatggctaaatacaagagaggattagccggtcaacgatttgataaccaaactagtgattcgaaaagaccaagatcatctcgtaggaagagatttggtcaaacatcaaagcaatcggagccatcaaccataccaactgtcgcaccgggaaaattgccttttcccgaacgctagtgtattaatccccgtcccaggaaaagccggggtacaccatacaaacatgatataaaagacacatctttattacatcgataatatttacattattacaaaggcgcttcaggcctgacaatcaaaaataaacagcagcggactagcgggcctacggctcaatcttcacaggcgctcaactggggtataagccaggactccacctaagacatattctccaaagcttctcttactgaagaggggaaagattgagcaagaatgagtacaaccacagtactcagcaagccacaccggagatgcataattaatgcaagggggggtacaaggagataataatataggggttaagttttgcaataaacggcatttaaaagtcacttagttgcccaaaaccatttataaagacgatcctagagctacacagtattattaaacaaggccgtgaaccctcacgaacctgccctaacccaaggcctacgatgattcagaccgaactggtaacccgaccctgggtcccagctcgtcccaagccaacccaggccaaccattgcacattttagttgttgagcaaattttaagaattagaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcctagccatagacaagagtaccgacccaatcctgcctacggccggaacccccgggacaggcaggcaagactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgt

SEQ ID NO: 93239 - DNA, 523 bp, Oryza sativa
gaaagcagcggtgaattcaagccaagtgatagttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacacgaagaaattctgctaacttgttctgtggaggtgcatgattatttccttggttttgctgattctgaaattgctgcatcatcatgttcataagctgtgtctgttgagcaagaacttgagcaagagtgggattctctccattgttgttgttattggggttgttgggaccattcccattgctgcgagtgttcaccatctggcatgggcagggcacaagaagagaaaccggggaaactacttaggacagagaattactttaacttttattgatcttaactgagtttcattattacaaactaaaga

SEQ ID NO: 93240 - DNA, 609 bp, Oryza sativa
cggcggtgcttctcccttcatgcggctaattcgttctccaaacgatccacgtggtcttctaacttgcaaatcttaccacgattccggtcttcacgatcttgagcggctaacacagtctccgcacgactttcatccatagcccacaacatctcaaaccaaatgcttcgtggtagcatcattctcaattccttcagtgtcaaggtaactgccacggtcacttccctggggttggcgaggatggtagcgatactcagtgtcggccaattgatcactgtagcgatcacggagctctcctatggcgatccttgccacctcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaggtactcaggcttgtaacgcggcatctaaagacaagtgaaaggaggtagttaaaacctttatccaatctcatagcacaagtttttggatta

SEQ ID NO: 93241 - DNA, 684 bp, Oryza sativa
ccgccgttagggtcgccgccaggccgcgccgtcaccgccgtcggattcgcgtggccgagatccaccccgtccacctctcctccgtcaaggttcgtcgccggagccctcatcccctcgcgcacgggtgagcaccacctctaccgctgccttcggccatggtttccggtcgccgtggttcatctccctctctctaatccctctctcctccttccttagggcaccccgaagctcgtccgctcgccgacgtcgtcctcccgtggcttgccgtcgccgttcgccatcgtcttcctccgcgccggccaccctcggtgaggcacccctcccttcttttccccttcctctcctcttagtgtcgcgcgccgtcgccttcgactgccgccgccgcctcccgtgctgccggtcgccgccgtcgttggccgcatgccgtcgccgctagacctagccggccggtcggttttgatgccgagccgagccggcggccgcctttatcgccgcccgttccctccccttcctagccgccgttagcgcagccgcctccgcatcgcctttgcgccgtcgccttcgccgccggttgtcgtcgccggcaacgcgttcgcgcgcgcgccgtcgccgtcgccgcggtcggtcggccggccgtgagccaagccgagccggtgccgctgccccttctctcccgcgccgctg

SEQ ID NO: 93242 - DNA, 604 bp, Oryza sativa
cggaccattgccggaatcactgctggggtgcacaccattagcgcggtttttgccgttgctgccctcgcctgttgcgcggctaccagtcctggtgtagaccatctggagggaaaagcagacgggggggaaagaagaaaaacagatgctcagaaactaagctttattacaaaggaattaaaactgcaattgttctgatctgaattaaaacacttaaagagcaagcaaaaatccttattaagacagccatatcataggcacatgatatcgaccgtcgactgaccccaaacaagcaacctaaacacaccaactaacaagcagaagctagacagtcgataaactaatgggaaaaacgagcctaatgctcggaacggctcctgcggtcggtggagtcgaaggcgtcctcctgctcgtcaccaagtccctctgagcgactcctggagcctggcagatacgtctcgccgctgccactgggagtagcagacaaccaacctccggtgccactggctggacctctggcggctgatgctggagcgaaggagagagcggactcgggagctggagctggagctgcaggaactgcgggcggaactggaggtgctgcggg

SEQ ID NO: 93243 - DNA, 856 bp, Oryza sativa
gaagggagctcacttttgaggaaggagattacgtgtatcttcgtgtcactccgctccggggagtacaccatttccagacaaaaggcaagttggcaccacgcttcgtgggaccatacaaaattttggaacgaaggggagaagttgcttatcagctagaacttccatccaacatgatcggcatccatgacgtgttccatgtgtcccaattaaagaagtgcttaagggtacctgaagaacaggttgattcggagcacattgatatccaagaggacctaacctatgtggagaagccggttcgtatacttgataccagcgaaagaagaaccagaaataaggtcaccaggttttgccgagttcagtggaatcatcattcagaagaggaagcaacctgggaaagggaagatgagttgaaagccgcccatccgcacctcttcaccagctcctccgaatctcggggccgagattccgtttaaggggggtaggtttgtcacaccccgaagtttccctcccaagccaaaattgtaatttataaatgaccctaagaaaataccggtgcaaatcaggagaaaaccctaagaaagtaatgcaaataataatcggatttgacatgtgggactttttcttgagttctacaggtcgaaattcattaacaggatttttagtggaattttcagagctctagaaataattgtaaccaattaaaattgagcaagcaatattttaattccagggaaaacctttttcctttttctttttctttgacctctctttttcctcctttctttcgaatgggccgccggcccattccctccttccttccctcccccttactgggccggccgcaggccgaggccca

SEQ ID NO: 93244 - DNA, 772 bp, Oryza sativa
ttacccggttcctggtcctgcgctccatggtgtccagaatcttcactggcctctccacgtaggtcaagtcttcgcgaccttcaatttgctctgagtcggcctgctcggatggcactcgaaggcatttcttgagttgcgacacatggaacacattatgcacgttgcccaagaggcgggcagctccaattggtaagcgacttctccgcgtcgagcagtgatacggaaaggacccacataccgaggtgcgagcttcccctttgtccgaaacctgtgtacacctcgcaatggcgtgacccgaacatacacaaaatcatccgctgcgaattccaggtcacggcgacggttatctgcataacttttctgccgggactgtgccatctttagattatcccgaatggttctgaccttcgcttcagcttctctcaggatatcagtcccgaacacttggctttccccaacttgatcccacattagcggtgtccggcatttgcgcccatacaacgcttcataaggtgccatttgtatgctggcttgatagctgttgttgtaggagaactcggcataggggagactcttatcccaggtcttcccgaaatccaggacacatgcgcgaagcatatcttctaggatctgatttagacgctcggtctgcccatctgtctgcaggtgatacgctgtgctgaaatttaatcgggtacccagctcttcttggagcttcttccaaaagtgaaaggggaactggcttcccctatcaaatacaatttttttgggg

SEQ ID NO: 93245 - DNA, 1005 bp, Oryza sativa
agggcagtgcagtaacttttccggcttaaagcgtctgccaccacattggctttacccgggtggtagtgaatactcatgtcatagtctttgattagttccaaccatcttcgttgccggagatttaggtccggttgggtgaagatgtatttcagacttcttatggtccgtatatatttcgcagcggttgccaatcagatagtgcctccagatcttcaaagcatgaaccactgctgccaattccaagtcatgcgttggataatttccttcgtgtggacccaactgccgcgaggcatacgcaaccactctgccctcttgcattaggacacatccaagtccgtgacgggatgcatcacaatagacttggaagtctttcgtcgggtcgggcagaatcaaaactggtgcggatactaatttcttcttgagctcctcgaaactcttatcgcactcagctgtccatttaaacttctcatctttcttaagcaactgagtcatgggtcgggcgattctggagaaattttcgatgaatcggcggtaataacccgcaagtccaagaaaactccgaatctgcgacacggtcttaggtggggtccatttggtaactgactccacgttcgatgggtcgactgccacaccctgagctgtaatgacatgacccagaaattttacttccgtcaaccagaagtcacacttgttgaacttggcgtatagctggtgctccttcaacttctcgagtactagacggagatgttgttcatgttcctcctcggactttgaatagataagaatgtcgtcgatgaacaccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatccttttcccggattctcaactggtgggtagcctgatcacaggtctatcttagaaaacactttag

SEQ ID NO: 93246 - DNA, 912 bp, Oryza sativa
aaagaataagtaaaatccatgtgaaagcctccaacaattaaaatgtgcaaagttaaaagtcgaataagggttggaggatttttgtatatttcctaaaagcctaaaatgcgtaaataaattttagtggaattttcagagcacaaataataattaagaagaaataaacaaagttaaagtggttttataaaaagaaaaaccctaaaagtctttttccccccttccccctcttgggccggctcggcccacctccctccctctctctcctctcccccgcggcccatcggcctcctccccgcgcgcgcgccgctgacgggcgggcccgcccgccaccctcgctgacgggtggggcccacccgtcatcccgtacctcgcgccgcacctgccggctcgcccgtgccctagcgccgccgccgccgcggattccgccgcatcccgccgtccccgcgcgcaataaagagggggaaatcattccccgtgattccctctccctttcccccctacttttccctctctctctccctcggattcgtttggaaactctcccgcaaacttcgccggcgcatcaatggcggccggatcttccgcgaccgattccccctcatgcggccgctctctcctcctcccaacactacataaacactccccgggcctccctccttcgtttccgccactcgccgctctctctccccgtcggaatcgagctcgggccgtcgtcctctctttccgccgtcgccgccgagctccggtccgccgccgtcgtcgccccgggcctcctcccgtttcggggtcgccttcttcgggttcgccgcgtcctcgccgatctcgtccaccccttcgttttgcccgccgaccgccggaacgccgccgtcctcgtcgacccgagccgggccgccgccttcctccggttcggtc

SEQ ID NO: 93247 - DNA, 913 bp, Oryza sativa
ccttgaatagtaatagtgaagatgtcccctcagtgatgttcgaagctggaggaagaaactacatccatgcatgtcaggaagtagcaagggcgccataggagagctccgtgatcgctacagtgatcggttggatgacaccgagtatcgctaccatcctcgtctaccacatggaagtgaccgtggcaggtacattgagagtgaaggcattgagcatgatgctaccacaaggcatttagttgagatgctgtgggctatggatgaaagccgtgcagagactgtgttagcggctcaagatcgtgaagattggaatcgtggtaagatttgcaagttagaagacaaggtggatcgtttggagaaggaactagccgcgttgaagggagaagcaccaccgcagaaggccaggatttgtcttaccgcaaggaagagagctctatttgtccctcgctatcaattggcgccaaaagttcgtgtggtggagaaagaagttgccccagcagatcctccggtcatcatcataagtgatgatgaagaagaagaatccaagcgcacccattccaagattgagtgggtagcaactcaagatgatgaagacgagccgaacgagcctacaatcgacctccgatgctcggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctttatcctaagtagtttcccccggtttctcttcttgtgccctgccagatggtgctcac

SEQ ID NO: 93248 - DNA, 3058 bp, Oryza sativa
tgctaacaaaaaagcttggagcaactaaatagccagggtggatggaataaggactttcgtgagcttcctgaagtatcaactgtttaagttctctgttatctggaacgcatacccgatttccgttccatagggttccgtgttcatcctctgtgaaaccagcggctttaccctgtttcatattcttgaggagtccatgcatgtctggatcattcttctgagcctcgcggatttgatcgagcaaggtaggcttggtttccaacgcagccaaaaatccgcgactaactatgtttaggttcagggctgccatctgttgattaagttccggtggaatgccacggatgttaagagtgttgcaatggctttttcgacttaaagcgtcggcaaccacgttggccttaccaggatgatagtgaattcccacatcataatccttgatgagttctaaccatctcctttgccgaagattcaggtccgactgagtgaagatgtatttcaaactcttatgatcagtatatatttcacagcgattcccaatgagatagtgccgccagatttttagagcatgaaccaccgcggctaactccaaatcatgggtagggtagttgccttcatgaggccgtagctggcgtgaggcataggccaccacatgaccatcctgcatgagcacgcaccccaatccttggcgcgaagcgtcacaatacaccatgaagtccttgcgagtatccggcaagattaacactggcgaggcaaccagcttttctttgagagttctgaacgccttctcgcattgcgggctccacacaaatttctcttctttcttcaacaactgtgtcatgggtcgagcgattttggagaagttctccatgaacctctgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcgacgaaggcccagcacacacaaagacaaacgagaaacaacggaagactagggcgacgaccacaggcgcttgacggcaggcacgagctagacaccaaagccttcatcttgcaggaactcctcttctgggtttgggaaaaattgagcaagactgagtacaaccaccgtactcaacaagacacacccacaagtgcagaataaatgcaagggagtacaagggagttataatataaagggttagggtttgcagtaaacagcattaaaagacacttagttgctcaaagctattttgtaaacatgattctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaactttggtacattgctcggcttgcccataaccgagggcgcggctattcgaatagattatactctgatcagaggtgtagatctttacccacaagacacatcttcctcacatgtaaccacgtgccacataccaccacggtatacagacggaagacatgacatagtttccaacccatcctagccatagacaagagtaccgacccaatcccacctacggccggaacacccgggacaggcaggcaggactgagcccctagcaggaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaagccaattccacaataatccaacagttccacaagtgtccaggtgatatgaatattcccaaagtctagagttgtaaaaccacctaatgttacctaattaaaagcgaagcatctacctaaaatcatgctagtggtaccatgagtagagtgtccactagttggggttttgtttaatctagggtgaacaaagaaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttctttatttaaattttaatttaaaaagggtttattgcgtcagccgagggggagggggtgcgcggaccgggtccatgggagtggggcccacgcggcagcctcacggtccacggtggaccgggtgcaccctggctcacgccggccggcgccgtgggccccacacgtcagccgcacccgagcgcgcgggcggctgacagccgggccccacgcggcagccactcggcgcgcccgagggcggccatgccggcgcggtcgacgggaggcggcttccctcgcccggagaccatcagctcggcggagcggcggccgagagaggggagggaagggggaaaggaggcgacggtccacaactcaccccgaggcgacggcggcgacggaggaggcggccagagcg

SEQ ID NO: 93249 - DNA, 1384 bp, Oryza sativa
cccgtataggaatatgagaaagaatttcaatggacacaaagatacagccggacccccggcagagctaacagggatagaggtgcacaacttagtgatgggaataaccaacgagtttggaaaaaagaggaaaattggaaagcgaaaagagaagagcacatcgaaggaaaaaacagaggagcatgtggaaaaacaaaagacaaaagagaggagcatgtggaaaaagaagtcaatattttggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcgctcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactaaagatcttaagttggtaggaatgaagtcgcatgattgccacgttcttatcacacagctgttgcccgttgcaataaggaatattttgcctcctaaggtgcgacacacgatccagcggttgtgttccttcttcgatgcaatcggccagaagatcattgatcccgagggactagatgaactaaaggcagaacttgtgagaaccatatgtcatcttgagatgtactttcctccaactttctttgacataatggaacatcttccggtgcaccttgtgaggcaaacaaagtgctgtggttcagcattcatgacgcagatgtatccttgcgaaaggtacctggggatccttaagggttatgtacggaaccgttcacaccccgaggggagtatcatcgagagttacaccactgaagaggtcatcgaattttgtgtggactacatgtcagaaacatcttcaattggattaccacgatctcatcacgaagggaggcttgatggtgttggtactgttggaagaaagactattaggttggatcggaaggtgtacgataaagctcatttcacggtactacaacatatgactgaggtggtgccgtacgttgacgaacaccttgagttatccgacaagagaacccaggccgatcagagagttgggtcaggaataagcacatgtcttctttcaacgagtggctgaagaaccgaattgccaggttgcagaacttgtctagtgaaacacttcagtggttgtcacagggtcttgaatggagtgccaccacctggcaaggatatgacataaatggatacacctttcacacggtaaagcaagacagcaa

SEQ ID NO: 93250 - DNA, 1008 bp, Oryza sativa
agggtgctaacaaaagggtccgctacaccaatccctatccagggggatcctcctcgcagcagcaacaccagcagcagcaacctcgctccgcgcctggacctcaattcgtggtgcgcgtcccacagccgcagcaacagcagaatcagcaggggactcgtgcaccccatcctcctacgccaactgtgcagtctggtcaaggccgcagggacgctcaaggtcagcagcgtctgtgcttcaactgcttcgagcccgggcactttgcggataaatgcccgaaaccaaggcgtcagcaaggccaagcgcctccccgctccaagaacggcgggaaggatgtcattcggggtcgtgtgaatcacgtgacggccgaggacgtgctgacaactccagacgtcatcgttggtacgttcctcgttcattccatccctgctacaattttgttcgactctggagcttcccactcgtttatatttgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattttgctagacaccaagaatttggatgtgatccttgggatgaattggttggctcaattccaaggagtagtggattgcgcgagacgcactgttactctgtaccgagggccggcacaaccagttgttttctttgcaccctcaacctctatcagaagttcagaacttcatcagataggactgtcagaaatccccatcgtcagggagttcggagatgtgtttccggaagaactacccggtatgccgcccaaacgagagattgagttccggatagatcttgctccaggaaccactcctctgcacaagcgaccctaccgtatggcagcaaatgaactggccgaagtaaagaaacagttggaagagttgaaagaaaagggatacatacgtccgagta

SEQ ID NO: 93251 - DNA, 962 bp, Oryza sativa
tatagggcgaattcgagctcggtacccgtccgattttgcaggagaagactttgaggaattccaaggccagcaagacaagtcacacaaatcccaaacaaccttttgagcatgttgatcccgtttaaagctattgtttctattcaactattgcatttattttcgaatgtaattaggtggaattcacctattgtttgttatggcccttttgttcttgattactttaatccttgataccttaggctattataatttgactagttgagctttatatgatggttcagctagatattagacataattgctttgtcatgcttagaagcattagttcactacggggataacttatgattcactattatttaatgatggattaatgatagctcatgatggttaatcatgaatggttaattaattaatttgccaactaaaacctgataatggtgggttgtgagcacatggttttgatgatcgtgctcatgacaattaaggaccggttcacgattttcggctgtgaaacatttaccatgccaaccacaagccagcgtgggcaacggctttattttctatatagtatggttcatagtagagcaccagactgtgaagtggcggagataagcccacgggggtcgctggggagtccataccttgttcataagggagtgattatgatccgggaacggtgcactgctttgaattgtattatatagagggtattgtcacaatctctattcgggtacttgtcaagtatcgtgacgcatggttgacatgatgttgaggttgtgtgttgtgggtacagtggtacacctctggccagagtttgaactattcgaatagccgtgcccgctgttatgggcgggtctaacaatgtctttcgtgattagtctcacactttacactctaataaatgacgatgttaatgacttgattagctcctggtttggaatagttaattcctggtttgg

SEQ ID NO: 93252 - DNA, 711 bp, Oryza sativa
ttgtgggtacagtggtacatctctggccagagtaaaactattcgaatagccgtgcccgcggttatgggcgggttgagtaatgtttttcgtaattagtctcacacctctcacaaataattattgatgcaataactggtaataatttattttgctcctggtttggagttagatctgtacagccgggtatggttgttcaggatggttgggcctgagcagcatgggtgctgctgttcagtgttgattaaaatttctaattaattactctattgttttactactcttaactctttgctaaatgctgcttttgcaaatgagcctatattatgccatcctttggtatccttgtgcacttgcatatttgctgtgtggcttgttgagtatgtcatatgctcaccttgcaataatcatcaaacctcagttgaagagaaaggatccagaaggagaagacgtttggcttataccccagttgagctgcctgtgggagtggagctgaagccatcgctagaccgttaattccgcagctgtttttcttttcttttgtaagtatgtaacgttattattatgatggatttgtatattaaattgtcagtttgtgtacctcggctgattcctggacgaggattttatgcacaaattagttcggaaattacttgtgaatttccgggcgtgacagtctatataaagcacccctgttccctcctctctcttttt

SEQ ID NO: 93253 - DNA, 539 bp, Oryza sativa
ctatagggcgaattcgagctcggtaccccaccagctagctacggggaggctatacgagctgctactcaaagctaaggggaagagatggagcgaggagggagaacggagggatgccctaccgagacgaggcggggcgctgtgacgagaggccgacggcacgggagtgatctctccggcctcgggccggggaagagaaagaagacgagcgcccggagtccccttcacgcgtccttcgcacgcaccggctctcccggtgctttggcgacgaacggcggaggtgcaagcagggcggagcgacgatggtgcggaggagttggaaggcgaaaacaagggagtttgaaatggggaaggggctcggatttataggggcgataatgtcggtttgggagggaggaaccgacattgggcggtcaagccagcgagctggctctccggctagcggccaaaacggcgacagggaggatgacaccggcgggggaaaaaagaagaaaagatagagggaaagaagacttgcctcttgccactttgggaaaagaagg

SEQ ID NO: 93254 - DNA, 1738 bp, Oryza sativa
ttttataatttctagaagtccctaaaaaaattgattttttgtcaaattttaattaatatcgtattgtattcttttaatatttttattttttattttcaaattcagttgtttcaaaattgtatttctacttgaactctcttttttttataattttggatattgttttattttttttattttgaattttaattaatctcgtattgggttcttatatggattcttctttcaatattgcttatttttaattctgaattttagctaattctaaattgttttcttacttgaactcttctttcttttttgctaatttcggattttatttttatttttattctcaattttaattaatctcgtagagggttcttatatagactcttcttttaatatttcttatttttaattccgaatttcagctattttaaaattgtattcctacttggacaatccttttcttttctaattttggattttattttatttatatttcaaatattgattaatctcgtattgggttcttatatggaaacttctttcaatattgcttatttttaattccgaatttcagctatttttaaattgtatttctacttggagtcaccttttctttttttttatttttcttcgattaatgtgggaatttctagctcccacagcgaatgtggtacctcctttcaaagctgttttaataatataatagatagatagattgttcaggtgatatatgtgttgccacggctcatgtttctagattcacatgagcatgagttaagtttgagatgttgtagatctttagccattttgtcaagtctgctaaatgtgtaacacatctggtcgccgccttcgagtggtttgatgggcacatctcaggctgaagttgactgccaggctaaaggctcagcattgtctccaatattattctctcgaggcgtcggatgtttcattatgcttgtttgatgacttgaattattcacttcatctctcaaatataatggaaggtccggagagcctaccacaatcacataggtattgtttcaccttgtgcatgttgaaaattatactctggcactggccttcccgtaacacctcgtattttcatatattttgctgaaaaattgcattccctagacaagtttgttcttttgcaaagttgcagtgttttccagattttcctctgtgctcaagtctggtagcttctgtaggtctgttctttcccgtgcagttgttttgttatgttgattcatgccactaaaaacatgaaaagttactgctgcgatagtttaagaatctaaatgatttgtacttataatcgttgtcctattgcgggtgtgctgccacaagcaaagatgctgtctggactgaagggagtttctactaacggttccttttctgtgcgtctgtgaatgagcaggacaagtggactctcttattgaaaacctggaaaaacttttgccagatgcaattttttgtgtggttggatctcacgaactgcatcatttgtatcttctgggttgaagccttagaagactaaactatccattcaagttgcaaagggaatgaaagagttagagaatctacaattagtaatgcaagatatcctgaggcgtaatgttccaggtatatatatgccagaagttatcactttatctacataagacgtgaacacgttttttttgttaactacatgatctgtctgatttgaaaattgaaatgtgagcagcaccagcagcattggatccca

SEQ ID NO: 93255 - DNA, 712 bp, Oryza sativa
atgtgttacacatcaggaagacttgacaaaatggctaaagatctcaacatctcaaacttaactcatgctcatgtgaatctagaaacatgagccgtggcaacacatatatcacctgaacaatctatctatctattatattattaaaacagctttgaaaggaggtaccacattcgctgtgggagctagaaattcccacattaatcgaagaaaaataaaaaaaaagaaaaggtgactccaagtagaaatacaatttaaaaatagctgaaattcggaattaaaaataagcaatattgaaagaagtttccatataagaacccaatacgagattaatcaatatttgaaatataaataaaataaaatccaaaattagaaaagaaaaggattgtccaagtaggaatacaattttaaaatagctgaaattcggaattaaaaataagaaatattaaaagaagagtctatataagaaccctctacgagattaattaaaattgagaataaaaataaaaataaaatccgaaattagcaaaaaagaaagaagagttcaagtaagaaaacaatttagaattagctaaaattcagaattaaaaataagcaatattgaaagaagaatccatataagaacccaatacgagattaattaaaattcaaataaaaaaaataaaacaatatccaaaattatgggtaccgagctcgaattcgccctatagtagtc

SEQ ID NO: 93256 - DNA, 663 bp, Oryza sativa
caaatgtgctaccttcagtctgaatggaggaatccaatcttcctcgaagaccatctgcttgaaagagttcccagagaggtacaaatattttaagttcagtaaacttgaaaaatgctcctcggaaatctgtccggtgaaattattccaaccgagatttaggtaaatcatgtttctaagtgctccaaaacccacaggcagctcaccagtcagtgtgttgtgtgagagatcaacaaaatccaggctgctcaactttcctatccaaaccggcagctcaccgctcaaattcgtagaatgcaggtccatctctcgcaacttattccatgaacacctcggtaatctctccatgaattctgttgcgtccccatcaatatagttgtcatataggctaacaacctgcagatcacacagatgctgcagggttgtcggtatggtccccattaggttgttgtggccaagatccataacctgaagtgcagacatgttaccaaatgcgtccggaatggacccaaaccaatggccttctgtcagatagagctccttgatgcctttgtgatcccaaagccatttctgctgaatcgaagcattgaatttgttgactgaaagatcgaggacctcaagacgtgtgaggttgaaatgtgacatggtagagatggcactctcaag

SEQ ID NO: 93257 - DNA, 1753 bp, Oryza sativa
cttataaggagggacttggatcgatccatgacaagccatccgataagaccacaatgcttcggccaatcgagtatgccactgccgaggataatctgaaatctttctcttaatcaatttgatcaagctcttgttagatgcctcggcctgcccattagcttgtgcataatatggtgaagaattcaacaatttgatacccatgctatcggcaaactgaacaaactcatcggacacgaaaattgaaccttgatcggttgtaatggtttgagggataccaaatcgatagattatatgttcttgaacaaattgtatagcatccaaagaatcaatattcttcaaaggaatcgcctctacccacttggtaaaataatcggtcgccaccaatataaacttatgtcctttactcgatggtggattaattatgccgatcatatcaattccccaacctctaaatggccatggtttaatgataggattcatagccgacgccggtgccctttgaatcgctccaaatttctgacaatcttgataccctttgtaatacctgaaacaatcttctagcattgtcggccaaaaataccctgcacgccaaagcaaccacttcatcttatgagccgattgatgggtaccacaaatcccttcatgaacttcgccaattgcaaccttaacctgattggcactcaaaaacttcagcaacaccccatcaatcatcctataatagagttcatctccaataaagtgtacttcaacgctttataccttaatttccgagaagccgattgagatggattttgcagataatgatgcacatcatacctccaatcatcggctgttaatgtggcaacttctattttgacatacttcatcatcggcttgtaacccgatgcccctttagccaaatcattagcttcaacattctgttctcgagatacatgcttcaaagtcaccagccgaaattctttcatcaactcttggcatttctcattgtaaaccattaatgtatcatttttgcactcatattctcctaccaattgactgaccactagcaaggaatcacccatgatctccacagcatcggcttcaacttccttgagtaattgcaaccctttgagaaccgcttcatactcagcctgattattagttgcataaggtttaatagtataagcaaactcaaaacttgccccccgaggggaaattataaccaagccgataccgcatccatgagtgcacactgacccatcgaagaataaagtccagggcacaacttcaactgagccgattgagtcatcacgatgatcaacgataaaatcagctatagcttgccccttgaccgccttcggtgattcataccgaagatcaaattccgttaaggaaaatatccactttccaacccttcctttcaaaatcggagccgataacatatataactacatcggccttgcatataacagtgcattcattggacaatagataatgccttaaccttgtacaagaaaaatataagcacaagcacaacttctccacaggagaatatcttgtttctgcatccaaaagccgacgacttaaatatagaacacaaccctttcttttccttcaagctcctgaatcaaaaccgagccgattgacttctcaccggctgatagatataacctaaaaggtattcccttctgtggaggaatcaaaactggaggagagctaagatattctttaatactatccaaagccttctgatgctctgcccccaagtaaatttttg

SEQ ID NO: 93258 - DNA, 746 bp, Oryza sativa
cctccgatgccgccgccatggggtatgccatggggatagtagctgtagctaatgtagcacttctcgaggtacacctggcctgatggcgcgcccccgcactcgacctcgacgtgctggacggcctgggtgacgcactggccgcagtcccccgaggagaggtcgccctcgcactgcgccatggcgtacacctgctggtagctggtggcgtagaacccgccgtttcccccgccgacgctggcctccatctgcgcgaaggcggtgtcgcggcgcatctcgaagtcggtcccgccgccgccgccggtgccgcaggtcttgaacagcatctgggtcccggacacctgggggaacccggatatctcgtagagcgcgaggcagccggtgagctggacacgggcggcgacggaggcgccgcaaacctcggaccaggatgacatggcgcgggagacgcaggcggcgcagtcggagccggagaggtccccgcggcactggaagaggccgaagacggaggtggaggaagccgaggatgacgacgaggtcttgtagaacttggcggaggcggactggtccgagagcgaggaggagagcgcggcgactgtggggggcaccgcgccgccggggaagctctggttggagcagcccttgtagacgagcgcgtacaggtcggcggaggacaccggcagcgaccggagaacgacgacgacggcgacgtggagcagcagcagcaggagagctctgggaatgcccat

SEQ ID NO: 93259 - DNA, 735 bp, Oryza sativa
  unsure (1)..(735): unsure at all n locations
aatgaatgacatgcgacaccaccnnacananggngnatggcgactacctccgccgtcggattgcgccgatccagcggcgcgctcggggcgcctgggagtacaccgtgttctaagactgcatgaggacccaccagggagtgagatgggactgggctcctgaggactttaagatattggtccaaccgatgctgaatatcaactacgtggaggccgccctcattacccaaggaatgcttcccctctgcagcgatccaaaccgcgccttcatattgaccattatgatggcggtcggggcctcagaggagcgagctccaaagggccactacggcgcaagcaggaaccgccggggggaacaatctaccccgagagagggtcgtgcttctgtgtcccggggcaggggcccggggagcaaacgtcctacctacgcccggtggaagatgaagcatggaggaacaccttccccatctgctttccgagggggcggtgcagagcgtgccagcagaaaagcgccatatgtgtgccccccagcataagtacccgagggggagcgcaagaagaaacggtccctcaagatggaggagacagaaccatctctgggaaacccttattccccttcaaagtgggcgataaccgacccccttgatgttcgcctctaccctcgtggctgatttattctttcacgcaggttttaattacccatcctggtcgcttctggattttatttgtttgacaaga

SEQ ID NO: 93260 - DNA, 2005 bp, Oryza sativa
  unsure (1)..(2005): unsure at all n locations
actcacgtacatcagcccctttgtcagtgacacggttactactccttggtaggcgagcataccacgtatcctcatcggagacaaattcatcatgtccatcgtccaatatccaattatgaagggcacaacaagcgataaccaccattgcttgggctttcaagggtatgaatggcttattcataagaatcttgaagcggttcttaagagcaccaaaagctcgttcaattgtagttcgaagtgaagaatgacgatagttgaatagctcttttgggcattttggaccttgagggccacgaaactcttttaggtgatatcgaacacgacgatatggcggcaatatacccggcctagcagcatatccagcatcagccaaaaaatatttccctacaaccatcaatcatgtcatatatgagcctaatgttatcttcttacaacaaggctaattacgattctttcaaaatgtttaattaccttatggtattttaagaccatttgggcgcgacaatgcatcttgcaagacaagagaatcatgagctgacccctcccancctgatagaatatatgtgaacctaaggtcaaagtcgccagcagccaatacgttttgtgtggggtatgacttgcggcctctaaacctatccaccttcttggctggcacacttgccttgatgtgtgtgccgtctagtgccccaatacagccctaagtgcagacaaaataaaaacatccgagtgaaataaacaaaagttaatggaatatgaattattgtctcttggtatttagagttcccccaaaatatggatagaatttgtttgggttgctggtgatcttagtatgtgtatcggcagacctgacataaatgagttctcgagctaactcacacatggcccgcaacacaatatgaaaatacctactcactgtctcaccagatcgccaaaatgagaatcctacagatggaactgaatgatgttgtccacccttcttcagaaacattgccacttgctcctctactgaaacatgaaaggtgtcaactagtagtcccttgttcttaagacgagaacagagcctgtagaataactgacggggcattctcaattgttgtgtgcatatcctatctgaagtgtcgatcaacctaattaattcacttgttctccatacatccctatggatcaggggcccataccgtacccctttgcatttacttcttttaccatttttattcctcaaccagacgaggatcaaaaccagaagtatcactacagccttttgcctcaacaagaagcaatgcacatattgctgtcgattgctctccatctggaagcagattaccagtttgaaattactttagaaaatcaaatactattgtgccaacatacagatttatccaaaaaaaaggagatattcacttagatgtaaaaggacacactaataaagtacaggtgaaataagcatcaacactaaactagtaagatgttcggccaactaacttttattactactagtacataagatgctagggtaccgaggcagattatacatcagaaattttattatcaacacaagtgggaaagcattctatggaaggaatggttacctttgtgtgatggcacttgagcgcgacggagtcagtagagctgcagctgaaatcgcggcgcccgtatgccgtcctctgtcgcctgagcagaacccttccgcctcactctcgtcccctccccagcagatttactccaaaatttctaccccatttgatcagctcttatgggtttgattgtttgagaagatgactatggatggcaagatgggcttctgtgtcttctagctcgggattggaggagctataggttgtggcctgtggctagagaagatgatgagcggtaggtggatgccaataaatgggaatatctgcttgtgtactactgtgcagcttggatatggagcgtcatccgagcccgcgcaagagtttaaatttcacgcctacgttttggctcttgtcaatggcgtgacctattg

SEQ ID NO: 93261 - DNA, 979 bp, Oryza sativa
aagaaaagcaggagctgccagtcatgtcacaagtcaccatgttcttgcaggagcgaagtattccattcagatttgtacccgacacttcctgcgaagatgatgatactggaattcctcatcagaagcctgaggcacccaagaagaacccacaatgtgagtgatcttgatgacatgatcagcaatggagctagcacagggagtgtagttcttggtccttcggagaaaatgatgttggattctttgcattcacttgttgatgcgaaaacgaggccaaaaagtccttcattcttccactcaggaaccaagatgagaaaagctcggtcaaaatcccacatcataacacagtcagagatactgaagctgatatctcctgagacatgggagatctcctcccctggcgtgtcgccgttgaagaagagcacagctgagttgagcatgcatgagaagatggtgtcctcagatacaccatccatgagttcaaatcaacctgttctgtcctcatgtccatcttctttaagtgcagggcttctacaatgcatatggaaggatgggcttccacactttgaactgtcactggacaatcctatggcagtatacactgccaatcctacaaaggcccatgacaatgacaagccccttgactatgtctatttgttccattcaggagagcaagggagaaaagattggttaggcaactcaagcagtgtatcacggcttgtcggcaagatgaaggtgtcaagttctttggttctgaacccagacaagtctacttctatggagacagagtttgtcctgtatggttctccggatgactacctgaggcaaatgcaaagttcatatggtgttacaaaaggcaaggggctagccaagagagtggcagacattatgaagccatccaatttgaactctagtccgaaacatgtgtggaagtttggcaaatcgtcctcccaacagattgatgagatgactgaaatacctg

SEQ ID NO: 93262 - DNA, 2391 bp, Oryza sativa
ccaaaggtcagcacactccttcccgatgggtccagtgatagcagaacctgatagaacatatagaccatatataatcagttaacatgtccaatttagattattcagcatcaagaaagtcaagttctgcattgttacctttcatctcacccttaggattcacaatcactccagcattatctgcaaatgaatcacaacaacaatcagctaaatggttttggagtttatcataggagtagcaaaataaaccaagcaaactaataataactaccagtccaagaacaacttatatgaaaatatggaataattgattttccaaattgaatgaactgagtaaaaatgactgcctcatggcctagaccgaatgtttaattgcggcaacgccactaacaagggccatggaatatgagtctacattcagatggagcaattcctagggaaaacctcaacatccaaatgtttactttatgacgtctacctgggactatgcaaacatgaggtttgctccaaaaaggttgagggactcagatgtccctccatcaaatagcaacaactttaggcattacaaatacaaatgagaaaattgaaggtgagctgttaaaatgactgcctcatggcctagacccaatgtttaattgcaacaacgccactaacaagggccatggaatatgagtctgccaacagatggaggaattctgaaaaaacctcaacatccacaggcttactttatgacgttagattaggactatgcaaacatgtaaggtttgctccaaaaaaatgctgaaggactccgatgtccccccgtcaatagaagaaatgttgcatgggataacaaaagaagttccaaataaaatgtaagatatctaacagagaacaaaatatgattgttaggaagcatttaaaatgattgcctcatggcctagacccaatgtttaattgcagcaacgccgctaacaagggccatggaatatgagtctgccatcagatggaggaagtcacaaggaaaacctcaacacccaaaggcttactttatgacgtttgcctaggaatatgcaaacatgtgaggtttgctccttaaaggctgaaggactcggatgtccccccgtcaagcagtaaagtgtacaagttaatcacaacaaaaacagagtgctgaacaattataaatttgtcatacaaagtacaactctaggattggatatggaaataacaaaatacatttgtagaaataaaaagtacaaaataaaaaaaatgagaaatggtgtaactgtgtgcaataaaaatgatgactcatggcctagacacaatatttctatgcagcaatgctaaatcacagataacctgggatatgggatataatacagaatgtaaagttcagtatacaaatatatataataaatacgttgcaaagaaatgtctattttaaaatgatctcatctagaatgatattcactgatataacgtaagataaaaattcccatgaatattccagagaattaaatccagcccaagaaaaatagggcatatttgaattttaggttgggggaatattcgcctcatggccaatcccaaattttcaaggcagcaacgccgctacacaaggcaatggaatatgaggcagcccacagatggaggacatggataaaggaaaaatctttcatgcaaaaacctcaacacccgagggcttaatctctgacgtttactttggaatatacagatactgtaatatctgctccagtttaagctggagagcccggcggccctcccgtcatccacactctaaccaaacatctaaactaacagtagcaaaggacacaggtataatatagggttcaaatttcgcagcacacgattattgcaagaagaaaacaacaggtgtaagaggtgatctgtgaataataccttcgaagtacatgtagacacagtagcaaagcacacaagtataatatagggttcaaatttcgcatcacatgataattacaacaacaaaacaacaggtgtaagaggtgtaagaggtcatctgtgaataataccttcgaagtacatgtagacaccgtccttgcggcgccacggcttgcgctggcggacgatgacggcgggcatgaccttcttacggagatcgggcttgcccttcttgacggtggccatgaccatgtcgccgacgcaggcggacgggaggcggttgaggcggcccttgatgcccttcacggagatgatgtagaggttcttggccccggtgttgtccgcgcagttcaccgtcgccgccacaggcagacccagcgacatccggaacttgttccccgccgaccctcccctccctgcatcaccatcagatcgcaacacgaaacaaacagattagagcgcaagatttgcaagcacagtggttgaatcgaatgg

SEQ ID NO: 93263 - DNA, 599 bp, Oryza sativa
ggcggattttttcttccaacctcaagatttttccggggcattctgatcttctatgggattagcttgcatcatctgaatccaaactccatagtgtatattgccaattttaattcatgcctgcgaagcttttctgggcattaggccccatttcgccttgttccgccacatcttcttcctcaagccccagccgaataagagtaaaccatgcgtcgttgggggtgctggtttccaactcaggggaacactaagccaaaaatacttctccatgccctttaagacctcaaataaaggctggcacgcaaattggttttatgttcaaaaccccgagcccgttcttccctagtactcctgtcttcctccagtttatcgagatacttggaactcactaccaatgggagatgaagctgcacaagcagtagaactgatggagaggatgataaagctgaaagaacagggccttcaaggagaacagatcacccggcactttatcaagtgtcggttagctccaatcaaagaaagatctcgcacagccttcaaatttgacggcaagcatgacccaaaccgtgaagatccagattctcttgacttcaaggttatga

SEQ ID NO: 93264 - DNA, 1289 bp, Oryza sativa
gactactatagggcgaattcgagctcggtaccctaacttataagcatgcgtacaaatatagagcagatgtatatatctctactattataaaaattgaagatgtttttaccggtattttggtacgtcatatgtatttgggtcgatttttaagtttgttcgcttttggaaatacaaaagaagtcgtatgaaaaatttcttttaaaaaacttgcatgctttgttcgcttttggaaatacaaatccgtgtatgagtcagattttaaattcgtttgcttttgaaaatacaaaagatgttgtataagaattttttaaaaaaaaaatcttgcacgctaacttgagatgaaagtcaggctcctaattctagctcatgattttctaaaagcgaattcccacagtgaatttcatccttgttaaaccgtataacaataataagattaaaataacattcacccgttgcaacgcacgaataatttttgtaggtacaagtataaagcacgggtgcagccaatgagatctaaacatgaactgaaagacggtcccagcaaactggataaaacagaacaccacacgctatcacaaattattgctagctgattgcaagctcgacagcataacaaagatcttcgattatctggcagatcgattagttaacgttgttgattacctaccttctcttaaccctgaccattaagccattcttcatgtggagaaccatggacagcttgggctccacgatatgtcctggcacggcctcgatctcgaagttcttcaccacagtagccgccacgaccttgagctgcactaacgccatgtccttgcctaggcaggtccgaggccccgtgatgaagggcgtgaacttgtacgacggcacgtaccgcagcttgccgtcgtcggagatccaccgctccggcctgaactccatgcagtcgctgccccacacggactccgtcctacccatcgcatagatggacaccacgatcttgtcaccagggcgcaccttgtgcccgctcggcatcacgtcggcggcaaccacgcctttgtggtccagcggaacaggtgggtagagcctaagcgactcgcacacggcggcgtgcaggtacacgagtgacttgagctcgtccgggtcgaaggtcaccatgccgtccggggtggtggtggcgcgctcgacggagtcaagctcctctaggatcttggacgccacatgagggttcttggtgaggaggtagaagaaccatgatagtgccgagcctatcgtgtcgcggccggcagcaatgagggtcatggtcgtgt

SEQ ID NO: 93265 - DNA, 899 bp, Oryza sativa
atgatttgatttttcaatgccatatggacgtgaggatcaggtcaaatcagtcacgtaagtgccaaccatgatggcctgaaatcattgttcaaactgttgtggtatatcgtttgcattgattttaggagataagggatgttgtgcccggtttaacggttgagggatgcgatcaaactcaggctttagagaagggagctatagtgaactttttcctccagattataagctgttggaagtagagcctgatctgctattaggcccgcagtgtaatggaatattgagcgacatcacactgtttattgggcctgacattcctagcttaatgggctattaataggctttgacaacttggctgacgtcacacaacaggatggaccttcaactctaacgtttttatggaacacacgtgagaactagcgtacagagagggtctcgcctggtgaaatcgaacagaccgtttacattttacaacacggtgatagagatacgtaggccatgcatagtgaaaaccgtacatgcccgtgtacaaacacgtacgatatgttttcaccgatgggttaattggcacacggtcgatctaccgcttcttcaccttcaccatgaggccgttcttgatctgcatcacgatcgacaccttgggctccacggcgtggccggccaccacctcgaggtcgaagttccaggccacggcggcggcgacgctcttcatctgcagcaccgagatgtccttcccgaggcacagcctcggcccggcgttgaacggcatgaacctgtgcgccggcacgtgccgcagtttgccgtcctccgtcacccaccgctccggcctgtactcgccgctgtccttcccccacacgctcgccatcctgcccatggagtacaccggtatcaggatgttgtcc

SEQ ID NO: 93266 - DNA, 574 bp, Oryza sativa
tccaccggagcataacgagccagacgattgaactcatgcagatactcagtgactgtgcgggaaccctgtgtgagcgacctgaatttcttcttcttgagagacaccactcccgatggtatgtgcgtcttccggaaagcagcggtgaattcaagccaagagataggttcagcagtagtcctgttaaggcggaagtgatcccaccactccgatgcagggccatgcagctggtgtgaagcaaaagagaccttctcctggtctgtgcactgaagcagatccaacttcttctctatggcgtgcagccaatcgccagcttcaacaggattagtggtgctagacaaaacaggtggcctcacgcgaagaaactctgccagcttgttttggggaggtgcatgattgttcccttggttctgctggttttggagttgctgcatcatcaaattcatcaactgtgcctggtgagccaggacttgagcaagcatgggattctctgcattgttgaagttgtgggggttggggccattcccattgctgcgagtgagcgccatctgacatagacaggagcacaagaagagaa

SEQ ID NO: 93267 - DNA, 630 bp, Oryza sativa
aacaaccaaagtatgtgaataaattgtattaactattacggcaaactagcggagataatagacaaacctttcaagaggtaatagttccaaaatcagcaagaatttcttttaatttctcatcgtcgtagatgctatcatccaagtttttcaaatacaagttagttccctggttcttatccgccgcctttttgatgttcttctcaaatttttctttcaattccatctccctctctgacttcttctgagctcaacaaacataccattccttgtcatcaactgtcttgccattctaatctccaacagctcgagcagcatcatctggattttcaaagttaacaaatccatagcatatagatttcccatctccttcacgcattacaacgacactagttgtgggtccaaattaaccaaaaatttcctttaaatgatcttcagttgttgattccgataggttctttacacacacattgttaaatttgggattgcatgatacattttccctgtcctgtttacgaacaaaaggccctacatacccctttttgtcattcaaaagcatcccattgagctaacaaatagcattctgggcagcttcttccagctcaaaataaacaaaaccatatcccttcgact

SEQ ID NO: 93268 - DNA, 1346 bp, Oryza sativa
gagctcggtacccctttgcacaagcctcggcatgccgcttcaaatgtcctgttccaccagatgatttcgcagataacttatttttgcatattctacatctcgcgaatgttacctgccttccatcagggcctgtcatggccacctcatcgaaatgttgccaaacaccggaagttcttgatctctttgagccggtgttcgtcgatacactcccactcatagtgccggatgcttctgaacccgccggtggctccataactggtggtgttggagccgatccggtggcatcatacttaccagttgggaatgacctcgacacgtagttagggtcgaaatcacctaacgtgaacgatggaatgttcgattcgtccattctgaaaatttaaaacaacataaacaaatttcagaatatttattcgcataacatgaaataaaataatacataaaactgaatatatgacgtacttctttcttaccacctttgcttggctttacacctcttgtatgcactatttttagtcacaaactatttttgattttagacaaaattttgtcaaattttgtctaaatcaaaaaatcgatctatcacacgaaagagcacaacagagcacaaaatgggaggtatggacgattcagaatgctccggtgggtgtcctatttatagaaacaaatttcatatttttttcgaatttttttccatttttttgctctccaacggctacttctcaaaaacagcggtcgttggattagctcactagccgttggggacacgtggcactctcgcattcgtcgtttgactagctgttcggccgccgtacgggatctcgctgagtcgcctgtcgccgtctcggctgctcccaacgaggcacggagtgacggaggcagtcagagcgagagcgacccagcctcccagccccaacgacacgtcgcgacgccgcttgccacgcgccacgcggcgacgtgcgcttcccgccgcctggccccgcggctgccctcggcggctcggccgcttggcgccacgtgcgcggtgtgcctaccctaggccgctcccgtgccgtgccgtgctcgcgggccgtgccgtgccagccctctacagtaaacgtgccgtgtcgtgctggcccacgggctatggcgtcagcccagacacggcacgggtaaacaggccgtgccggcacggcccacaggccggcgtgctgtgccgggcctgggccttctacagtgcggtcgtgcttgggcccgcccggctttggcacggcccatttggccaggtataggtggatccccacccaccacccaatccacttccacggtgggtgttaaactcccatgctattcggctggggaaaaca

SEQ ID NO: 93269 - DNA, 3880 bp, Oryza sativa
ctttgtcttgcacggcagcagtttgttaggtagttagcgtccatcagagcaactcagccgccagtagtatatgcggacgtgcaaaagaagaattagaaaaacaatatcaatctgtgattagaaactaatctaacagagattaaattaaaaggatgaacccagatcatgcatgtcgatcggtcgacatgtgcatgtggattactcctggaggctggcgatctcgtgcgcgagccgtgagcactgccgttccacgttgctcccatgtcaggttacaccgccaccggcatctgcacacggggcatggaggaacacgacgtattgggctgacacaccgggatgacagccattggtcttgatctcagtcggcatgcaaaaataagagaaagtaataggagattaatctgtagctagaaatcaatttaactagtgaaacgataaaattatctaatgaagttggagattgaatcgatgaaatcgctgagattaatcccttcggctgaattgaatccaagacgaaaaagacatgcttcacgaatccggcgatgccgaagattgattccatcgcactcgttgataggaaactcgacgcaacccctacctggcgcgccaactgtcgaaacatgaattcggcaataataaaagggggtagcgtacgagacctaaagtggatggatgcagagacaaaggatttagacaggttcaggccctctcaatgagaggtaataccctactcctgtttggggatttgaatccgccgggtgtagtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctgttacatattccatagatataagttatcccctataactagtcggataactacgccgtgtgggtatggggtacccataatctccacagttttctttttcttgaaagggagattgtctttatctctattggccctgtttgaatcttgctatttaagagtattaaacatagattactgacaaaacctatttcataacctctaggctattttgcgagacgaatctaacgaggtatattaatccatgatttgctacagtgatgctacagtaatcagccgctaattatggattaatatacatcattagattcgtctcacaaaatagcctaggggttatggaatcgattttttcggtaatctacgtttaataatcctaaatagtaagattccggagggctatttaatagcccggaggattcaaacaaggccattgtcatgaacatcagtaacaatttgaccatctttcgttaaaagagtatttaacgttatcccaatatgtgtatgcatggtaacctatggtgtagtgagtttatgatgttcagagcttcgtcgcaaaaagaccatgcaatttaatcaaggcctatatcaattgctttatagacttgagggaacaaggcccaggataaccggaggtttttgggccggtccaagaagagaaacactaatgcgacgctttaacgtgaaaaggccaggaaaaaaaaatcgaaaatgccatgccatgcctagcctcgaccagttaattatgcatagcctgcagccctgtacaacacagaataagttatggagtaacttattttgccctaatggcattcgcagtgcgcaccgctggcattcagctctagcccttcaactcaaatatttccagccacgtcggtctctcccgtgcccatgtgagaaacatgtagccaaagttagtcacaaatccctcatcaaaatgcgtcagagattcgtcagccgacacgagaaagagagagcgagatgagggggagggcctactagggagccaaagcatcatcatgtgttggtggcacccatttgcagccgtcattggagatcggttcctggcaagtgaaggcgtcgatcactagggcgtgctccaccgtcttcgccgatgacgccacctcctccttcacgacggtcatgtcgtcctcccttccgtctctggcgcggtagtgatggtgatggcgaccccgaaggcgcggcggcaagaggaggaagggggaggcgctgcggccggaggaggggggaggcgtagcggccggagatggaggggggaggtgcgtgactagtgaggaatgagtggcgttgagaggataagggagaaacttacttttttatttgtgtacatttcacttgaggctacatatcactgtaaaacttgtggcaagtattattcttcccgtatcttcatcctatgtggtcctcaaactagcgactagtgagccgtactgtgaatggtctaagaatatctaacttatttagaatcttaaaaatatctagcttatttagaatctcaaaagaagagtgacaattgggatggtttatgtaatctttttttttgtaaaaaaacgttctcagttttgattctgtgtaactatgccttcacgcagcatgtaaaaccggaacattatcccaaaaaaggtccccgaatacaacattttgctgtgaagtttgggtttttcaattgtaaggtgtgaatcaaagagtatatcgtgttaactgcacagaacatccagaaacagcagagatgggagaaaaaaacaggttatagtgacacgaagctcagatcagtgctgcagcattcatacgtcgtaaacttgattccgcttggtgatttacaacagcagtatacacacatactggaccagccatttagcgctccaattattggaaagctagtactgaaatgaacgcgagactaccaatactacaccatgctagtttcagagacaacaggaaggttgttcgtttgttcagatcaggttgttgccgaagccaaggacgagtgagcagcagcagcggcgaaccccgcgtagcccagcgcgtcgctgctgctaccctccggcccgtcgccgtcgtccgtgtcccacaagaacgcggcgtgcgcggcgagaacgtggctgcagagatgaacatcaacacgggtcatcagaaaattcagaactgattctcgagttcgcgtcaaagcagtagtagatcgcgacgatgcgaccatggattggtgcgtgaaagattggtcgattgcacagcgcagcgaacctgttctgcggggaggctctcgctgcccgctcgaagtagctggaggcgcggtcctcgtcgcggggcacgtcccagaccagcttggcgtactccgacaggagctcgccgtcgttcgggtcggcgaggatggcacgggagtagtactcctctgccttccggctatcccctttaatctaccaaatccattgcatttgctcatgtgttagacatgagaagttgagaacgatcgccagatctccactgaaatttgcagaaatggacagtgctgtggcttacctgatacaggaactgcgcgtagttcctcaggaagaggccgttgcatgggtcctcctcgatcatcttcttgtaatgcatctcgatgtcagagcgattccctccgttgtcggaggtcaccaggtaactgcctccggcgccaccgccgccgccgccgtcggaaccgccgctgccgccgtcggcgctcagcaagcctgagccgaggcggtcgatcccgaggcctctggcgaggaacagcgggtgctcgacctgcgcgaacgtgctgctgccgctgaagcggaactttccaaagctcagctcctgctccgcgctttcgtggtcgccgtcgtcgtcgtcctcctcctcctcctcgtccgtggaagcgccgccgcgttgcgtgaacgactgga

SEQ ID NO: 93270 - DNA, 4312 bp, Oryza sativa
tttaatgagtactctctctgttttgtattatgacagtttgacttttttatgttaaatttctttaattttgattaaattcatagaaaaatttagcaacacttacaacgccaaattagtttattaaatctaacattgaatatatttttatagcatacatgttttgtgttaaaaatgttaatatacctttttttttatataaacttggtcaaacttatttaagtttgaaatacatcttataatgttttcataagtttttttgtggggaatgttttcataagtttgactagagaaaagtgaaaatgtcatatactatgaaatgaagaaagtactttgtttccttcaccttactcttaaaaaaatacttagaaatactcaaatacagatggagagagttggtatgtagtattactcataagtcgtaagtagctatatgcgtggtatttttctccattttttcctctctctttttttcgtgtttaccacacctaacacggcaatagaacattaattggctcaaacacgtgaccaaagcactgcattccgcctatatataggtatccatgttcattttaacttatgccttcccaatatccatgtgtgtgcgtggctatgaaaactttattttaatatcactagatttgttgtgagaaatgctagctaccccaaatcataattacgttattatatagtaatgtaaagtaatgaaatatgcactggtggagaaaccgtttgtagtcccggttggtaaccccctttagtcccggttgtccaaccgggactacgaatcgggattaaagaaagctatctttagtcccgggtgaaataaccgggactaaagatcgagctgaccttttttttttgcatggccctgtttgctgcatggttgattatatatatatatatatatatatatatatatatatatatatatatatatatatatatatgtgtgtgtgtgtgtgtgtgtgtgtgtgtgtgtgtgtgtatgtgtatgtataaatcatatatattaacacaaaagcaaatgtgtacatatataaatatatatatacatgcatatatagtacaattcatttgctcggtagctatagctacgacttcgacttcgacgccggcgttatgtcagaagaggaaggaccgacgttatgaattgttgatgatccgtcgtagtagaattcaccgtcgggattaaggacttcttcgttgatgaatctcatcagttgttcttgaacagccatgataaaatccttgtgtgggagattatccctcatgtgaatacgctatcattcgaaaaataatgacgtatcaatatatgaaattaataaacaacttaacaaatcgatacgcaatgaacttttgaatggtttatgtatacgtacatcgagctctcgtgttgtgcatatttggtttgataggcagtgggcatactcgcatacgtagtagacgcataagttagttccctgttcctgctttgcacactacatgagaaacgaagagagatttaatatactctttatattaactgtaattagagattcaattcaatataattttggatcatgcatgtactcactggaaaatgaaacctccgtccaagtttttctttccaagtcccgcggaccaattgacggaaccgatcccaagccctacatatgcagttgcaagctatgattaattaattattatctgagatcaacataatagcaatagattccccgcgactttggaatagatagcattatattacctgtctatcagtttgaagaccttgtcaaaaatcttctcctatttattcattgagtcgtacacagtgactctgcatgcatccaagtcgaagaattacaggacccagtggaatctggaatatgcgtgagatgagatatatctgatcgaaaatgtacatgctatatgtatgggaatgaaatttgttcgaacgacaataaaaactcactctgtgttgtacggcagtagtatgtacgtcttgaaatgctgctgcgttaggagatggacgagattgtcctctgtgtctttctcgtacttgtcgatcatttcggtgttgattttccgagggtcgatgaacccagtatcgtagaccctccgccgtcgggccctttgaatctccattctacaacgatgaaaggaaagtattattgcttacatatatgtcaggagctaattattgaacgaaacaaatcgaactcaaagatactcacaaaatccatgcgctcaggagagagacgtcgagggcgtccaactggtacagatcgaagagatctttgaaatggatccagagaacatcgtctccttgcaagaagtcggggtttctgatcctcgccccaaacatctctctaccgttggcgctcatttccatgtaccgttcatggaatttgtacatctgtgtcggtagggactccagctgttcaggtttgacaagcggtttaccgagttcaaacttgtatgccacttccgccttcgggattggtgcggctccaaccaactaatccacagatagaccggtgtctgcaatgaaatccgttatgccaaaatcttcaccggtcaccaacgactcgacctcttggtttggttgttctccaagctgagggactggtttggacttcttgtgataggctctctgaagtgttcggtcatagtccgatatctgtaacgcctccttgtttgttttggacattcccttgaagaagttcttcacgctcgggtcaataggtatcctcttttcaggactctgaggcttgagttgcctcttcacctctcctgccacataagcatcaagctcctcttgactgcaatcgtatggtggctccttgtttttggtggcgtcaacttttgccttcttcgttgcccttgtgcgggcaggcggtggagcttggcgagaccttgtcttgggaggtgcaggcggacacggtggaggcggaggaggcggaggagccggaggagatggtgcagcaggaggtggcggaggagccggaggagatggcggagccggaggagatggtgcacgaaatgccacttgtcgcccaggaaggatgatgtaccgcttgcgccatagtatgatggcgtggcttgtgtctcgtagatgcgtctcaccgtcccctcctgggtagtccaactcgaggtcctcgtacgcggcttccactagctcaacttcgaccctcgagtatcctgctggaatcggcctgcagtggtaagtcccggaagggtccgttgggatggccattcccgatgccaccttcacgtgatgagaggttatctattagtaatcaacctaagcagcaacttgcggaatgtacaagtcaaaaatcatcaaactacgagcataccttgattgataagttcttgaagggaatatgcagctcacatggtgtccgctgcgtgatctcatcaacggggcaggaggtttcgtcctgggtttgcatggcgtctatgctctatgatccgacctgcccggttgaggcgcagctgctacgattgcctgatgggctgaccattacaggatgaatgtacggctggggatcttgggaccgatgtgcggccatacgttcatccaccttccttgccacctcctcttgcatgctaagctcgtagctcgataccctatactcaagatctgcaatcttcgcctcggtatctctcttgttcctcatccgactcctgtatgtgtggatgtcctccttaaatccaatcttccagggaatcacgcattttcctcgtgttcgtcctggatgctcgggagtctgtagggcgagtgacagctcatccttctctctatcgggtcggaatgtgccctgagaagaggctaccactgcgtctgttagtcgactggcagcctcgcgtatctgatcgcttaagacaagggagccatcaactgggttaagcgttccaccgtgagcatagtaccagaacttcgatcgatccggccaattagcggtggccggttcgatacccctctcaagcaagctagcctccatctcctcccacttcggcttcgcgacgctatatccgcctgaccccaagtggtgatggtacttcttcttggcagcattttctttgtttctggccatcatcgcttgcccttgttgccctgtcttgtaagcaacgaactcgtcccaatgatcccttagctttgggaatacgtcgaagttcggtgttagtcccttcaggatgtatttcttgtagagatctcccttgaagctctggaactgttctgccattttcttcagagtccactatttcactaagttatccgtacccgcgggtagcgtgaacgtctcgagcattggggtccacaacatct

SEQ ID NO: 93271 - DNA, 663 bp, Oryza sativa
cttgtgctattaactggataaatgacttaactccctcctttcacttgtcttagatgccgcgatacaagcctgagtatttgttcggtaccgaaggatttgtccaagagttgcgtacgatgtccttcctcataggatttgggattgcccctttgtatgcccagatccctcatgatcgtgatgaagagaagtgccgggtcaaagtcgccttgaacagcaatcgtgaagatattccatcagtaatgttcgaggctggaggaggaagctacattcatgcttgtcaggaggtggcaaggatcgccataggagagctccgtaaaagctacaatgaccggttggccgacaccgagtatcgctaccatcctcgtcaaccctagggaagtgaccgtggcagctaccttgaacctgcggggatcgagaatgatgctaccacaaggcatttggttgagatgctgtgggctaggatgaaacccgcgctgagattgtgatagccgctcaagaccgtgaagaccggaattgcgacaagatttgcaagctagaagacaaggtggatcgtttggagaaggaactagctgcattgaagggagaagcaccaccgcagaaggccagagttcgtcttaccgcaaggaagagagctctattcgtccctcgctaccagttgcaaag

SEQ ID NO: 93272 - DNA, 734 bp, Oryza sativa
tcactatgggcgaattcgagctcggtaccttcgccaccggttttcttctgttgccactgactcgtgttcacttcatcacggctttgcaactttgtcaccatggtggagcaacttcatttttattatcttcggcatcggcaaactctattgcctctacttcgcaaactttgctacttcaccaaccacgacgactacaagagtttcgacacctcggcattcgtcaccaaatatgatgccgtgttattttattacaacaagtggtgttccaaatttcaatatttatctttactcaagcaatgattactcgacgacaagctacagttctcgactctatgttcagttgtttcccaactaaccaaagaatcgggggctacacaaatacaagactctcaaaattcgacaagctttatgtcaagatgaagcaatcaatcaatcaatgagtcaactccaggagtcattatcttcgtctttgcttcggagcagacgttctacttcagcaacttcaattatttcactgacaattttggatgccctatgctgccataatctacttcaagtatcaatcaagcatctgcaaccgctatagcaccaagttctacagccatcttcataaatcaaggggcattgcatcagtcttcattatgcacacgctcgtatcaagaaaattattcgagcttcgatatcttctcaacagtttgatggattattgtcattgacttcatcaccaacacctc

SEQ ID NO: 93273 - DNA, 1805 bp, Oryza sativa
ccgccgagatgtctcgtcggtacgacagccgcatgacgatcttctcgccggaggggcggctctaccaggtgcagtacgcgatggaggcgatcgggaacgccgggtcggccctctgcgtcctggcggccgatggcgtggtcctcgtcggtgagaagaaggtcacctccaagctcctccagacctcgtgctccgccgagaagatgtacaagattgactcccacctcgcctgcgcagtcgccgggatcatgtccgatgccaacatcctcttcaacaccggccgcctccacgcccagcgttacatcctctcctaccaggagcccatccccgtcgagcagctcatccaatccctctgtcacaccaagcaagggtacacccaattcggcggcctccgccccttcggcgtctccttccttttcggcaggtgggacaagcaccatggcttccagctctacatgagcgaccctactacagtggctggaaggccgccgccgtcggggccaacagccaggcgacgaagtccatgctcaagcagctccttcccctaccgtcgccgcgtcacccgtcgccggccgccgatgccctcctcccgccggctaagtctgagaagggagagagagatgaggaagggagaaaagaggggaaaggaaagagagagagagaattggctgatgtggcagcctgacatgtaggtcccacgtggctcccgcactgattcagctgccacgtaggataaaaccgggtcaaaaccaccgacggacttactgtgactggtttttgttagttaatggacgatggatacctggttttgcggttggtggacgattttgtaactcaatgacaagttgagggaccttcggtgtactttttcctatggcctatgaactgattaatgggcttgcttggacgtggctgggttgatggattggatggtccaggcctccagctcatttggctcacgagcatagccagtgagctcctatacatacatcaatttttccccctatacattgctgcaagcctacaaccgtggctcagcttgttaacaattgtgaacgactcaagcacatccgaaccgagccacatcacgagccgagtgaactagcaggccagagtttttctccgctccctagttgcctgatccaaaattatagtgaatttttgctctgcgcacacatctaagctacctggagatcgatttccatatcttctcttcatgcagacagaagtgcactagggtttctcgtttctgctatgttaacataaattaacatgaatgcttacaaatacacgcagaaaagaagttcaccttttggcttttcaagaaatgattaatagaaaggtatgctgactagatatcgatgtagtccgctaatttccggcatctagcaatgaagttaccgatgcagtccgatgatactcatcgatctgactctaatcatcgagatagattaaaaacacgtagacattccgatcactaatgagagccgccactactagaaaactcattttcggcgtcataggggttcgattttcgcaggtgtgcatgtaattcggagctaaaaccccgctggcaaaaaatgtacccggggtggagggggcggtctgcctgcgaagatcgatctttgcaggcggagcatataagcggcgcctacgcggaccatattgaagaaatatgggaaatcaactatggacacacaatgcaattccccatatttaagtgccagtgggtaaaatacccgaacaggatcaatgttgataagtttggtcttactgttgttgaccttgcgagtgtgggtcacaaggat

SEQ ID NO: 93274 - DNA, 4287 bp, Oryza sativa
ctatagggcgaattcgagctcggtacccctggagcggcggcggcgggggagaagcgcgagagagatcggatcggtgcggcggcggtcgagggaggcgcgaggatggattgaggggcggcgatggtgtgaaggaggcgggatacgacgacggcggagagggagaagtctgcggtgtcgggtgacgagtgagaagaggaggcgccgtttctttttttttcgcgtcgcggaggagtagcgtgtgccgtttctttcttttttttttctttttttttttttgcgttgcggaggtggagcatgtcgatctacgtttctaatttggatcgcacgtctatgttgccttcaccatcaccactacgaattttttaagtattattaaagataaaaatatagtgctacagggaaacaaaatatattgagagtggatggggttgaagatgtcaaagattataaccaatacgatagtatgccactttatagtcagtttgtacagaagattaagaatgtcgagacatctactcagaagaccgtgaagccttacatacgcacggacggtgtgggcaaaaatgttaaagggtaatgattgttgagtggcatgtaagcatctaacaagttagtagttatgtaatggtggtatgtaaggtgatgtgtgatcatatcgcaaaatgacgaacaattgtactcaagatcaattagtttatgtgcaattaccatttgtagtgtaacatttacagatttttatattttaaaagtttttttaaaagaggtttcaaaatttagtagcaattttttatgtgcacttaccattgtttcaaaatttgttaaaaaattttaagtactatgtacatttaagtaagatttacatttgaaaagtatggttgtatgtacaataaccatttttattaaaactattgtagacattttcaaattacaaaaataattttaaaaagattttgaaataatgtatattcacctctgtaacaatcttcgtaggcggacggaccgcttgtgaagattgttatgccgagtgcggtttacatctttgcaggcggttgtgaagattgttatgccgagtgcggtttacatctttgcaggcggaccgtccgcctgcgaagatagtaaaaacgatcttcgcaagcggacggcccgcttgcgaagatcgttgtcctatataagggcaagcccgcagcgccaaaatttctaagtccaggcgggaaccctagaaattttggcgccgtcaggctgtcgaattttttcgccgtcccacgccgccgccgtcctccgccgccgcccgcctgcgaccatcgccctccgaccgccatcctccgccgcggccgaccgtagtcctccgcgcgccacgcgccgaccgtcgagctcgcgccggccgctccaccggcccaccaccgccaccggctgctccaccgccgagctccatagtcacgggccgagctccaccgccaccggccgctccaccaccgagctccgcccgcgagctccaccgccaccggccgctccaccacctcgcgccggccgccagcccgctccaccaccgccagccactccaacgctgcccctctctctctctctcaatcgcggtatcgcggccgaacggcttcttcggccggtcgtcgtccacgagcgaactcgtccttggccgaacgacgtcttcggccggtcgtcgtccacggtcgaacctcgtcgtcggccgttcgtcgtccacggacgtgtgtgcatgtgggtgcttgctttttatatgtgtgtgcatgtggctgtgtgggggtttatatgtgtgtgcatgtgggtgtgaatgggaatgaggggtgggtgatatgtaaatgttttgattgtgaatatgaatgtgggactgtgggtgatatgtgaatgaaattgggagggtatgttcaattttttttaataacatgtagaggatatggtcgccttattaattttttagcaaattagtacaaactaattttagtttgtactaatttatcaaatttgtttgtaccaatttagcaaattagtttgtactaattttagtacacaatggtttacacaagtttttattataaccttgtgcaattatgtacacaagtttttattataaccttgtgcaattatgtacacaagtttttaatacatagtttaatatacaattttttttgttatgttagaagtttgaaacgatggccgatagtactaaagggatcgaagagaagggtttaggggagcaagagcagtcccttgctgttgtggttgctccggaaccaatggtcccaccggaagatagttccgacagcgacgtagctgacgaagacgatgagtactcgtcgccaaatgatccttgtccaagcccaagcccgaagagaaggaaaatgggcgactgtgcagaaggcgataaggactacattccccctaaagaaggggtaagtaaacttaatatgtaaactgttcaccgtgataactattagcccgagctaattcgaaactttcatatataccttctcgtaggaaacggcaccacggcaatcaaaacggcagccgaagaaaaaagttccgtcgaaagacgacgaggcaccaactaacacaaccggctcaaacaaaagcgaacggtcagcaaaggcgaagaaaaggaagggcgagagaagcgtgaataaaaaggatgaagggttccatgttgttacccatgtttcgccaaaaggagagccgctcgcccctaagacggcacgtgcgaaattcagttcacagtgtggcataatagtaagggaaaagatccccatcacggtcaaggactgggatcatgtatcgaacggggataaggaagtcctatggaaagagttgaagaaaatcttccagttcccggatggatcagaggcagcagtgaggaattgtgcactgcaaacaatggccaagtcttggcgtggttggaaaaccactttgaacaagaaatttgtaaagacgggacgtacaccgtttttgacgtatgccaacataaccccgaatcagtgggacgactttctgacgttgaaaaactccccggaagaaattcaaaggagccaaaagtattcagagttggccaagaagaacaaatttcctcatcgcttaggctccgcgggatacgcaccaaaggtggagcagtggacaaaagatgaggaggaaatgaggaagatggggcaaccggtaccaatggaagaatggacacatagatcaaggaactgggtaagagctagaactccgaagatcacggatgaaggcaaagtatcgtttgaagatccggagctgcagggcgttgccgattaaatagagaatttttccagttcaccgaagaaaggatttttcaagcctaagagggagaaagatgtgctaagtacggcgctgggtactcctgagcatgggggtagggttcgaggtgtgtcgagcaagatgagttggaaggaagggttcaaacatgacccccacaagaagcgtgaagcgtacaaggataaacttagagacgaaggggttgtggattttgaaaggcaaataatggatttctgcgttaagcaaatgattttgcctcgccccgaaaccaaagaacctgagccagattacccctttgatgacctcaaggagaatacaccctgcagattgcacgttcccattggacgcttcgggaaaactcttgaggccgctacagccattgctatccttgggagaacatataatgaagagttcatacccgatgcgtacgccaaagtgcagccgcaagtggtccacgaagggtttgagtcctatgacattgacttccctactgcagatggtgtatccgtacttggggatgtggtcgatcttgtaattctctggcacaagaatgacatatcctttggattgggcaccgacgccacgcgaaaacctgtagtgccaaaaccggggttgggaaaacctccgagacctcctaagaagaaggtgactgataaagcggaggaacccgagatgcataaggaaaatccagtgccggaagtgccaccggagattgaagtgccggaggtgcccatggagattgtagtgctggatgtctaaatggagattaaagtggcagaaccagaggtgtggcatcagtcgagacagaaatagaagaagtaccaggattggaatggaacggtacagaaccagaaatatttgaagacccttctcctgcgaaagaccccgaggtgcaagagatcacggttctgaggtgcctagagtgcttaggagccacgactccaagtccaaagatgagaacaaggagaagttcatggtaaccgtcttcaa

SEQ ID NO: 93275 - DNA, 2071 bp, Oryza sativa
ccacgacccatgggccattgacgtgcccgtgccggcatggtacggcacgacgttccctcgggccgtgcttgggccggggagtaggcacgtgggccggcacggcacggcccgctacaggagtcgtgcctaacgggccgtgccctagcgggccgtgccgcgggcgtgcccgtgccgtgctgggccgggccgcccgtttggctaggtatagatccacccaatcctggactggtggtgtttcccccggggaaatccctacacacgtgccgaaggaggccttagtgatcgtggtagtaacttatgttatgcggttttaattaggaataatgatacctggatcagtatgatatcatgtatacgtatggaggagaaccattttatgctaaatgaaatggcgaaacattaccagtagcagctagtaacatttattgaatataatcttttacttaagccatgtgtcgcgcagtcttttttgtctgatgtgttcaatctattttgcgcggtgcaactacgcgcggctacagtacttgtagcactcctacaatatatcctatcgcaataagaaaaaaaatgcccaatacattcttgttaaaaaaaagtaacggctttgtgccattacaggggggattgaatcgaacttttaacatttgaaccgatgaatgccatacgccccttcttccatctaacaaacaacaacgatctccatgaaccctgatgttatatgtggctgtatacaaccaggttgttgtagaggccgaatttttcccattatcaatgtggtacgatgatgtgtttagcccgtagcaacgctatttcgatgatgtgtttagcccgtagcaacgctacttacctggaaccactctctttgatttatgacatgatccatgttgaattaccgatgtatttgggggggggggggatgaaaaacggtcggaaacggtagcatctcttcggaaacgatgctccgaaacggtagcatctcttcggaaacgatgctcgatcttatcatttagactactcaatgtcgacattaatacgatacagaaacaaattagaaaaaaaacaaaatttttaaatagccaaaaatacaaaaatagcacggtcggaaacggcgctaagtcgatcgagaatttccgagaccgttttcaccccctatattggtaccatcaatttactaatttcaagcctccgactattttgttctgtttggttggtaccacatcaatcaataccgaatacttttatttctgtttgcttggttataacacatcaatctgactacttctgaaatataacaatacttttatttctgtttgcttggttaacacatcaatctgagtactttcgacatatgccagagaactgaagagacatcaagatcaaagagggatcctcttccgcgggaagagggatggtagaaacaaaacaaaggaaataatatattcgagaccagatttccataggaaataatatattccagtaccgattactctttgataacccacaatccgaacaatactagagtttcattatagatagctagctaagcataaggaacaactctaacaaatttggacaacgaacagaccaaattaaatattgaacgacggacttaaactaaccagaccacacctacatgagcttaagatactactagtactagttccgcacggatgaatcataaaaaccgtagtttaacactttagcatactcctgctgggtatatctctggaggttggttggtacggactcggccagaagtgggcggctaatcaagcaagatcacaccccggccacggtcaccgcggtcggcccggccgtcacggacaccacgaccgcgacgaccgggacggtccccacggccgccgtccccgccgcagccgccgtccccgccgtggccaccgccgaggccgccgtacccgccgttcccgtcgcgggcggggataccgccggggccggcgtccccagcggggccaccttgtccgccgtacccgccggggccggcgcgcccgccgtcgccaccattaccggcgcgtggttctcgtggaggccggtcgtcaccgacgtcgccccc

SEQ ID NO: 93276 - DNA, 622 bp, Oryza sativa
taatcaattcggcctttgaatcaattgcatcgtgccccccagctctctgcccaacaccgatcagatcgaccgtgcaaggcctgtcagactgcccgaggtggccggtcagactgcccctggtcaccggtcagaacggccgtgcaatgccggtcagaccgctctggtctacaattttgccaatttcgcacaaaggtttaaaatcaagcacctgctcttctaatatcaaaaatactcccctcttcacattatagccagatgcttgttgtgctaaatcatttacttgagaattatcatgcctagcaatatgtctaatagcaaaatcatcaaaattggcaataatatccaatcattgatcaagatacctatttagtgatctgtccaaacatttgtaagttccggtaacttattgcaccaccaattccaaatcactaaatgcttccatgtgcttagctccaaccatctccatcacttgtaagccgaataataaagcattgtattcggcttgattatttgtacaataatactccaaacgaaccgatgactcataacacatgccattaggtgaaaataaaactactcctatgccttgaccctccttgcaagaagaaccatcaaaataaat

SEQ ID NO: 93277 - DNA, 1245 bp, Oryza sativa
atgtcatttaagccgactaaaaggtcagtgaaaacagttataagttatgagttcccttttacttgtaaaaataattattaactatgagtagttgatgtgattgtataaatagatttaatctattggattaaaaaagataaatgatctaggttatttactaaagtaaagatgcactataaaacacctcattaatgtgacctcactaatgtaaagagagatcagatgatagtaatctcactgctggaaaacccttctttagttccggttttgtcacgccccgaactagtaccgaccggaactagcccgtgacgctccaaattaacctgttaatcgataccagtcccaggaaaacagtgctggtatcacagggagacagaatatcacagcaacagaggtctctttattatagagtagaagtacagtcatgttgggctgcggacagatcccgagctcacaactgcattacaaaagggaaacgggagccaaggcttggactaaacatacaggcgtgacttgggaactagaccgaaaccctaaaactcatcgtagccgacttgctcctggaagaactcctcatcaacgggatccacttcatcttcttcagcaactgggggaggattatttatatagagcaagggtgagtacaggagtactcaacaagccatgggaattaagtgtttaatgcaggcttcaagaaaaggctgttgtttttgcaactggttttatttaaactcctttttgaaacaactaagtgagtgcttctcaaacgacacggatgagacagtgtgtctcgtccggtcggagtatgtgcaatgtatcagtctttgaattgattcaaggttggcacccggccaacagctttcaagcggccacccaggcctggctgatcccatcagccgcagatttttcaaacatcgaacccattccacaacagtaatttcacaagcagtagtcaaacaaaactacgctaggaatcacctcacatccgcccatgaccgtgggcacggctgttcgaacagtttaataacctctgcagagggggtacactttacccacacgacattactaacccgaatcacccagcccgtgcagagcggccacgtctggagaccttgaggctttcatgacaaggcatttcgaaagccgacacaggttcaccatatgccaacgagaggggtcccagaccaacaccaggttaggtcccagaccatactgtgccaggaaacccgggggttctccccggca

SEQ ID NO: 93278 - DNA, 576 bp, Oryza sativa
atttgtgaaataccatcagtatctaacccaattattttacctgaacagatgggagaaaacgcccagcacatggtaactggatgcaatgatagcccactaacgttgccttcaacagaaggctcaagcttggaagataccccctacaaaggtgtgcgtctaacagctgaacagagaaaggaaaagatctccaggtacataaagaaaaggaacgaaaggaacttcagcaaaaaaataaaggtaatattgaacatttcaagaacataactacatgcatcatcttaccaaatttattgtactgatgtaaaacaaaatgcagtacgcttgtagaaaaaccttggcggatagcaggcctcgggtccgcggaaggtttgccaagaacgacgaactctgtgaagctaccagatcaagctcccaagattttgaacaatatgaacatgttgtaagtgtctaactatcttatcagaaaatagccaaatttagctgaaaatatcacaaataaatatgcaagggcaagattacctcattagccttagagacaattcatcaagatggttattcaatcatctcatcattttt

SEQ ID NO: 93279 - DNA, 644 bp, Oryza sativa
ctggcttggccatttgaacttctcgtgcagctcaaatgatgtcacctcatatcccaaagacgctgaaaaaagaccttgaactgcaaggaatttcaatacctcagtctgcactagaaatttttcttcaatgcacttaaccatttcagaatctgtcagtgaattccctttagatgtcagcttcagattttttaaaacacaaggaattgtagtcactatccaacttttcaaaaggtcagcactcccttggccaaaaaggtccttatcttccattgaaccaacttccgaattctcatcagttgtctgactttgatcagatggttcgtctgtaacagagctttcatctacaaagagtgacatcaaactctgcacaagacacaaacaatcttgaccacttcggaacttggcaaccaaatctttaacagttctcgtttttgtcatgcagtcaaatcttccaccagtatacttctgcaagttagtaataacagcaacacgtcgatcattatcatcactcactaaacttactaactccttcagaaaatgttggccggcattgtgcaaccatgacgattcatttgacagaacatccatcaaaccatgaacaaccttgctggacagaattacttgaatcgaagatggggatagcc

SEQ ID NO: 93280 - DNA, 573 bp, Oryza sativa
gctagaatgacttacattataaaacggagggagtatcatattctacaatgacttcatcagttggaaacttgaaaatatatatccaacgtcagggtgcttcactgcttatgtatcataaactgaagcagtatatcaacaaatcagtcttttagttgtggaaacagaaagtctaacacaggatgagaggaagactttcccttcaaacaaattaaataaaagaaatgaaaagataagaaattcctggaaatggagcttctactccaacatggggaagatactgggatcgtggcaattaaatgtgtttcctctgatataaatagaggcaaatcaaaataagcagggacagacaagttacacggtgttgtacctttattaaactctgaaattgcattgggcatcctggaagcaacgcaatttttccctcccggagacttgtgaactgaggtccagaatcaggaagctgggtacctcttataagttcatagatagctgccccaagagaaaagatatccaccttgtcaagatgctcatacttgtcgttcagcatctctggaggcatataacgtgaatctc

SEQ ID NO: 93281 - DNA, 852 bp, Oryza sativa
ttacagcattcacagttgtatatcctgtccaacacatttgcagctacaatgaatgcccttgatccataattcctaacaggacctccattcggttctactagatacatgttttcagaagttcaggtcaatttatatgatgttgaagcaataagctctttttgaaatctgttgaatataggccttgtgtagacctccaatgcttttgtttccatgggatagttagcccacatagaagggattgtttcttctgcttcaaactcattctgatctgttgcaacagtgattttttcttgaatcttcttgtactgcaaaaataagttgtatatgctgttttgaggatttacatagcgcttcagcactgcgttaaatccctcactccgtgctgtagtctgaaggaaagggaagaaacagtgcataaagtatgctgggacccaacaccgtctcatttcccaaaggtgtcggaagtgctcactatcttgtaaatgatatgttgtcaacattgcatcccatttagcatcaaactcttgctctgtccagctgttgtcaaggcagtcattgaatgcatcacacaatgctttgtcatgatctaatatatggccaatcttcttctgagcattctgcattatatgccagcagcagttgcgatgcttagcatgtgggaaaactagcgctatagctgccttcatagctaggtcttgatcagttattatgtttgtgggctctacaccttccatagcctctagaaatgcttgaaacaaccatacaaaggtttctgtcttttcattccatagaaatccacaacccagctgaatatcaaaaataatacacataaggaagtcagtacagttttga

SEQ ID NO: 93282 - DNA, 1047 bp, Oryza sativa
tccagcaagaacctagttctgccagttgaggacggaggaggtctgcaggaactctcctcactccagtcactcaggatttcagattgtggcagaatgttctctcgatggtgcatggtcgatgcaggagctcgtaccagcaagcccctcccttcttccctcagggagctcagtatttgtagagagtcaagcatgcagtcgatggctctgctctcaaacctcacatctctcacacatcttacactattggaatgtgaagacttaacagtagatggatttgatcctctcattacactcaacctcaaggaattggtggttttaaataattgttatgagaacaattattcttgttccatagcagcagatttgctctcagaaatgacaaggaccaaagtattatctgcaggttccttacaactggaagcacttaaggtggacaatatctcaggagtgcttgttccctccatttgcagcctccttgccgccaacctccacaagttaattttcaaatctgacttgcagatggaaagcttcgatgaagaacaagagcatgcgcttcagctcctcacctccctcaagcaactatattttgccgactgcccaagtctgctttccctccccgatgggttgcatcacatttcttctctccagaaattgcacatatataattgtcctaaaattggattcctacccaaggagggcttcccctcttcattgagagatctagtgttatcagagtgtagcgtcgatctacaagatcaattgaagaaattggagacatcaaacccagatttatttgtacaccacatgaggtaaaaaggaaagaaaaagaagtgttctctcaactactacttatttcagcatccatctgtaaccttcaatactaaactaaaactgctctgctttgtttcctactttgctgtgaaggatgggccgaatcagtctggagatatagcggactatctgcatccgcatgcgagtaactcaatagcacatgcgggccaaaggatcgatcggttcttccctctgcaacaatctggaaggttcttg

SEQ ID NO: 93283 - DNA, 6927 bp, Oryza sativa
tgaaaaatgcaataaaaaatctgttctgcaagttcaggacccactattttattggcaggttctcttctccagaaaaaaagtcaatacattttccaaatcagtgatgcatctgtgcgttgatcctgtctgacttgctgtttctcaggttgcaacagaagcagaccttggtttagcagatgcctacataaatggctgcttctcttttgtcaataagagagaaggccttctgaatcttttccttgtaatactatatattttagttcattactttcttggtaaagcaatatccatagtgctatttattaatcggttttcagacttaacccatcaggcttttttactgcagatcctcattgccagtagagatgcacacaggagttcttgcaggaattctagtcgaaggtatcaagtcctctgctcttcactaaatccctttcgactgtttgatcaaaatgaagtagcatatgttgtgtgagattatcagtttgataaaaatattgccttgttctcaggggttggtggacacccttgctttttactgccggcgttgcatctgctaaatattttctgcgtcacatctcaaggaagaactctgtaacacaaactcgtcaaaatgtctctcagcactatgatttggtcagtttgtatatgtccttttttaattatctatcaaaattaacagatctaactccttgctgaatgatgacttagctcaaaatagttagcatgttgatgctttctctgcctatacagcttctggatgcttgataattttctttaattcccatgtctacataattgactagtcaacaagagttaccctttcttatcctatatattttacctgcagagtaatgatttcttctcgctttttctggataagtcaatgacctactcatctgccattttcaaggtaagtgaaacatatgaatttttccgcagcttgtaaattatcataagaatatgttggactaatgcacagttgatttattgccctattaatttgttaggatgaggaagaaagcttagaagaggctcagctgcgtaaaataaaccttctaatccataaggtgataattctatcatatagtagtttttgtgtttccacctatctctctctcaccacataatgagagagaacatatgtcttgatcgatatttactatgaagatgaacccgaccctttcttatctatatacatggtctgatgttccttcaatcttttacatgtccacttaatgaaaggctaaagtgggacaggatgatgaagttcttgagattggtagtggttggggcagtttggctatggaagtggtgaagcaaactggctgcaaatatacaggagttacacagtctgtggagcaacttaaatatgcccaaagaagggtgaaagaagctggcttagaggttgcgtactatttactctctctccctttcacatcatctgcgcatatgatttactggaatcagttttagtgttagtttagtctcctatttaaatatgtatggtgaaatccctgataagttagcattaataataactatatatttttatttattatcaggaccgaataacttttctgctgtgtgactaccgtgaaataccatgtcacaaatatgacaggatcatatgctggtaagtactagtactaccatgtgagtttcaattgaaatagagtaatcaagttggttttctcccatcacctgaaaaataaagttggttatcatcgatcaacactgggtacatgttcatgtgattccgccagttactaattgcttccagcctattgcataattcatcagtgagatgattgaagaagttggtcatgaatacatggatgaattctttggctgctgtgagtcccttttggctgaaaatggcatatttgtcacccaggtgtgtacaaacaacctttgtcattgtcattgacactgactgttgatatatcccacttaaatttacatgggattattccagtttatctcaattccggaggaacggtatgatgagtaccggagaagctcagactttattaaagaatacatattccctggtggatgccttccttctctgactcggataacatctgccatgtctgctgcatcaaggctctggtatgttcaagatcagtcaattgatgctcaatacaatacagtgctcacactcgtacattgatttattggttttggattggatgcacgtcgagttcatttgcagcattgagcacgttgagaatattgggtaccattattatacaactctgatacgctggagggacaacttcatggccaataaagagtaagtacaagcatggccttctactcaaagtgagcaactagtaccaatagggtatgtgttacacagaggcccaaaagagttgaaatttcagaaattttagtcaaagcacagaccctgccttgtactttggcagtgttaaaagtgtcctttccaatttcttttatctccaattgaacaataatgttaaaatgatagccatagtgtgttctagcaaattaccataaaacaagagtgtcctatggcaaagacatgtttttgaaatgtcttacggcaaatggcacaaaattatggtgccataagcctgctgagcaagcaaatgcagaaagtagcagttcaaaaatccaaagtatgaacacacagtatggcagttcagagtttacacagaatttccctcttgtattttcagtaaaattttggccctgggctttgatgagaagttcattcgtacatgggagtactatttcatatactgcgcagccggttttaaatccaggacacttggagactaccaggcaagtactgtactactgtacgtatgaacatatatagagaactatttattactcacttggttgcttgaccctttcagattgtattctctcgtcctgggaacaccaagatgggatctggcttctaaactcaaaattgacctctgccctagagcacgagccaacctatttatctttgccattgtgtaataatttacaggaaactttggtcttcatgcttgaagatcatgtttgaaaaaaaatgaataagtctatatttgaaatccttcaactattggcgactcaatccatgaactttaaaacaggacaaagtacaaccctggagaaattaccgccattgcttgtttaaggcatgttctgtgccatgtcacccttgtttggaggggtgactagtaaatattctgatgatctattacctcaaataaattccatatggtgtatatacacgatgcaagatgcattgcttgtcctagcattgttcttgccatttgagcgcattaaagatatgttgggtttggttggttttaaaaatgaaggttaccatattttggtaatgtgaattttctgtacggaagaatgatttgaatgtgttaagagaaacatggaggtgtttgcaagcggatttgattatggatattttgagagttcacaaattactagcatatgatgtcgtgcattcgcgtgactatatgcctcctattacgtggcatgtgggggtggcaatccatttttcatgggtttctcatcgctataaagaaaaaacataagtcatttattgcaaaattcatatttgcctgagtcattgttttatatgtcatcgtggttgcaaaaccccttattttctattgcgtgcactctttatagcctacgtataaatttttgtatgtttttaaggcatgagtttgggttcattttaaattcgtgtgaaaatcatgattgtgcatgtagaaatattttcctcaaatatattaacaattaaaatatttattgtaaaattcatatttgcccgagtcattgttttatatgtcttcgcggttgcataaccccttattttctattgcatgcactttttatagcctacgtataaatttttgtatgtttttaaggcatgagtttgggttgattttaaattagtgtgaaaatcatgattgtgcatgtagaaatattttcctcaaatatattaacaattaattgttccaaacaaaattaattatatgaacgtacatttgtatatgttcttaaatagctcaatcttgacaggtgaatataagagagtttatttataaaatagttttttttattataggagcaaatcgtaaattatatgtataaccttgtaccatcctatgtctattttctatctttttttccttcctttctttcctcttctaatagctttgtctccaaaagcctctttaattattgattttaccatccatttaatccaatagtcaagattcatttattcttttccgtcctatagtgaatccaatggcaaatatttatcgaatgatgtggctcattctcgttttattttgagtgtcacttttcattagtttgttaccggctactaaggtatttaaagtgttcggttatgttctcttattgaaatagcataagcatagccagagacactttgggcctattcagattgtagccaaaataaaccttaccaaattttggcaagttggcaatattgccaaaattttggcatgattccttatgtatttatcaaaatttagcaacaaattaaacgtatacacatttttggtaactttgccaaaaaaaggtatgattgaaaataacatcaatctgaacagcccctttgtgaagcgttttgtgttagtttatcttcaaggctttgtgtttacctgaactaggctgagttttacaaacgttgggaaagtttgggacaagatttggattacccagatatcgaaaaaggaatagctccatcatttcgtttaagcttatcaaatacaactaaaatttaaattttacatcttaattttataattttgattttttttatcgtactttattttctactattggcttttaactcttctcattgcatggcaaagatgcaaagatatatcactggcagatagagcagggtaatcagcacaacagtatattctacacccccatagaataacttaacatgacatgacatagaatttccattaatagtggatgacaatttacataaccaatgtttttctcaaacgattatatctagtccttatcattctcaaaccaaaagtaaatctttgaaatccatggagatgaatcgaatttcgcacgtatcaccaccatcgacgattcacgattgatgtcgaaccaaaacgaaagataatattactgtcaacggctaacatcaaaccagagcaaaagatcgataatgctgaagagtaactgagttgtacatataaagtcaatcttgtacagctatataataatacatgttcggaacatgcacacaacagcaagagagagaggcatgtgggagctcatgcttgtctcccaaatattccaaacttggaatccacagaaatagtattaaaaagagctcatcctcgttgtcaccttcaggttgatcctaagcatgccgacgtggatgctaaatccttccggattactgcacggatttgtatatctccccttcgatctccaccgaacttccagcccaatcatggtcgtcgttggatcgagctgatcatgtagctagcgtgtggtatcatgggccagattgtactgctaccacttcagaattaagccacctatgtcgtctctctcgctgcaggctgcagctgcctgcctttgatctttcttatctccttctcttcctcctcgatccatggtcaagtgatcgtatcttcaattcctacaatggcgatgccgtgggagacggtggcgtgcatcctgcggaacgtgtgggcgctgctcgacggctggatcgccgtctgctgcctcgccgccgacgagctcgcgggcctcctccgctcggcgctcggttagctgatcgacgacgtgctcgatcggcgcgcgtggccgatcgagctaactaactactccactaattaactgcaggttcgtcggttgctttatcattcttgctctggttgatcattgcttaattccttctcaagtaatgcttctgttcctgcatatgtgtatattttggacaatgcatgtttcttagttactccatctctctctctctctgcttaattagaccagtagaactttatttctgtggtaattttatcattcttaagaaagtatcgggagcaagggcggacccataattttaaagttgtgtattcgaaatataaaggagccaaaaaaattttaattagcatgcacgaatcatcgaaatgagccgctagacttgcacaaattaggccattagaggagagagaggatggagcaaggcctagaaatatggttttatttgttttatttaaatatatttatatataaatataattttattatatatatgtattacattgtatatacttattttgttttgtaaaaaaagaaatgaatacccttcgtccacctctgatcgggaggtaccatattttctattgtaaattcggtacatataagtagaaatatcttgaaataccaaaaattttattgtaaaatctcaatagctcgaggtactttctcattaaaccataaagtttctcttatttttcacataactcattttctcacttacatatgggacttggatcatcttgttggcacgaatttgctagcgagctatgataatgtacctgcttacatcatatgttcgctgcaggcagttggaaacatatctcccacgtatgaaaaatggagcggtccattagcacgtgattaattaagtactctctccgtcccaaaatataataacctaggatgggttccatcctaggactacgaatgagtcatatctagatttatagttttaggatggccatgtctagattgacccatcctaggttgctacattgtgggacggagggagtatttgctatttttttaaaaaaggatcgatatggttttttaagtaactttcatatagaaactttttgctaaaaacacaccgtttaatagtttgaa

SEQ ID NO: 93284 - DNA, 4757 bp, Oryza sativa
atgcagaggtacctagatatttaaggtggtgggagcccgacctaggtgccttaatagtcatgatcctcctggctgtggtgcgcccgcttttcaaactactaaacggtgcgtgttttgtaaaaattttctatagaaaagttgctttaaaaaatcatattaatcaaaatttatagtttttttagctaataactaattaatcatacattaatccattgctccattttacatgtcagaggtgagggtttcacctaggaacacggccaaggatgtgttcttggaaccctcaccttccgcacgaaaaacagagcgatggattagtgcatgattaattaagtattagctaaaaaactttttaaaaaaataggtcgctatgaattttgaaagcatctttactgcggaaaatttttacaaaaaatacatagttggtgaaacgtgtgtgtggaaaaaaggaaggagaggatgggaatcagctgagccgaacacaaccatatggtatctacagacgatttgtagtgatgaaacttgtttggtagcaatatacattattatcgaaaaccatcgtcatttgaacaaaaatcacatttgaacgaaaaccatcgtcatttcgacaaaaattacatttgaagataatattaatccggattcatgattttgagtttaaaagtttaccaggttttaaatttagcgttaatactgcactcagaacgaagtttgaggtaaacaactgaatttttcaaaataaaaataaaagccaaactctgcataagcttttgatttttttttttcaggggaacttcgcataaggtttagccgtcaagtatgctattgaatgaaataaccccctactcttctaaactgacaaacagtggaatcaaatcaaatagtatatatcagatagaaaaggttcaactttgaaattcattttgtctttgctgatttgtttatttaaaccgatgatcaccaaacgacagtggtatttccagcggggtatagatggccattggacattggacaaaatcaatcgagccaatcatacgtttgctattattggtcagaacatggccagatggacacatgtatgacaagtgatactatttatatataaattacatgagtaagcttgtcgtcaatcatgtagtaactgaaacatgatggtcgccagctctagtctgctacttgagactttgaattatgtgatttgaagaatcgactgatatcgatctgttttcgtgaaaaccacccacataaacaattgttttagaccctgggaagtgtaattttgtctcccttttcgatttcaggtctttcatgttgcacggagaagaggctgatcgatgtacagacaatttcttttttttctttgttaatgtaactatgttaatggtgaagtgatcatgcctttttgttctgaaaaagaaggtagatcaattaatgtacagacgtgaatgtgcaggatatatattgtaaattttgaacttcatttgttatagattaattattgatgtatacacgaggctctttagcagattttacttgttcactactccctccgtcccataaaaaaccaatctacttctagatgtgacatatcttgattctacgaatttggacatttatccaaatttatagtacagatatgccacattcgttttttatggggcggacgtagtacaccacaccaaaaaggaggccgctgtcggtattttttttcgctagcactcaggccttatttaattcgcgaaaagaaaatttttgtgtgtcatatcgaacatttgaccggatgtcagacggggttttgggacatgaatgaaaaaactaatttcataactcgcttggaaaccgcgagacgaatttattaagcctaattaatctgtcattagcacatgtgggttactatagcacttatggctaatcatggactaattaggctcaaaatattcgtctcgcgatttccaagcaaaatgtgcaattagtttttcattttatctatatttaatattctatgtatatatccgaagattcgatgtgatatttatgggaagaaaattttgggaactaaacaatgcctcgatatgccgggaaatgtcctgtcacagtgtctactggtgaaaattctgtggtagtagttgtttgtctgtcgacacgtgtagatatgcatctagcttgccaaagattctgaggcgacctaagagctattttagactctctatatgtccatttagccaactgtttaaaaaaattagctagtcatatttgccttttactccaatagtctctccatctcactctccaatcttatagtgggtcccacatgtcagtctctattacttctcccctttcccacatgagcccgcgtgcatgcggatgaggcggccacggaaggaggtcgacgaatccacggagggggtcgccatgcaagatcggcggtggtcgagacggcggtgggggctgcagccagagctccaaacggcagatccggcggcggcactcggcgggggattcggcgggcggatccggcggtggcactccctcgttgactcccctgtgccgtcggcgggcgaccgagcggacagatggcggaaatcggcggcgaagacgacgttgctgctgcttgcaccagcgagaggcggcggcgatgctgcgcctactcgtgccggcaagctcggcagcgagcgggcatacctctccatcggcgacggcgacgaggagtaggaggcgcatacgacgggaggcgacgacgatgggagtcagcttcgacgaggatttggccgccgccgccgccaccaagattggcgcctccgtcgtgccatccccgttcgccgccgctagctgctttgccgaggcgtgcggcggtgccgacgacgggcgccgggctgagaagggtgtggagccgaggaatccgggcggctgcgacccgcagcgccggtgggttggcgagacgacgctggtgacgaggagagcacgagtcagggacgcggaccggtggttcgacgcctcctccgagttcgacgccgccgtgccgcacagcatcgatgctgcgccgggaggacagcagcggtggcgctaggcggatggggcggcggcgctaggtgaatagggcgctgggaggatgacggcggcaacactgggaggatggggtggcggtgctgggcagatgggacgccgggaggacgtccggcggcggtgctgggcggatggggaaagggggagagagaggatagaggaggtgggacccacaccagatggcaagccgtcctggctagccaactttggtcaatgaggttgggaatttagccagtcggatggtttggagagccatttggctagtttgttggagtaaattttttatccaatttagctaaattttagcttggagaaccatttggctagtctcttatagatgctctagatagtggggcgggaaatgagaggcggcaaggagggaaaagtggcgggatgtgaaactttcagggctctctttcccccattccatttcctcgatctgaaatcaatccccacacaaaacacccacaccaaaccaatccccacaccagcagcccttcccccatccacaatagccatgatgcatcgcctctgctgcttcattgtccgtacgccgcctccaacgagctaagtgttcctgctcaacgacccaggaaagctttggacggagcacgagaagcacgaccttcacgcccctggctaagtctggcacacatggagaagagaagagaaaagaagagaagaggagagaaggaaaaaaggctattatagctagctacagcacgaacttcaatacgttatgtgtgtatgagatgtgagaccatatgttaatgatttatagataactaatgtatgaatgagctgttatattggctataaatgatttgtagctagtaattgggtatactattaaacttgctctgaggaagcaatggcttatctataaattttatatgaatggtccaacttatataatttttttaaacaccttaaatataactaagttagaaatatctattgattaaatatgtatcataatatatttataaaatatttataaaggagcttttttctcctttttttcaaaagtttattttcatatatctatactttctatattgttagtacccactgataattattacttcatctgtccctaaatataagggattttaataggatgtgatatattctgtccagattcgctgtactaagatatgtcacattccaccaaaatcccttatatttagagacggaggtagtaaaagctaaacctcaacatccaaacatgtcacctcatcagctactaacaatgagcatctaaaattttatacgagcatgacacatcatcttctcccccatattattttcatagcattttaacatcatcatttgtacaatattttacatatattcatgcatcaattccgtagcaaagcgtgaaataccacctaggtatatatatgcatttggctatgatttttgagtaaagtccatcaccggtccctaaacttgtaccgccgtgtcatcccggtccctaaactcgcaaatcgaccgttcaggtcctcaaacttgttcgactgtgtcatccggtccctaaacttacagatcactcgtttagatcctccaacttgttcagttgtgtcaccccggttcttaaacttggatttgaatatcatctaggtcaaataggatggtctaaagactttatatttaaaaataattcataactttttcatgtgaattctaatgaa

SEQ ID NO: 93285 - DNA, 687 bp, Oryza sativa
caatgtattgtatagggtctattatctctaagttctacttggaaaccgcctgacctgcgatataaaagggaccccgcgaggaggacctggggcatcgaatgtcggagccaacataaccctcacagcctacgaagtcggagcctgcaaggagccaaatcgccgaggatctagtcgaaccaactagaccatgatctcgccggatccctcaagttccattgttccctttataacctgtgttttccaccatataatcccacatcaactggattagggctattacctaccaaggggcctgaaccagtataatcctcgtcttttgtctacttgatgtcgtattacgtagatccttataccaacgtaccccaataccctctatatccggtctacgggtatcacctgtcgacaagttccataaacaagcgttgtagtactaattttggaacagccgacattgccgggatgtcgccttccaacaccaaaaccgccaccgtcctcgctgccagtctcggcggaaacacacgtccccgacacccacgctgccgcgaccttcttcccaggcgcgacgttggcgtcgcccgcgcgcacgcgcatggcccgagcccgacaacacaagttggcgggttgccaaatgccaccgcgaccgcgagggtggcgaagccggccgctagccacaagccaactgccaac

SEQ ID NO: 93286 - DNA, 2093 bp, Oryza sativa
catagcttttctgccgagattgcgcgattctcaatctttccctaacagctctgactttctcttctgcctcatttaaaacttctgtaccaaacaactggcgttcccctgtctgatcccagaagagcggagtacgacacctccgtccatacagtgcttcaaatggtgccatctgcagactagcttggtaactgttgttgtacgagaactcagcatacggcaagcttttgtcccatgccccaccaaagtcaagcgcacaagctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacatgattcttgatagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaactcagctatttcccttctcatgctgacccaccagaacttttctttgaggtcttggtacatcttagtactaccgggatgaatggaatattgagtttgatgagcctcggttagtatcaggtcttttaattccttgttttcgggtacacacaatctttctcccatccagattgttccttgttcatcctcaacaaaacctcgggcttttccaaccctcatgttctttttgagctctgctatttcaggatcacttgcctgagctatgcgaacctgctccaccagcgtgggctgtgcctctagggcagccacgaatccgtgctcaactataccaaggttcagatgttccaaatcgcgttgaacctcaccacatagttgctctacccatgcaacattgcagtagctcttcctgctcaaggcatccgcaaccacattagccttgccgggatgataatgtattcccatatcataatctttaattagctccaaccatcttcgctgtcggagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccatttggtaactgactccacatttgctggatccacagctactccttgagcattcacgatgtgaccgagaaactgaacttccttaagccagaacgtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaa

SEQ ID NO: 93287 - DNA, 3138 bp, Oryza sativa
  unsure (1)..(3138): unsure at all n locations
gcgcgcgacctcaggcaccgcatcgtccgccgcttctcccacctctacgccgccgcccaagcccccgacagagacgccatcgatgcggccgtgcgccacctctacgcgccggatctcaaggccggctggggcgtccacgtcgtgcaggagctcaagttgctcgcgcccaagaccctgcgccaccacctcgacgctgccatcaacgacctcgtcgacctcggcatccaaaggttggttcttatcatcaatccacaccctcccggatcgatcccctctctcttttcttttcttgcaccctctccaatcgcgcggaatttctttcatgccacctcttgctcctgtttttttccccattgattaataaatctcctccttttgcacatatccctactactattagctttacaattacgacttcaattactactgcgcctaggtcctgcctaaatgaaatggtcaaagacaacgaatttctttctcttaaaaaaaaagtgtcacctacgcgtatgcacatgtagtgggaatcaacttggatatccaaaacttccatgcatgtattagatgctgcctgacctattagttttagtatcgtcatgttgaccaccctgtacagttgtacatcttcatcacacaagaatcccaagttgctatgcatgttaaacaacaatttatgcttcctgctgcaactgtacagttgtaacaacccatggattggagcttgctcaccaaatcaacctgtttcctactatccacctctgtatactagtcttgacgttcactgccttgcagggaaatggcagctgaaaccatatacagggagagatgcatagctgtaacaaatgnagatagttgggccaagtacatgtctgtctctggttcgcaagagnacgagcacaacatatccactctgcagtacacagaggaaggcttactgaccatcgatgaganccggnnatggccatgctgcagcttttggtgatgatattgctatcgagtgcctgccaaccgagttcaagagagaagtttatgtggtaaagcccgtgtgaatgttctgcatgatagtttgctagtcaccatagatctggcacttttatcttgcatctctgtttcatagttttctcagcacttttatctgcaatctaacaggcccttttgtttgtaggtgcaagcacatggagcggatgcaatggttgatgaggacaactgtgtgttcttcctaccacaccgccctagaggagaaatttgcgagccgccgatttttcttttcatgaagggaacaggtaactttgggaatcatttgcccagcaacctagtacgaactgaaaattggtgtctcaacaaaatttagttgctgtctatgctgtcagttgcaatgtgtctggacttaaggtagatgtccaattctttttcttgcagcatggtgtggtgctggtgccgaccattatgagcctttgatagccactgtcctccagaatgttactccagacaaggcagctgttgtactttgaggatgacttccttctttttcgctcccccagttctagtcactgatggagtcgagccaattttgtaatctgagctagattgctttattgaggagcaacgtctatgcccaagaggatctaactgtgcgccgcagggtcttgcctgcttctgaagttgtgtactatgattcgttttgtatgctgatttgattagtgtgtgttttgataggttctgactgttgaggaggagattcagagtgtggtagaatatcggatctagtttatgctgtgaattgttgtgcggcattgtaaaccggcattttggtattgcctcatgcctattgtgaggttttttttttttttggttgcttgcgttctagggacatgattggacatttgagaatgaggatcattcttttcagttttgggctacccgttgttccagtccttgctgttgccacaatctgactggagcggggatgaattgatttgcaaaagagatgtaatacttgttttctcatgcaaattgtaccaacattgcagagggatatggctgctgtaaaagtctcttctttcctttgcaaaaataggatcatccttcgttgtatttatagctttgaactcatttcatgcatgaggaaaccatgaaagaacgctacttaagctcgtgaatctgtcccaaagatcactgtgatttccgagggatgaccggattgacatttttcacttaccatcaatttaacgatgactgattgatctaatcttactcagtaattgctcactccatttgttctgtaaatggcttggtgttgggtaaattatctacccatcccaccatcatggagatgaatgaatcagtagtcatgttgagtggagatgactgatgagtaatcagtcatgttaagtcgattacttatcgtcatcatgaattactggcatcttgtaacggatcccctcgtcaaaataaaagagaattaaaacggggatggagaaacaagagatgttgggtgaaggaaataagagcttgaatggtcagaaatctcatgtggaattagtgtatcatcgcagcggtcagctggctcacaacagttaatattaacgtttcatcactccattcaagcatccaaagcagcactcggaataatcagagggaaagaaaacaggggggaaacaagaatgatcagaaatctcgtgtggaattcgatggttatgcacatggcatcacggatgctgctgcaacctaacgagctcatcatatcatttttcatgcattgaaacagccattcatcctccaatccaatccaacgccataaccataaaacagtatgataagcgagaaacaacaacaattaaaaaggaacaaaattcagaagaaaagacggcagaagaacattgggcgatgggtgaaatcaagacaaaacccatccaatctagtgatccactgtctgttgtgagaaaacatgggaggggctaagaatggcggcggcggcggaggaagatgaaccctagaattggagggagcaaggagggagggagtgagtgagttttataaggggaaggaagaggagtctggcacgtggggcccgcatcccatcgcacaccgtccatttacacagcaggggcggagatattattttaggtgggacccacaatt

SEQ ID NO: 93288 - DNA, 2059 bp, Oryza sativa
acttgatgttcttgctgagaggcctccagaaaagaagtttgaatgggtaagtaattgtgccattgcatgtacattctagtctgtttcgctctatgatcctaatgtgctgatgctgtttatgtttctggcatgcgccgtgtatgaattcttgatgttctctccttgttggtccaggctaaggtaaatttactctttgttttattctacaaagagcaccttttttagtgcatctatggtagaagaaattactgagaaattatccatttgcagaggcttgtgcgaaagtacgggtcgctggtgtccgttgttggcttggttggagtgtttatctacctggttgcaagcccgtcaaaatccagcggtgcaaaagcaagcaagaagaggcgttgatatacttgcctaccatatataaggcagtgtttgttcttttttattaaaaagaggaagagatggtggcaggttttttagattgatagcgcgagagctttaaggctgccgcatccttgaactgtatgaattttctctgtttgtgtttttggaagttgaaaacctaacccagagaattggagagtagattttgtaacagatgaaatctcaatgcatcattttgaagttgcctgatacagatacctattcattgcatttggtaacagatgaaatctcaatgcatcattttgaagttgcctgatacagatacctattcattgcattgtatgttgttgagaatggcgggtgaggcttcacatttatgttgtatgtgccaatgggattgatgttggtagatctcgcttagtaaatcgagaagctaagcttatggatgcgtggtgaacttgtttctgacatgtgagacgaaatatgatgcgttcgatacaacaatctattatgttttcaagtggcgaaaattggagaagaaatatttgagctattagatcatctataaattacaatgttttatattgacaacatagtttgtgttcaacatagcgaaaccgttggtaaaccggtaaaaactggtaagatttggaaagtttgattattttttttttaaaaaaagttgggtaattgtggggtttgttttttctccgagcggccccgttgagacttgagactgtgagctatatatgtttatttattttaattgtacttttgatatttatttttgatacaattgtatactatatggaagcagaatgtaagagtatagatgttatgaaaatctatgctcgcacaaaattatgtgattggggtgcgacatagggaatcaatatatacttcatttacatagggaagtattccatacgtaataaatgaaaaaagaaagcgcgggaaattctaaatgtaacacttgaaagacgctcaataggtatttagtgaggcattttcataacaagaggtaagcaaataaatatagtatagtagtaagatatatgagaaatactttgaagtaagttatcgtgtcatggaagaaaaagagaaataccgaaagtcgtcagatattaaaaatgaaatactccaatgggttaacttagggtcgggaaggggagaggcggtggcgggcggctgaggctttttgttctcctcctgtgagaagagaggaagaggcggatcggattgggattggggatccatccatcgatcgattttgccttgccagttttcatccggctccgattccgcttctcatcctctttccttcccttgattcctctcctctcctctcccctctgagtcgggtcggggtcggggggagtagggtttctctttcgacttgccgcggggcgtgggcgaatcggcgcacaccacagcatctatgccctaagactcagaggtgagccccttgccccgcggacgaaccctcctactcttcttcttcttcttgtgttgctgctaacccatggatcgatggagtttttttctctcttttcaggtgactagctccatggaggacgatgacgatgaccaacgcttgcttcacagccttggtgtcacgtccgcagacatccacgatattgaaaggagaatcatatcacaggtacgctacgcaatgcaatgcactctt

SEQ ID NO: 93289 - DNA, 685 bp, Oryza sativa
gttaaggaaattcatcatggagttcacagatggaaggagtcctactcgaacagagctgggtcatcattttatcgtgcaacgtccgatgtctcggagtcctacttggagaccagttaacgtgcgatataaaagggacctccgggaggacctaagggatcaaatttcatagtcagcacatccaccacagcctacggagttgaagccaagtcgccaggtgatctagtcgaatcaactcgactacgatctcattggtatcatcgagttctgcttctccttctgtaatctgtggtttccattatataatcccatatcaactggtttagggctattacctatcaaggggcctgaaccagtataatctttgttttctgtctgcttgatgtcgtattacgtagatcctcgtaacagcataccccactaccctctatatccggtctacgggtatcccccgtcgacaatattgattcttataattaattaatgtaaaactatatatgtgggtttatagaaactaatggtgaaagattaaaatgtttggcttataacatctagaatgacaaattaactcgaaatagagggagtatatagtttagaaatattagctacatgttttacaattagccacactaattattttttaaagtaccatcgtccgtataattatttttaaagtactattgtaaaa

SEQ ID NO: 93290 - DNA, 842 bp, Oryza sativa
agttttgaaaatgctttgggagaaatattgaaacaatttgcagaattaaagaaaaatatagagactggcagtacaatactcttacataaacagtacctgcatgtcagttgaaggattccagtcaggatcatatataataatccggtttgcaccagtcaaattcgtacccagtccaccaactttcgtggtcagaatgaaaataaaaatttcatctgtgttattgaattcatcaataagtgccattctttgctttgcaggtgtaagtccatccattcttcggtattggtattcgcaagctgtcaagaagttctccataatgtcaagcatttgttgtgtctgagtgaaaagaagaacacgatgaccttgttctttccatactttaagaacttgctcaaccactttcatctttccacttctttcaggattcccatagtcaggattctgagcagcatgttctctctcaagtagatcaggatgattgcatatcttccttagaacatctatcccataaagggaatttctgttaccatcaaagatttgttccacctccgaactagcaagaaatgcacgataagtagcacgttgctcagtagttagactacagaaaagaacatgctctgttttcttgggaagctgtgcattgacatcagctttcattcttctaagaaggtacggcatgaccaggtcacgtaggacaacagcacatcgatacgccgtggacacttgcaatggtgttgcattagcgtacccaccaacagtaattggaacagaaaactcagcctcaaacacaggcaggacacctagttttccagggaacacaaaatcaaagagagaccaaagct

SEQ ID NO: 93291 - DNA, 1636 bp, Oryza sativa
aacctttggccaacatttatgaatattaaccttttgaaaacaaaatgcatgaataatgttctacagcctaaaattttagcactattagcattcacaaaaatcgtgaatattagacgtaggagttttttttttccttcggtctataactttcgtgagttcttgccttgggggaaattgatgagtattcaaattttggaaaataaaatgcatgaatattgttctcttgcccaaaatttcaaggatattagctttgggattgttacacacaaaaattcgtgaatatagttattgcgttcggaaagacatgcataaatatttatctccagcctatataatgtcacgagttatagtgttggcgtcacacttcaatttctttgtcatatagtactcactagtgtatgcactatgcagcaggtatcgacatatattgtgctccggcccgttgctgattgattccaggtaagtttggcaaagcgtccatgactcatattgtcatattgcctccatgacaacaagcgaggggaaatgctttaggtgaataaccggaggaagtatccggatgatgtatttgctcctggtctaggtgaatagccttctctggacactgttgtctgccctggaggtaggtttgataacattgacaggtatctggattggcaggtcccaagtacgacggagaggcccgcgcagattagagctgatctataggtaatcacatatgtccataatatatggtttttttaatataaatgtttccgcacaacaaaatttgttcagtgctccctcagtttctggcgccaactttcaatagttgtgagataattaattcatatactgtacctgttgctatataagagcaagttcaatagtatagccaactactagctccaattcatctatagtcaatctaatagcccattcatacaatagttacatactacactattaatatctagtcccacctgtcatagacacactgcgtcttggagtccgtgctacagctggctacaaatctgtagcccgttgctcttctctctcttgatttatcttcgtaaaatatgtttgtagctggcttatagcctgccattgtacctgctctaacgcagcaaagtgtgatgaatgttggtgttgatgatgggatcatgggaagtaaccatgagataacagaggtattgttcgatggagtaagtgtattatatgtatgtaaatattatattattgtaaatcattttgaggagctagactagcgtgccttattaacaaggagatatgtaccattacatgatgattaacatataaatctgtagctacatggaattaaggtagtggagcagaggaggaaggatgatagaagactccaattctccatggatgggaatgggatcaggtggccttgcagaactctccgcccagatcgtcgcacgcctcctcggggaacaccctgcgtgcaattttgtgttttccgatttcagttccagttagttacactagatttcatcagttgggtagtatagtagtagagcttaattaattacgtggtgggctcgtcgtaggataggtagtccctgtcgacttcctccgccgccgcacgagaaacagcaacagcagccgatgatgagagcttggcctctgggta

SEQ ID NO: 93292 - DNA, 794 bp, Oryza sativa
caaaatcgtctatttatgcagttgatggacgtagtgacagcatatctttatgggtcacttgattatgatatttacatgaaggttcttgacggaatcgacatcccgaatcagaaggtaaatcgtaacatgtattgtgttaagttgcagaagtcactttatggcttaaaacaatcgggcaggatgtggtacaaccgattaagtgaattcctttcgctaaagggatacactaaaaatgatgattgcccgtgcgtctttatcaaaaagtcccccacaggattttgtattatctcggtatatgtcgatgatctcaacatcattggcaatacacaagatattaatgaagcacgtcatcatttaaagacggaatttgagatgaaggatttgggtcaaaccaaattttgcttaggtctacaacttgagcatttaccttcaggaatccttgtgcaccaaagtgcatatatccagaaaattttggagaaatttaatatggacaagtcatatccttccaaaacccctatggtggttcgatctctagatgtggagaaagatccatttagaccaaaggaagatggtgaggatgtacttggacctgattttccatatcttagtgctattggcgcacttatgtaccttgcaaatagtacgaggccagatattgctttctcggtaaatatattagcaagatacagcgctgctcctaccaacgccattggactggagttaagaatgtctttcgatatcttaatagcacaagagatcttggacttttctttaaaaagaaccaggattcgact

SEQ ID NO: 93293 - DNA, 524 bp, Oryza sativa
  unsure (1)..(524): unsure at all n locations
gaagcctgctgctaacagcttggtcaattcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggggatgagcgcgctttcctatttacaatctaactcggcgcctattacagcagttttggtaggatcggaaggatctaaaggaatctttttagtctcggcttcggtttccccactttttgaaatcttggcagctggcacttctccttcgctcaccgtggttgcagccagtcggatttcctctcgggcagacgccatctcgcgggtttgggccatatcacaactctccttgtcacatgtgacagcttgcttgatgtcgctccgtagggttaggactcctcggggaccaggcatcttcatcatcatgtatgtgtagtgcgggacggncatgaact

SEQ ID NO: 93294 - DNA, 574 bp, Oryza sativa
cgggcacaccgttgagcgtcacctcgtagtgcagattgcactcgttgtcaatggacatccaggccatgccgacggcatgtggattctgtgcatccgcgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccggtgctcttggtcgaggattcggcactgtgcgacgccagcagggtttggaagatttcgcagctggctcgagtcacgatgtgtccctggatgcgcagatgtgggtacttcttggactccacggccagcaggagttt

SEQ ID NO: 93295 - DNA, 4048 bp, Oryza sativa
gtagttttgtgaagttactcaaaaaaaacccataaagggtacccagctatttaaaagataggagggtgactagagagtctctagggttgtgctccaccaagttgggaagctaaccacttgggcctctcagatgaatttacatgccaatgggctcattacaggtggcgtatcatcttgtttctgtaattcccactgactcatttggaatttcgaggtaaggccgcaaataatgtaaaagaggactccaagagctttctagtatgtaatatatatatatatatatatatatatatatatatatccgacccaaaacaaagctcgtatggacatttggcattcgtttgaattcaacactattgcaggtagcccaattggattacataacttgggcggcttgatctcaaggtttaggatcaaagacataatagagggggtgaataggattcctaagaaacatggtgtaattagaagttaaacttgctaaacaaagactagcctatgtgcctaggtttatcgcaagtgcaggcatgttttgtaccctagttgaagtcctaacaattttacagcaaactaagtattgaaaggaaatacaaactaaagagaggaaagtgataggaaattaaaacacacggcacgatgagttcttcccgaggtagtggggataggaaattcaaacacaagatacaagagtatagctccctcccatagtcatgaagtctatatgcgctatcatcatggtgattcttttttgctccagaaggtgaacccaaaaccttcacaaccacataaggtttcccacaaccttcttgagagatcaccggattgcctctgagactgactaggcatgccggaaagccaagagtagtaggaaaaaaccttcactagaagcccttagaaacaagactcttggatggtgcacagtaagctactctcaactcaaactagcactaaactactgaagaaaattataacaactagctcaatggtgttcttggacacgcccttcaattattgagctaaatagggtttccagaaacattagggagtcctagaaaagtgataaatatagccccaaccgagctcacttatagccattcgtagccattggagatcaagcagccagccctcctggtgaatctacacttcaatttgatgaaagtagaattggagatatctctcaagtatctcaattagagaatgaagctttaactcaacatttcactgagaatgagattaaagagcctgtattcaaaatggaacatacaaaagcacggggccctgatggttttcctcctgagttttaccaagttttttagaatgttgttaaaaatgatttgttcgctctttttaatgatttccataatggtactcttccgttattttcgcttaactttggtacaattatcttgttacccaagtgtgatgaggccatgaaaattcaatagtataggcccatatgcttacttaatgttagtttcaagatttttaccaaagtccggaatatttggtaatgtttcggatttgccatatccgttcctccaagaatatcgctcattgcctttttccgaccgttaccgcaccgctttaaatactaaccgtcgtccccgagaaatttcacaccgttagctccgttttcaccacttaagccaacctcgtcttctctctctccggcgatcccctcgacgcaccagacgatcccaaggcgatttcctctccgaccaaacttccgcctgcgatgatgtcaacttccgccatcccgtctgccgcgccatcgaccgaatacgcagaggtaagtacccatcggctagattctctcctttatgcagtagattggttcttctttgtcttatcttgttttcttcttctcttttcttgtttgcatctgtagcacttgtccaacctggtcgcaattcccagtttgtcacatgaacatcactactttctcggtccaatcggcaatcccgatcccactaagtttattattgctggaaccaataggatcccttttagattggccaacccaatcctaagtcactggaagaataccttcaagtcttggccttctcttgagaaaacttcccctgagaaaagctggtctgtgtggtataagcgtgtattagccagcaagcaagttcattgggacgaactaggaatcggccatgcccttgctcttacattagcaaattcggctaaggacaaacccttgatggcctctccagcctattgttggtccaacgcccttaatgctttcttgtttaatcaagggccgatgactcccactctgcttgacatcaccatgattactggtctagatgtgaccttatcggctaaccccatgagtttgaataccaagaatcaatttgattttaggaccaacagcataggtggttggtctggctatgtagccgcatatatgggcaaaggatctgccaccccccgagagcacactgcctttctcttcatgtggcttgaaaagtttctgttctgtggatcaagctgcggtcctaccaccaactggcagttcttagccgaagcccttgaaagcaagagacaattccctctaggcaaaatccttctcggctatctgtaccaaatgttgagtaatgcatcggctaagatagccacaggctcagtagtgggtgcgggtggaccatggtgattgctacaaacatggcttaatcttgtcgttatgaaggttgtgaatcggccgcctctgatagatgctgaattcccaaggctggagcccaccaccaatgatgacagggaagaagttacccatcgccgatgcctgtcgtatggtgaagctacatcaacaccagccgattctggagcaaagctatcggctcaactgctcaaggactggttctgcagtttctatgaaggcttccaaagagatgctcgagtctggtttccatatgaggactcagtaaactttgatctcccatcggacttcagatttgaagacatcaactctgaaaattccaaaaatccagagaagtcttctcggctgccattagtccatgcatccttcctgttggcattcaccaagggagaaacatacaagtatcttaggagttataccatccaatgagctcggccagacaattggaatgggatagttgccgatcggcttgttctttgccgataagatccagtgcagaggagaaatctgatcaacattgatgatggatcggctgctcaatatcctaggaccccctttgggtagtattgataacatagagctggcaaggttcaggagcaggaactttgaaagatggtggggtgaatggaagcaacatatattccatcagctagcctctatgtatatgacagatctattcccagatattgttcctcaggtatatcgttactctgtcaattctgttgtaataaaagttagccgatttgtacctttaactaatctcttcgtttattttgcagacaatagaatcttctcctcctcgcaaaagcaacagtggcagagatatagaatatgtcctaggccttctaccaaatggaggtggactagctcctcctgtcattggctatcatgcccccaggaccacaagtctgcttcaagagcaaatgagagaaccacccgatattcgtaagaagagaaaaaccaaggcatcggctattgatccatcggctctggctcccaagaagaagaccaagaagaataaacccaagccagccgatgacctgcctactttagatccatctattgagcaagcctgggatgaagaagagatcgaagaagatgtttgtcacaccctgaagttctcctcccaagccaaaaatttaatttataaatgaccctaagaaaatgccggcgcaaatcaagagaaaaccctaagaaagtaatacaaataataatcgaatctgacatgtggaatttttcttgagttctacatgtcgaaattcactaacaggatttttagtggaattttcagagccctagaaataattttgaccaattaaaattgagcataagcaatatttaaatccctggaaattcctttcttcctttttctttttccttttccct

SEQ ID NO: 93296 - DNA, 783 bp, Oryza sativa
tagacatgtggaagtacggtagtgctttgcaacagagcccgaagaccggtccttatatggtcgaggtgctactatcaaaaccatgcactccgagcccagcctaaaaccattttggggattttgaatagagggggcggtgtgaatccaattccacaataaaccaacaattccaaagtgtccaggtgatatgaatatcccaaagtctagagttgtaaaaccgcctaatgttacctaattaatcagcgaagcatctacctaaaattatactagtggtactatgagtagagtgtccactagttggggttttgtttaatctagggtgaacaaggtaataataataacaataataataaggtcataacaaaggtagataggcatggctaaataaaacagtgataacgcgggaatttaaataaagcgataatgcaataatttaaatcaacataattttataaactgggattcaatatgttcaaggatgatgtgacttgccttgctcagagagaacggccttccgaaccttcggcgacgaccacgaaccacgcttcgggaacctccggaacgacagaagctacgcgaagcacacaagcaaagctacaagcctataaagaagcaataccaatacataaaaagaaaacacagggttctttaggttataacaaacattaagagacttgaacgggtcgattcggagctcgtatgaccaagatatgatcatccgaagtttaatgctgttatatggagatttgcggattattataattgagctttgcaactataaaa

SEQ ID NO: 93297 - DNA, 1496 bp, Oryza sativa
aagacgattatgaagatgtgaagcctattcatgttgtcaagcatctctgcactagaattatttttctcatggaaggtttattcccgtgaagatgagtcacttgagaagcccaagttcaaatgtaaaatgaagaagtcttaaagcacctatggcagaacctaagctttaccctcaagagtagtggtctcttgtttagttagatcgttgtgttagcttgcttgcttaagttttgtttgtgtgtgtgtgggttttagcgtatggagtatatcgagggttgtgatataaccatactagtttcagtgttcagttcagtgttaaagaacaacctacctcacatcaataaaagttaaagtttagtaaaaaaaaaagtctattctattctgagtctcctatctactttcttaacccttcctttctctctcttacctcctacctaagagaatggatttaaggaaaggaagttttgtgctcattagtgccagtggttttaacaagttaacagctaaggaacaatgtgtctggatctccaaataaaattcatcctgaagctaatgtggacaacacagtctgtcatccaaggaaagtaaaaagtcagaagctcaagggataccattgaaaaaaaaatcaagagaattctttacatttggtctcattcggtttaaggttccaagtttgatgtgagcaagagtcattaaggaataagaaagacaaaagcttacatctatgtcatcaagatgatcattatcactataatgtggtttaaagaaggaacaattatatcaaggtgtctaaaaagacaattctttttgtactatttttaagtcaagaaaatagtgtcagcaagaccaagacactcaacaatgagaaatataaagagatgttgatttagaagaaaaaatagcaagaagattcaattcacacgtcttcagtgtgaagtaaatggaagttaaagtttgcattgttatggaaaagtgaacacattaagtagagcaattattcctgttatcatggtaatggaatatcaagtgaaggctcggttcataaaagacttgtctttcaattaatggaatggatcaggagataatgattgctagcccaatttagtaatagtcaggctcgtgaatgatggcagaagttgtaatcgatcattcgatggtttcttgttgatggcagtaatcatgacattatttctgttaatagtaaccatataatactatcagatgtgatcaacaaaagtatcatcaagaaaggtcgcgctcatgacaattaaggaccggttcgcgagctattgttgtgagacattaaccgtaccaaccacaagccagcgtgggcaatggctttatcttttgtatagcatgattcattatggtgtgccagactgagaagtggcgagaagtccgtgggggtcgctggggagtccattgcctctggttttgagggggagattatgatccaggaatggtgcactgtggtgagttgtgttgtgcgaagggtat

SEQ ID NO: 93298 - DNA, 3471 bp, Oryza sativa
cggagaagatgtcttaggtggagtcttggcttataccccagttgagcgcctgtgaagatggagccgtaggcccgctagtccgctgctgtttatttttgattgtcaggcctgaagtgcctttgtaataatgtaaatattatcgatataataaagatgtgccttttatatcatgtttgtttggtgtaccccggcttttcctgggacggggattaatacactagcattcgggaaaaggcaattttctcggtcgcggcagctgttgacatttggaccgtaaaggagttttctggttacagccgagtgtacgtgaacctacagggtcgcacgctcaatgggccagaataaggggattggatggagatccaatatgagcttaattcggatagggatccgagtgggagtcctacgggtcttggaggcccgagtgatagattctatatattcatgagggatgtgaccagcggaggtaattgcatcacgtgagaaaccctagctgtcactcccctccccgagcaaaaccctagccgcgcgtgggtgctagcacatctgcgcgtggcgttccgtccttgtaggtgtggatactcgtagaggcgccgctggttttcggttattaataaccaaatttagtaatccaagtatcggagatggagataaaacaaagcggaatccaagataaacatcgtttcggaaacagagcgagaatcggctaaaagtccgaatcggctatgatcaggatcgacagagtttgagtcagactaggttggccgattgagccgatgtcgacaatgtgacgcggtacacgttgtcgggttgagttaatgtgcttcatgaggattgccacgcatggattgagtcctgagaaggcaattgtatctattaattaggatatttcatgtaatttccttagagatatgtttgggcaaaagtctgccataaagacttatggtatcttagagtttattagagataagagtcgtgtctgacacagacatattttgcaatctcgggtataaatagaccccgagtctcatgtaatacaacaacacacgtttaatacaatctcgggtcatcgccacccttttactttcgtttttgtttcgacgagttcttgctttcgggttgagctgcatcggtttcgatcttcaactagaggtaaaacatgttatggcggcttgcattctcgggattagtgcttctatttttatgataccctaatcttgtttatgtaattcgttgagttatcatatattctatataatccctggcaatattgttcttctttttatacttatagctgcatcagttgagtttgattttataagtcgtgattagaatctcaatttctagcttgcttttggttgccgattagggtagcatcggggtttcagccgatcttacctgatttagccttatatttcatgtgcttgattgatatgctaaatctgccctttatgttaagatcttgttgcatttaggtatattaggcttctgtttgatatattttacttgcttaatatagagtggtatcggagtattagccgatacatgctagatctatctgatcggctatgctatgagcatctataatctcattgttagtatatatttcgatctaagtgatttatactgtttcggcatggcgaccgatctatcccaatcacttgatttaagtatatatcgacataaagattatatattgttaatatctacagccgatcgagtagatttaagtctttcttatttattcatgattgcggatcgattcacatatgacatcggctcaaagataaatgatatgtcatcggctgctggccgatcggctatcatttatggatttaaccgtggtttctttgtctttatttcttgttgattgcaggatcaaatcaactggtgtgctcacgaacctaaaggcaagatttttggacctgcactgaagttaagtagatcttccaggcctcgtgtttttgcatcaacacgcttttggcacgttgccagtgccgatttagctctttgggagatggatggtattgattgcctgtctggaaaagtttgggatggagattttctaaaagtgtccgattgtgatatacaaccaattgaagatggagagcccaaattattattttgagggcatcaaacgtctataccaaggacacagtagataatctcgatgacaagcaaggacagggtttcatgtcggctgatgatttggaagaaattgatataggtccaggtgacagaccaaggccgacgttcatcagtaagaatttatctccggaatttagaaccaagttgatagagcttttaaaggaatatagagattgctttgcttgggaatattatgagatgccaggactcagccgatcaatcgttgaacatcggctccctatcaaaccgggggttagaccatactagcaaccgccgaggagatgcaaatccgatatgcttgaagctgtcaaggctgaggttaaacgtttgtatgatgccggttttattcgtccatgccgatatgctgagtgggtttccaacatagttccagttatcaagaaaaatggcaaagtcagggtgtgcattgattttcgggatctaaacaaagctaccccaaaggacgagtacccaatgccggttgccaatcaattggttgatgctgcttcagggcataagatattatgttttatggatgtcaatgcaggtaacaatcagatctttatggcagaagaagacattcataagacggctttcagatgtccttgtgcaatcggcttgtttgagtaggttgtaatgactttcggtttgagtgaatatttgctttaaccgaatttgatcttcggtatgaatcaccaaaggcgattaagggacaggctatagccgattttattgtggatcatcgtgatgactcaatcggctcagttgaaattatgccttggacattgttttttgatggatcagtatgcactcatggttgtggtatcggcttggttataatttctcctcggggggcaagtttcgagtttgcctacgttattaagccctatgcgaccaacaatcaggctgagtatgaagcggttctcaaaggattgcaattgcttaaagaggttgaagccgatgctgttgaaattatgggtgattccttgctggtgatcagtcaattggcaggagaatatgagtgcaagaatgatacattaatggtttacaatgagaagtgccgagaattgatggatggatttcggccggtaactttgacgcatgtgtctcgagagcaaaatgttgaagctaatgaatcggctcaaggagcatcggagtacaagccgatgataaaggatgtcaaagtagaagttgctacgataacagttgatgattgaagatatgatgttttccaatatttatagaatccatctcaatcggtgtcacgcccggaatttctatccaaaatcccaaacgcttacatgtgtgttaaaccatcgtccagga

SEQ ID NO: 93299 - DNA, 3165 bp, Oryza sativa
aagtaaaattgagggctcattttagaccaggaagaatttacaaaaattctccgggccacattcgaaatttttcttgtacgtattttagtgtttgccaatttcttttcaaattttaattaattctattattccttttagaaaataatttttatttcgggatgaatttatcaggacgtgacaaatgtgccatttttggatgctatgcaagtaccaacatacgcccgttatctcaaggtcatactcaacaacaagagaccgctcccaacaacggaggtggtcaagctaacggaacactgcagcaacctgatactccacaagctccaggagaagaagaaagatccggggtgtcccacgatcacctgctcgatcggggcacaacaattcgtccatgccttgtgcgaccttggagctagtgtcagcgtcatgccaaaaaacgtctttgacaaactcaacttcatggtgttggcaccaacaccgatgtgcctccaactggctgattcatcagttcgttacccggcggggatagtggaggatgtgcctgttaagatacggaatttcttcatcccggttgattttgtggtgctagacatggacatggggaaggagacaccgctcatactggggcgtccgttccttagcaccgcaggagccaacagtgacgtgggaacggggagtatcagtttccatatcaacgggaaggagttaaagtttgagtttcaaccgaggacggaacaatgcttcatggtcagaatcaagtacaggccaaacccgcagaacattcaagaggtcgaagtggagcaacccaagacggatagcctggtaaggttcatgcagaacttcctgggaaaggaaacaacaatgcccaggaaccgttattggaggacgctagtaaaatcacctgtaccggccaagaagttagagcagccagctcagaggaagccgtcttctgcactaaaatcaaaggtgtggaaggaaaagccaaagacgcccgctccattacctccggagacgggtggaaaatccgtgaactgaatcgaaaggaggtatggtcttgcacgacggactttaaatgacgcgaccttcgccaacaggtaaattggtatgtatccgcatatttgttttcaacaatttgaatttttgcatcaccacatatttgaatttcaaaattgcttttaggacttttgaattttgaggaaattcttcaaatgaatttttcagagcaaaccaaaataaaattttcaacgaaaattcactgtgccacgatcacactgaccgttggattccaacggccgaaagtggggccggttgggcccactaggggttcgcccgaaccggccaggcaacggtcagctgcctcactttttgaggcaacggctagtgggttccacatgtcatttttgaccgttgtgggtatcctacaaaagccagccgcccgagagagggaattctaccccatttcaactcattttcatttcctctccaaagtttgctcccaagttcattcatgctttgatagttttcctcaacttcaactctttagttgcatacatacaagttgctttggtgaaactaacaggcgggtgaaactcttgtcatttctaacccccgccgagttagcctgttcttgctccattgtgtagtatgaggaggcacctgtctcgtctgtcaaaggggtcgggctctctatcaagtcgtcatgacgagtctagtactcgttcatcagccgatgcctcgatggaaaacgccgacgctccgcgacaactcctgagcgacactgacctcgaccttgtcagtgatcgggagagacaagcctactacatcctgagcgaccgggagtatgctcacacgcgagaatactcaccggagttgctgaaaaagataggtttggatgttgaatttcgttctatttggaaagctgttggttggcagagatttgctgtggtagatgagtctggttctcgtttgcttactttgcaatttctgtgcactttgaaagaaatagaagatggtatttcttttcgccttttcccgtaaggagttcacgctcacatgaaaggcttgagtacacttcttgtttttcacgattcctttaaaatcgatctccagaaaggaatttcttggttcaagaaaaataggttttgggaagatatttcgggtgctccaatttgcaagaaacctagaacgaatgatatccataatcctgcacttaggctcatgcacaaatggattgctatgactttgtttcctagaagtgatctgagacccattaggggagatgaattaattatcatgtttgccatggttagaaagatcaaaatttctcctgtaaaatgtatgataagacaatggttagaaaatataaagttctttgctcctgttgagtgcacttctctgattactcggatagcaaaagggctaggggtcgttagcgaccaaattgcttttatctcagccgctcgtccgcgtattgatgaggcttattcagtgcaagggcatattttgaaacatggggtagatggatctttgatatacttttttcccggttgtacaaatgaaatcccgttgccaaatgcggggtatcatttgtacaactgccatgaactaaccattcccctgcagaccgtagaagaatcccgtgcagatggaacatacagggagacgcgcaagatgacaaggaacgaacaaggaagttcatcaccctcaacacccgtgcagatgtatgaggcaggttgggcaccaactggggatgcacccggatggacccaagctccacgccatagcatcggagtctcaacctggtcaagcgccagtgaggaccggtggcatgcgcctgatgacatccactggggggataatcaacctcccagatcaagtggtgtgcctccatgtccaagtgaatggggctcgagttcctctcattgcaacttgggtgaaatcactaggagaatggacacccttgatatgcagacgggggagatccagtatgacctgatggaacacatagctcaaacgcaagaatggcaacaatctgctgatgctcaattcaccaacatcaacaacatgatgcagcaacagcacgacgaccttcaagcatacttttgctttcaggggttcaatccttatcaagggccctaagcaaaagccaagcttggggggagacgggct

SEQ ID NO: 93300 - DNA, 2038 bp, Oryza sativa
acacgaagatacacataatctccttcttcaaaactcaaatctctgcggcgattgtcggcatactcttatgacgagactgagccactcgcaatctttcttgaatgattttcaccttttcttctgcttcccttaggatatccgtcccgaaaacctgacgttctcccgtttgatcccacaaaagcggagtgcggcacttccgaccatacagtgcttcgtaaggagccatctgaaggctagcttgataactgttgttgtacgaaaattcagcataaggtagattcttatcccaacttccaccgaagtctaaagcacaagctctcaacatgtcttccaaaatctgattcaccctttcggtttgtccgtctgtctgcggatgataagcagtactaaagttcagcttagaacccatctcttcctgaagtttcttccaaaaatttgaagtaaactgactgcctcgatcagacactatctttttaggaatgccatgcaaacacacaattcttgccatatacaattctgctaaccgactcccggaataggttgtctttaccggaatgaaatgagccactttggtaagtctgtcgactatcacccaaatagagtcatgacccgatgacgttctaggtatttttgtgataaaatccataccgatttcttcccgcttccattcaagaatcttcaaaggctgcagcaaactggcaggtttctgatgttctgccttgactcgctgacaaacatcacatactgctacgtactctgcgatttcgcgcttcatacttgcccaccaaaatctttccttgagatcctggtacattttgatactaccagggtgaatagagtataaagtatcgtgagcttctttcagaattgcatcttttaaatctttgttgtcaggaacgcagattctctcacccaaccatacagttccgtgctcatcctccaagaaaccgatagcttttcctcttctcatattcttcttgatctcttgaatatcaggatcattaatttgcgcttctctaacttgatcaattagagtgggcttcgcttctaaggctgcaataaaatctctactgacaattcccaaatttaatctttcaaattccttgcataattccaatggcaacttgtcgccttctgtagcattgcaatagcctttcctgctaagagcgtctgctacaacattagcctttcctgggtgataatgaattcccatgtcataatccttaattaattccaaccatctcctttgtctcatgttcaggtctggctgagtaaaaatatactttaaactcttgtgatcggtgtacacctcagtacgagtaccgaaaagataatgacgccaaattttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatacacttggaaacccttctttggatcaggtaaaatcaaaataggagctgatatcaagcgattcttcaactcttgaaaactctgctcacattcttccgatcgtggtaacacattacctaggtgataatgaatttccatatcataatccttgatcaactctaaccatcttcactgtcgcatgttcaaatcaggttgagtgaaaatgtacttcaaactcttatgatccgtatacatctccgtacggttaccaaaaagataatgacgccaaatcttcaatgcaagcactaccgctgccaactttaggtcatgcgttgggtagttattctcatgagggcgtaactgcctagatgcataggcaaccaccttcccatcttgcattaaaacgcaacccaaaccatgtcgggatgcatcacagtacacttgaaaacctttcctaggatcaggcaagactaacacaggtgcagtcactagcctttccccccctttcccgctgggccggccgaaggccgaggcccagctgagccgagccggccgcccgcctcctctccc

SEQ ID NO: 93301 - DNA, 2055 bp, Oryza sativa
  unsure (1)..(2055): unsure at all n locations
catttaaccttggtttatttcttcttaataataatttgtgctctgaaaattccactaaaatgtatttacgcattttaggcttttaggaaatatacaaaaatcctccaagccttattcgacttttaactttgcacattttaattgttggaggctttcacatggattttacttattctatgcataatttcgaggatgtattttagatcgttttgggacgcgacaaacctaccccccttaaacggaatctcgaccccgagattcggaagaactggcgaagagatcgggatgggccgccttcagctcgtcttcacgctcccaggtagcttcttcctcggcgtggttgctccattggaccttgcaaaaacggattacccggttcctggtcctgcgctccatggtgtccaggattttcactggcctctccacgtaggtcaagtcttcgcgaacttcaatttgcgctgagtcggcctgctcggatggcactcggagacatttcttgagttgcgacacatggaacacatcatgcacgttgcccaaggaggcgggcagctccaactggtaagcgacttctccgcgccgagcaatgatacggaaaggacccacataccgaggtgcgagcttcccttttgtctgaaacctgtgtacacctcgcaatggcgtgacccgaagatacacaaagtcacccactgcgaattccaggtcacggcgacggttatctgcataacttttctgccgggactgtgccacttttagattatcccgaatggttctgactttagcttcagcttccctcaggatatcagtcccgaacacttggctttccccaacttggtcccacaatagcggtgtccggcatttgcgcccgtacaacgcttcataaggtgccatttgtatactggcctggtagctgttattgtaggagaactcggcataggggagactcttatcccaggtcttcccaaaatctaggacacatgcgcgaagcatatcttctaggatctgatttacccagctcttcttggagcttcttccaaaagtgagaggtgaattggcttcccctatcagatacgattttcttgggaacgccatgaagactcacgatcctagcgaagtagagttcggctagtttggtccctccataggtggtcttcacaggaataaatcgagctacctttgttaatcgatccacaactacccatatagaatcatatccaccttgggttnttggaagtccggtgatgaaatcccatcccaattcatcccatttccattctggtacttggagaggttggagaagtcccgcccgtccgttgtgctcttgcttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatttggaacgcatacccgatttccattccatagggtcccgtgttcatcctctgtgaaaccagcggctttaccctgtttcatattcttgaggagtccatgcatgtccgggtcgttcttctgagcctcgcggatttgatcgagcaaggtaggtttggcttccaacgcagccaagaatccacgactaactatgccaaggttcagggcttccatctgttgattaagttcgggtggaatgccacggacgttaagagtgttgcaatggctttttcgactcagagcgtcggcgaccacgttggccttaccaggatgatagtgaattcccacatcataatccttgatgagttctaaccatctcctctgccgaagattcagatccgactgggtgaagatgtatttcaaactcttatgatcggtatatatttcacagcgattcccaataagatagtgccgccagatttttagagcatgaaccaccgcggctaactccaaatcatgggtagggtagttgccttcatgaggtcgtagctggcgtgaggcataggccaccacatgaccgtcctgca

SEQ ID NO: 93302 - DNA, 743 bp, Oryza sativa
agctcatccatatctgttcgccagttcttccgaatctcgaggacgagattctgtttaaggggggtaggtttgtcacaccctgaaaatcataaatatataaattgttgttaaattggaattttttagaaataattttaaaagtcttgaagagaagatctaattttaaaaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcttcttttggctttgggccgaaagtcggcccaaaacctcctctctctctcctcggcccagccggcccagtccgcagccgcagccgcccgcgcgcgagtgcgctgtcgctgacaggtgggtcccacctgtcggagtcgtcgtcttcgtcgcgccgccgccgcccgaaaccctagtttcgcgccgccgccgttcctttccaaatccggtcgatcctttccgtttccggccgaattgatagaggggaaatgatcatcgggatctcctctaccttttctcttttggaaacatccgctaattcgttttggaagttcgtggaatcgagttcgattcggatcggcctctttcctccgaaccccgaagtttccttctcctccccggccgccgtgggctttcgtcaccgcctccgagccccttta

SEQ ID NO: 93303 - DNA, 704 bp, Oryza sativa
agagtagtactaggtctatctaatagatgtgatcataatccatattggttaaaaaatgattttaagtattgtgactcatacatctgcataccagaaaatattgtggagcagagtacaaataagttaaatgatgtgccagcgcttgttacacatgccctatactatatgcctcttattaagtgccaatgggcaataccattctgttatttgagggctgttgaatgacacttgagaatgtccaacagttacatactcgacacaattgagattaagctaggcttcacgaaatcattcagtggataaacagaagagcacctaattcgaagcctcaaagaacaaaccttgttctggatggagaaattgatgaagtttgtatccacaataacccggtatggcggcccgagcgctgtgttgtagctgaagaacagcgccgaagagacctgaggcctaaaataataaaccaacaagacttgattaatccaatcatcccaataatcgttaaacactttaaacaaatggatcccaaaacgcggtaggcactcacacattccgcccgagcttctccttctcgttatccttcttcttggggttcaacacatcctccttgtacctagaggagacaaaatttagggtcgcaacaaaaagaaccgaatcaccaagaaaccaataggagagggagatggtttgcctacttctggatggtc

SEQ ID NO: 93304 - DNA, 636 bp, Oryza sativa
caaaagacaaggattatactggctcaagccccttatcaggtaatagccatagtccagtttatatgagattgatgatggtgagaacagattacaaagagaatagacgaaacggatgataccgataagatcgtagtcgatgagttcgacgagatctcccggcgacttggctccgcgcactccggcttcgtaaactatggtgggtgtgttggcgatggaattggatgtcctcacacccctccttgagggtcccttttataccgtggatcgtattgacccctaagaaagattcgaggatatttgatctggtacggtataacagaaactctatacatttccgagtaggactttggacatcgcttgactcgtagagataatttccataatttggaacggatttctaccacgtacacgggaacgatccgtatacgtgaaggtataccatattcgtatattccataagtcgtaggatagaaggtatgccttatctgtaaccctaacatcgggatactacctaagatttcgttggatcgtgtagtaatgaatagtaggatcgagatattatgaaaattaggattctatgtgtgatcggtatcgttcggcttgataggatcgtagtatcgtaagatattcgaatac

SEQ ID NO: 93305 - DNA, 741 bp, Oryza sativa
aatttatatatatgatgatagtatgaggctatatatgagctgttgttaggaatttagagaatttagagagggtgttttcttcgatgaactatataaaaacaagaagcaagatgagcaacaatctacatttattggaagagaattttttgtacaagttaaaggatgaggacatcatcactcatttttaaaatatcaagcattgaaaagttctcctctaaattgtaagttttttttatcattttaccattttctatcctttacatgttatatatgttgccactttcatatgtcgaacaattagtacttatatatgttaaagaatttggacttatgatcaattctatcaatttataaagttatggccatatgctataatattatacaattagtaatgtgtaatattataccaattaattattggacttctagaagtaaaaagaattttgttttacccctacctatttcgaatacccaacctctaaatcctgggcccgccactggatcataatccaacggccaggtccaggtgactgaaatgtgcctagcgaatcctaacatattcgttctttggccccggcgatgagtagcaagtttattactctctccgtttcaggttataaaacattttgactttggtcaaagacaaactgtttcaagtttaactaagttagtttcatcaaatcaataattgaatatatttttataataaatttatcttgggttgaaaatgttactaccttt

SEQ ID NO: 93306 - DNA, 504 bp, Oryza sativa
tcgtggaacagcgtcgacctgcgcgacctcaaccagctcccgtcgttcaccgtcgggtggttcgccgtcacggcgggttccggggactacgtcatgctgcgtcacagtagtagcgggctcttcctccgagctgatggcgggaacctcctgtgcaatagcgtcggcgtcgtcgtcgacatgttcgacttccgccgcagagagatcaggcagtgggtggtggaggccattcccccgagagattccatgcctatcctccccaatccttcggtgagcttgtcatgccctgtttcctttcctgatgcttgcagaattgattgcattactgggttctccggggatcaattcttgttcttgatcttttcttgtgtctgattgctgcgaattgtgttaattcctttctcctggatgcgattctttgctctgtttttgccatagttcaaggtgtccattctctatggtgcgcattcgtaggtggagcagttctctatgttcttcagttcttgg

SEQ ID NO: 93307 - DNA, 541 bp, Oryza sativa
atctctcatctctcgtctctctctatctctctcactttctcactcccccgccatccctccgtcgtcggtgactccctcgggcggcggcaccactgccatccctcctcactgccgctccccctcctcaccgccgtgaagtcctctctctctctctctcacacttgggcggcggcaggaggcggtgggcgacggtgggagcggcggcggcggcagctaggaggagcgggcggcgacatcaaggaggcagcgggcgatggcgagatggcgggagtagcggcggaagcaaggaggcgtagcggcggccgcgaggagggagcgggcgacggcagcaaggagccgcggtggcgacgccctacggcgagacggcgggagcggcggcggatcaggcggcgccgtcttcgggaagggcggatccgccaccctaggggtctcggcggggagcggcgggcacggcgaccggttacgggggaggatccggcggcgccgtcctcgggaaggccggatccgtcgcccttgggggtctcggcggcaagcggggggc

SEQ ID NO: 93308 - DNA, 1258 bp, Oryza sativa
atctagtcatacttagttgctgaaaccagaatatgacaggaaagcacatcttctggaaaagagatgttgtaaatagtatgaaagtctcagtagtcagtagtacataaagaggtttgatattcaaaccttcaactaagaataaaatcatgtttattgtatatcctactaatacacagtactacggtaccgagacttgaattgcagattttgagcattatgaaacagactacagaagtatagagtacttgcctttatgtatgaatataacagagacttgaactgcaattcttttcaatgcttttccttttgagaaaaacactactacttccaatcttggggacaaatgctgcaaatccataccagcaatcggaaaacttcagaaccattttgatttctgaatatcaaacagaacaggacaagtactaggataaccgaaatattcagttcagatcatcagaataacttcagaaacattctgaacatcacatcatccagtcaaaggcaatctgttcacaggatcaagatggacacagaaatttggggataaaacagattacttcgattgcaatttcagaataaccagcagttacattgcaaccatggaaactaagaatcaaagactacgacatgacaaagcgacgatctaataataacaccaactggtagaacatgacaagtccctatgaatcaagcaagaaccaaaggagggcggatcgcctaagcgcgctcaccgcggatccggcgcgcgagctggatgtccttgggcatgatggtgacgcgcttggcgtggatggcacacaggttggtgtcctcgaacagcccgacgaggtacgcctcggcggcctcctgcagcgcggcgacggcggagctctggaaccggaggtcggtcttgaagtcctgggcgatctcgcggacgaggcgctggaaggggagcttgcggatgagcagctccgtgctcttctggtacttgcggatctcacggagcgcgacggtgccgggcctgaagcggtggggcttcttcacgccgccggtggccggggccgacttgcgcgccgccttggtcgccagctgcttcctcggcgccttcccgccggtggacttgcgcgccgtctgcttcgtgcgggccatcgaggaggaggagaggagagcttggcgcggcggagaaggcgaggcggcggcggcgagtgatttctttggatttgagacttggcggtggtggattgagagggggggaattcgcggtgtttaaataggcgtg

SEQ ID NO: 93309 - DNA, 2261 bp, Oryza sativa
ctaaaaaagacagaatgtcaaataccttatattgcgcgacggactgatgtacagatgtagtatttgtttctatcttgcggtcgatccgttgatggctcatgaatcatttctctctctttttcgaaggacgggaatctgggttggtcactcacaaagatgaaggattgataccttaatgagatgcctggacgtctaggtatggagcactggaggctcttctctatgccattaggccatattgcccttacagcaggttaatgagataacaaggggtaggtgatcacggcatcacgccaaggataattggataaagcaacttgatttgattacaaggggtggaaaaatgtgctgcatatgcgagtgcctgtgcctgctaacacaaggcacacctgactgatgccgcatgcttccaaacactactccctccattttacaatataaatcattctagcattttccatagaatgacttacattgtgaaacgaaggaagtatttagtcttcaccttgtgatttccaagatctcttttgacacttgacatcgcagtagctacagcttccaaacactatttagtcttcaccttaagactcaacaatacagttacctaatggactaaaatttatcttcacacaaatataagaacagcacaggcgacaaagtattaagcaaaaaagggtacaactgtaattgatgggagctaaatcctattgattccaagactcacatttcgatgcattgagaggttgcttgcgtggtatcagccacatgtgaaaccgcttcaagcatcctcatcttattcttcactactcacaagtgccattcatctgaacctgactctgcatatggtcactggaaccatattggccaagtagcaggcctacaagggtaaccttgagtgatcgtttgcaactttgcataactggttccctttccatgtagtgtacaaagttttcattccgctcatgaaagacaggaagattgagggtcctcggagaaattcgctgcttccttcaaatccatttacatgacatatggttgatccatgaaggcccattcgaagatctgttcatactgtgaggcggcatggtcccatgtaaagtcgcttgacatgcctcgcttcattagaccctcccaagaggacttgtgttccctgtatgtcgaaattgccatccgcaatgcctgcaagaaacgatgcaaatttttagtacatactccaaaagttcatatggtgtaatgcttgtgccctgaaaataccattttcaatgaggcttttattactgattctacaatgttttctcaacaaagtttgtagctttccctaattattatcttgactacttgagtacaaggcaaaacaaaactgactagtactcacattaaattgtagacaagcaatgcaaatctttccttgtcaaatccatttttttatcagtttcatttgaagtgttcaatgacacaaaatgggccctgtttccctgtttccacattcgaagtatgtaccaaacatgcaattcaaatcatggactggtcagtcgagcaatttagcaacctaagcacatatatgcttcagggttctattccccactaattccagtttcccattaacccaccaagtgctgagccgctttcttctttggatttcaatcacgtgtgttccttttctttagtttgcttgtcaactctttcttataatatttacttaaatctgaaaactaacaagtactaggagttcaatcctactggaataccagacaataaccagaactggctggaacatacgtcatgagcctcaccttgttttatcctttttacttctggcaagaatcaaactacattatgattaccggcaagaaaaatagcagtatacgatacaaccaaaatgcatagttgaaatcatcatgctattgatgttaagagggccaatagtattgatgttgtatggcatatataatgggattaaggaatggatagaagaactaaaactaggtgcaggttcaacataaacttacccacagcattttttcaatggttagtggcgagaatgcccacctgcaatatgtcccaagtagcaacagttaaattaattggttataaattgaataatatacaaaaaaaaattgaatttaattaattccactaaaataaaataaatctgcaattttactttaatgaagcattccttaccctgtaccctgctctcctttctcagcaaacgggttaaaattctccactgtatcctgttgaataaataaaaaaaagtg

SEQ ID NO: 93310 - DNA, 1191 bp, Oryza sativa
tctagtctcacgcagaaaaagaaaacagaacttacgaattgaatattgtcccgcatgagatctggaatggcaagtttaattagatcaatgcctttttgatagtccaatcttccaataaagccaatctgtaaataaagctaataaatccaactgcccataaaagaatactaaaataaataatttcataaatatttgtatctaaccagaggcacatcgggccttataggtaaacccagctccttctgcaattcagctttacacttggcctaaacatgaattcgaggtttcataaattagtctgtgaaagaaacgacgaggtgcaaagaaaaaaatgaaacgagatgacaatctgtatatacatggtactatacttcacctttccggacaggtcatcaacagaataatgataagggagaaacttgtctgtggatgggttccaatcattaatgtcaattccatttacaattcctacatatccagggaatagattgaattaatttgtatcatccaccctattacaatgatcagtccaagaacaaaatataaaaacccaaatataggtaccattcaatacactcttccgggagcttaagagctcattgaggccttgcccaccttcagcagttgtgacctcccatgaatacccctggtaatgaaacataaatgattccttaattgagtgcaagacaaaatgaacgaagaatttgcggtttaaaagccaaggcataaaaatagactaggatgggaaaaaaaaatcaactctaaggttaagttcaaatttcaaattttgactgtggccgtaagccaactagtagacgaaaaggaaggaatctcacctggctgacagtcacaattcgatctgctgtcacaactgcgccttttaaaaaattgactgcctcacccttgtcaagggcatgccgccttgcccactctggaaacacccattctaatgctccataccattcaggtggcaatcccaggtcaggatatgtactggcaggctccacaccctatcacattgaaacacaatgaaatactaacatactgcacttacaaagtgccattacaaaactacttaaaagatatgcaaaatgataggctcaaacctgatgtgctagattatgtatgacaagaacactgcgggcatccctgtaaacaccatatggtctatattttgcagcaagaaggctg

SEQ ID NO: 93311 - DNA, 1686 bp, Oryza sativa
tcccggtgaatcccaatgagttctcgctgatgtcttcgctcgcggaactggccacggcgatggaggagatgtcacgcccgaaatttctatccaaaattccaaacgcttacatgtgtgtgaaccctcgtccaggaatcagccgaggcacacaataacaaattgataatagagtacaattattactctaattaataagtgaataaaatgtcattacagaggtagatagttcctctcaatcaataaagatctaagcagcggaaaataagataaacggcgcagacggctccactccacaggcagcttgaccagggctacacctaatcctccacaccatcagcatcattgtagaactcttcctctgatgaatgattgcaaggtgagtatatgacatactcagcaagccacgcagcaaatatgcaagtgcacaggataccaaaggatggcatagtagggtttcatttgcataaacagcatttaataaacatttcagaatttaataaaacggttaagtaataattaaacaatattaatccaacgctatacaacataccctattgtataggccctaccattctgaacaaccatacccggctgtacagatctatctccaaaccaggaatataccattccaaaccaggagctaatcaaattattaccagttatacatcttttatcatgatgagaggtgtgagactaatcacgaaagacattgttaggcgtgcccataaccgcgggcatggctattcgaatagttttactatggccagaggtgtaccactgtacccacaagacacagccccacaacatgtcaccatgtgcctcaataccaccacggtacctcggaaaggagttgtgacaataccccttgcacaacacaatccaccacagcgcacctttcctggatcataatcacccccttataaacaaggcatggactccccagcgacccccgtgggcttatctccgccacttctcagtctggtgctccgcaatgaaccaagctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattgtcgcgaccgagaaaattgcattttcccgaacgctagtgtattaatccccgtcccaggaaaagccgaggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtgtaagccaagactccacctaagacatcttctccaaagcttctcttactgaaggggggagaaagatagagcaagaatgagtacaaccacagtactcagcaagccacaccggcggatgcacgattaatgcaaggggtacaaggggtaatgatataggggttaagttttgcagaaaacagcatttaaaagtcacttagttgcccaaagccattttaaaaagacgatcctagagctacacagtattattaatcaaggtcgttaacccgcacgaacttgccttaacccaaggcctacgatgattca

SEQ ID NO: 93312 - DNA, 918 bp, Oryza sativa
ttgtaagagcttggtaaggtgctccatttggctgagttgttgaggggcaccactacaccgcgtagcagattattagggataaccttcattatttgttgttgtttttgtgttggcaatgacagatatgagtggcgctcaaaatcagcgataccaacaaggtgcacgtgatgacagtactttggtgcaacgagtgctaagttctcaaatggaaaaagcggagcaatggcagtatcacgaattatttgaaacaaagtttgtggttaaggatagagcatatcgtactataatcgataatgagagttgcaataacttggtgagttcagatttggttgagaaacttgagttgcctacacaaccgcatcatcatccatattacatcaaatggttcaactcttgtggtaagttcaaggtaaatagaattgtgagaataaacttttcgattgaaaattaccatgatactgccagttttgatcttgtccctatgcaagcatattctttgttgtttggtcaaccatgggtatatgataataatggtttgcataattttgttgctaatacatacacatttagacataacggttgaaaaatgaaattggaaccaatgagtttttctgaaattttcgaagataatcttgaaaggatgaagaatggaatcaaagaaattttcaaagatagtattgaaaggacgaagaatagaatcgatgagattttcagagataccaggaataatactaatattgtgatgccttcaactaagtctgagttgttacaaaatgaacgtaatgttgtgcctattgttttggatactaatattttgtaggcatctgagaacaaccaagttagtaaggaggaagagaagaaagatggagaggaaaaagatctatctatagctacatgcatgcgggaagaatgttcaat

SEQ ID NO: 93313 - DNA, 1103 bp, Oryza sativa
attcaatatgttcaaagatgatgtgacttgccttgctcgctttcccaaacgccggcttcaacttccacgaagagcggatcctccgaagctgcagcgtctgcacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatggatttattgcgtcagccgaggggaggggcgcgcggaccgggtccacgggggtggggcccacgcggcagccccacagtccacggtggaccgggcgcacccgggctcacaccggccggcgccgtgggtcccacgcgtcagccgcacccgagggcgcgggcggctgacggccgggccccacatggcagccgcggggcgcgcccgaaggcggccacgccggcacggccgacgggaggcggcgcacccgcgccccgatggtcgcggcccgcgaccaacagcgcggcggagcggcgcccgatacagaatagggaaggggcaagcgaaaggagcggtccacggctcaccccgggtcaacgaggacggcggaaacgacgaccgaagcggaggaaggcgtcggcgcggttcggatcgacgaggacggcggcgctccgacagtcggcgggctaaacgaaggggtggccgaggtcgacggggacgcggcgaagccgaaggaggtgacgccgagtcgggaggaggtccagagcgactacggcggcgaaccggagctcggcggcgacggcggagagagaggaagacggcgcgggcacgaatccgacggggaggagaggcggcgagtggcggaaacggtggaggagagcacgggggtggcttaaatagggttgggagtgagggaaggcggccggaggagatggaaaccggcgcggaggatccggccgccattgatggcgccggcgaggtttgcgggagtgaatccggacgaatccgagggagagagagagggaaaaacggg

SEQ ID NO: 93314 - DNA, 903 bp, Oryza sativa
agcagccagttaccaacaggcccttcgccgatatcacgagaagcgcatcagagcacgcacactttcgattagtgactacgtcctctgacgggttcaaagccaggcagggcgtaacaagctctcacccaaatgggaaggaccgtacacaatcacgcaagtcttgcggccgggtgcatttaagattgcagacggtgatggccgcgagttagcaaattcttaggaacattgatcaattacgtaaattctatgtataaatcaatagtatccatacttgtaagacatcttatagcttcaataagatttatttttaggtaaagattacaatcaaagtgttccttcccgacgatccctcaccacgataacacctagcattgaaacctaacctcatgtccctttacgccgtcttgacaaggcctccgaggaacctaagggaacttcggctggggacactcagagccgataaggccttgtcggatcatgaagggacaaaagaccatgtaagatcaggtcgtgtaagagttcttgccgcgcgtattaaccaagccgtgtaatcggaaattgggttttccaacttcactgctgggggctaggatcagtgcttgttcaaccaaggcaggtcaaaggttcaagagccttatcttcctagaaaaattctccgatgataaggctgggggctagggagagtgtatgactcaagtgactgatcgaagtcacgaagtgagaaaacactcatacacaacgcatctagagtaagaaaacttagttagatagatttcttttctatttcacaactacttcttacagttcgtaaatattccaaaatatattacatgtctccctgagatatttgtcacaggatataaagactaccaggaaggccaacgccagtccatggactggaag

SEQ ID NO: 93315 - DNA, 773 bp, Oryza sativa
ctgcgattgcggggataagtagcgtgttcgtttagaacccggatcgagttgtgtcgtgactccacccaaatcgattgtttatcaatacctatcggaagatcgggacctaccatcccccatcagaagggaacaatcactgttcaagggaacgcaaagctgtcagtgcaatgcgacaagcagagcctcgacatggtcgagcacacgcccagcccacccgccacagatgagccacccaggaaagtgagcaaaacgaacaagacgccgaaaccagacggcgcaatcaagatcgttccgctctccagtgccaaccccgacaaggccgtcaagatcggggcatcactgggcgagaaataggaactcgcgctcatcaccttcctccgtgacagtgcatatgtgttcacttggcagccgtccgacatgccgggggtccctagggaggtgattgagcacaaactcatggtgcgacccgatgccaagccagtaaaacaaaaactgcagagatttgcaccagatcgaaaacaggccatacgagaagagctcgacaagcttctcaaagctactccatccagagtggctagccaacctagtcatggtgcagaaggccaataggaagtggaggatgtgcgtcgacttcaccgacttcaacaaggcgtgtcccaaggatcacttccctcttcctcgaatagaccaactggtcgactcaacagctggttgtgagttgttaagttttcttgacgcttactccggttaccaccaaatcagcatggcgaaag

SEQ ID NO: 93316 - DNA, 868 bp, Oryza sativa
aggtttacaatcttgcatacaactcggcgcagaatgtcattggcatactttgcctgagttaaaattattccactgatcacttttgctcacttctattccaagaaagtaatgtaaatcacccaagtcctttaaagaaaaagctttggtaagatcctgccgaaaagcagaagttgccctagccatagaactagcaacatttatctcatctacatagattagcacaaacatggtgacatttcccttattatagagaaacagtgaagcatctgccttggatgatttaaaacctagctcatgaaattttgtactcaaccttgaataccaagcccttggtgcctgtttcagaccatataatgctttatcaagtttgcacacataatttggtaccttttcactttcgtacccaggtggttgtctcatataaacctcctcttcaagaactccatgcaagagggcattctgtacatctagctatcgaagactccatcctctagatacagcaatagacaaaattgttctaatagtagcagctttaacaataggactaaaggtgtcctcgtagtctatgccatacctttgcttgaaacctttagctacaagtctggccttgtatctatctaggctcccatctgctttcctctttatcttgtatacccacttgcagtcgatcacgcttcttcccttttctagtggtaccaagtgccatgtctcatttttcatgagtgcatcatactctgcatccatagcatctttccaatttttattagtaaaagcttcatgtaaattttgtggctcacctgaggcagtgaagcaacccccatttgattttgccatcagtctatactttctccttgcatatttcgctctg

SEQ ID NO: 93317 - DNA, 1374 bp, Oryza sativa
aagcaaaaatgcttcagttcggactctagccaagagtgcaacttcagtagcttccactggatgtacccgtgatattacatgtcataggtgacatggcattggatacattgcccgcgactgtccaaatcggcgagctctatttgtgaatggtgatggtgagtatacttctgctagtgattgtgatgatgaatatgctttagctgccattgaccatgcaggaggacaagataacgataacatcgaggaagtccatttgcatccagagtcgctagatcagtatcctagcctaattgtcaagctagcacttagtgctaaagagaagtgtgaagagcaaaaccaacatcacaatttgttccaaagcaaagttcttgtgaaaggccatactgtcaaagtgattattgatagcgggagctgcaacaatttagcaagtgaatagatggtcaagaagcttggcttgactacccatccacatccacatccgtatcatattcaatggtttaatacatatggtaagatgaaggtaacccgtttggttaaaatacctttttctatgggctcctatcatgatcaaattgaatgtgatgttgtgcatatgcaagcttgttcctattcttttgggccgaccatggcaatatgatagagaagttgttttcaatggtaggaccaatatatatatatatttatattcgatggtaaaagaattgttttgcattgtatgactcctgccgctgtcgacggggaatacccgtagaccggatatagagggtattggggtacgctggtatgaggatttacgtagtacgacatcaagcaaacaaaagacagggattataccggttcaggcctcttaataggtaatagccctaatccagttgatatgggattatatgacggaaatcacagattacaaagggaatagtggaactcgataataccgacgagatcgtagttgagttggttcgactagatcacccggtgactcggctcctgtaggctctggcttcgtaagctgtgatggatgtgttggcggtaagattcgatgccttaagtcctcccggggggttgttaacaaccaatttggtaacatcagcgttgggaaagaagattaggtcaaagcaaagtcggaagcggagatcgagtttgaaaacagagcaggaatcggctggagtccagatcggctacgataagatcggctgggtctgagtcgggctaggtaagctgatgtagccgataccgacaatatgacttgtacgcgatatcgggttcaagttaatgtacttcaagatgattgccgcgcacggatagagtcctgggaaggcaattgtatctattaattaggatatcttatgtaaattccttatagataaatgtggg

SEQ ID NO: 93318 - DNA, 644 bp, Oryza sativa
tcacgctacatacttgcccaccaaaatctttccttgagatccagggacatcttggtcctaccagggtgaatggagtatagagtatcatgggcctcgttcagaactacatcttttaaatctttgttgtggaggatgcagattctttcgcccaaccagtcagtcacgtgctcatcttccaagaaacagacagctcttcctcttctcatattcttcttggtttcttgaatatcaggatcattaatttgggcttctctaacttgatcaataagagtgggcttcgcttctaaggctgcaacgaaacatctactgacaattcccaaatttaatctttcaaagtccttacataattccaatggcaactgtcgtcctttcgtagcattgcaatagcctttcgtgctaagagcgtctgctacagcattagcctttcccgggtgataatgaattcccatgtcataatccttaattaattccaaccatctccgttgtctcatgttcaggtccggctgagtaaaaatatactttaaactcttgtgatcggtgtacacctctgtacgagtaccgaaaagataatgacgtcaaattttcaacgcatgaaccactgcagctaactcaagatcatgagtagggtagttcttctcatgcgg

SEQ ID NO: 93319 - DNA, 523 bp, Oryza sativa
agaaagttaaagctgccagtagtgaatttacctcctttgcatctctatggtggaatgatatatgtggtagaggacttagacctagagcatgggatgatatgaaacgtacaatgaggtctagatttgttccttcttactatgctcatgacatgttaaatcaactgcaacttttaagacaaggttgctttgtcaagagatgatgattgctttgtcacgatgtgatttgcaagaaactgaggatgctagaatttctaggttctatggaggtcttaatagagagattcgggatattattgaatataaagaatacaataccatgaatagattattccattttgcttgcaaagctaaaagagaagtgcagggatgcaacaagcataggagttcttttacaggtgctacttccacacgacagtcaacaccacgtcaatctactactggcattcatccacctacctccacgccatcccatgttcaagaaacaagcaaaaatgcttcagttcggactctagccaagagtgca

SEQ ID NO: 93320 - DNA, 2188 bp, Oryza sativa
gagatgcggccatgaacttcgcgagagcagttcttccgatgatagcattgtatgctgtatcaaattcagcaacatcaaaggtgatctgctctgttcggaagttatttgcttggccgaaagtcacaggcaacataatcttgcccaatggcttggacgatgattgaggagtaattgcatggaagggttgattaatgggcgtcaactcgcttcgtgggattcccatagtgtccaaggtgcaggcgaagagaaggttgatggagctgcccccatcgataagaacccgtgcgaccttggtattctaaatagtgggctcgaccacaatcggatatcgtcctggcgtgacagcagtcttggggtggtcttcatctgagaactcgatcttctgttctaaccacttcatcttggtcgcagccctctgccatgtcgaacaaacttcacgctccattttcttgtactctctctttgaggagtaccccatggaacctccgaagatttgcgagacatggagatcggaatcaggttatgctgagtccaagtcctgagtagctgcctcagcggccttctcgactacacgtactcgtttgcccttctccaatgccagttgctttgcgagcgactttttgaagacgaagcaatcttccaaagagtgtctgtctgacttgtgtatggggcaccatattttcttcgtgtcgttgccttgtgggtcagggtgcttgggagggtccacgtactctgccgcgaggacttccgtttgagctttcgttttcccactcttgtgactcttcttcttgcttgattcaggtgcgtctttggtggtttcttctctcctcccgtcttcggctttgttgttcttgcgtcttagtgcgtcgtccgcgtgagcgcatcaatcgacaatctcgaatagttttcgagcagtcctgatcctccttgtcgccaactcttgggtggtatagcgatctctgaccccagtcttgaaagcgtagatcacggaagcattggtgatctcggggatagtatttctgcactcattaaagcgtcgaacgtagtccctcaatgatttgcccggattctgtgtcaacgcgtgtaggtcgtcttcgatcgcatggcgcttgtaagttccttggaagttagcaacgaactgctgccacagatctgcccatgaagaaatcgagtatggccggaggtgaacaagccatgaacgtgcagatcctttcaacgccactggcaaataattcgctaacgcgttgtcgtccgctccggcagtgtagagtactctggaatagacctgaaggaattcttctaggtcggtgctccaatcatacttctctattgctcccggtcggaatctctcaggccaccggacatcacgtagagcacggttgaaagctttacatctgccgctgggggtggtgggttgtcgatgatcgtatgtcctccgtggatttctgtctgacaatgaggatgatgaggatgatgacgatgacgatgagtcacttggttccggtgtacgattacgaggatgacgtccgggttctcgagaatcctgtcgtcgcctcccgttgatgtcccggcgacgatctccatcgtcatcatcgttatggcggcgtcctcgaccagtatcgcctggcatccgctgttcgcgatcatcatgttcgtggcggctgtggcggttatcacggtctcggttttcgcttgggtgtcctcctcgctcctcgttctcgcgacgtcgtgatgagacgcgatgtcaggaatggttttcattgtctcgcgcgtgtcgtacttctcggcggccattaagatggtcacaaagatcgccggtgccgcgaggtggaggggtgtcttgtcgaggtgatgtccgctgctcaggtggttcaccatttgcaccgctagctggcggttgttctggtttgctccggcagtggcctcctcgaacgcattactgagattggccactgattcccgtagtcattctgtccaccgtgtgaggtcatcgttcagaatgggatcataaggggtttccctcagtattgcgttgatggccccgatgtgctgggccggtgtaaccacttgattctccacttccgcgtcagcacgcgcagacgtgctggtcccgccgatagcaaacacatcgcgtggtgtgcttgtcgacgatgagccctgctgtcacaccctgaagttctttcccaag

SEQ ID NO: 93321 - DNA, 1174 bp, Oryza sativa
  unsure (1)..(1174): unsure at all n locations
cttcgccgcttgcgccctaactccttgtttcctgtgccctaccttcgccacacgcgctcgctctcaaacatctcttcctccggcgtcatggcacggggctccgctttgctcgatggtagcgtgctgccgccttcccgcatcgtgagcgagaggcaggccgggctgccgcgccgcttcatgccggaatctgccaccggccgggagatagtcacgctgggcgagggacgcccggcgccacactacccggggcggtccgtcttcttcctcccttttgcaatggcagggctggttccgccattttcttctttcttcatggatgttcaggagttttacgatctccaggtggcgcacctcacccccaacgcagtaatgacattggccatcttcgcgcacctgtgcgagatgttcatcggggtgcgcccatcccttcggctgttccgatggttcttcaccgtacagtcggtgtcgccgccgtcggtggttggtggctgttacttccagccgcggnggccggtgctgaaccgctacattccctgcgtcctccgcaagaagtgggatgactggaagagcgactggttctacacccccctcgccgacgaagcgcgcctncgacttncgagccagcccccggcgcaggcctncagctgggcggcgccgtagatctgggagatggctatgacgccgtnctcgaccgctggcgggcctgcgatcccaggggctcacaggggccatggtgtacggcgactaccttcgtcgccggattgcgccgctccagcggcgcgcccggggcgcctgggagtacaccgggtccgaagactatatgaggacccatcagggagtcagatgggactgggctcctgaggatttcaagatagtggtccaacgggtgctgaatctcagctccgtggaggcatccctcattccccaaggagtcctccccctctgcagcgatccagatcgcgcctccatcctgaccatcatgcaggcggtcggggcgtcgaagaagcgggctcctcgaagccacgatggcgcgggcggaagccgcaggggggaacaatctaccccgggagggggtcgtgcttctgggccccgcgacgggggcccggggagcagccgccctgccgacgcccgggggaagagaaagcaggaaggaacccctcccccatctcctccc

SEQ ID NO: 93322 - DNA, 732 bp, Oryza sativa
cacttagtgatttcaaaatgatttcaaacaaaagatttgcaaaacaaccttgcctctcttccaagcttgcattaaacacctaaattcccgtgacttgctgagtacgaaagtactcacccttgctctatataaatatatatatatagttcctccgccctgaagagaagataaagtgaagtgaagattagggtttcgtcctggttcccagccgtcgcctgtggtgttgggtgttagaccgttggttccgctgctgctgctgctgctgttggtgtttcctcatccgcgtcgtcggttgtattctcgggctgtctgagctgcaacctaagttaaggtaaataagtcctctatttattttaaggattgctatgattcatatttgtcaccgtgggtaccagcactatgtcctgggactggtaccgagatcgcggtttcgtaggaagcggttcgcgccattttccctacgacacgctcctgtcaggtgccgttgtacggcggtatcagattggggtgtgacagtacctgattaagaatgataaaattaccctttaacataagtaaatcgcaagaagaaatctgagaagaaaaccaaaataattaaaagtagtatatgtgtattacacagaccatatacagaggaacatatcacggataaaaaaaaacatttcgttaatctggatatcaacactgcacggacctaaaattaagttgctactcctctttttcacgaatgta

SEQ ID NO: 93323 - DNA, 543 bp, Oryza sativa
tctgctttccggcttgtgcaggttcgggcttggttgccatgaagccttccagatgtgtcgccgcgggatcctgtgccgatcctccaatgatggcccctcttgtggagccagctggagcagccgccggtgctgcttggctggaggccaccagcgccgacgtcccgacctgagacgtaccgagcccgccaccgttggccggtgcagccacctgggccttctggcttttgctgacctgctggaagagcacagccccagcctccctggtctggttgccagccgcagccggctgggtaggctgctggccagccagaggtgcctggaagggcgcctgggcgggctgttggtcagccagccccgctgtctggaagccagccggctggaactgaccagcagcggcctgctgctgcagttggccgaccaccgcctggccaccggcttggtgtccaggaacgccacctccggcgtggaactgaccggccgcgtggccagcagccggcgcgaagcggcgcccaccctgccaaccgcggcggttccggttgcctc

SEQ ID NO: 93324 - DNA, 537 bp, Oryza sativa
gcacgagcaccaacgaagatgatgaaggctcgtgtgcagatcatccatgctcttgttctcactccaactgctgcgctcggtggtctttcatgggtgccttgtcactagtccttccttgcttgctttgctaccttccagctactggctgtgtcaaactctcccagaaatgctatgaccaagccagcaggcccgggtgccggtgcaaaaacacaaacagtgtcatgtgcaaagcgccagatgccgtcaacagaccagagaagccattctgattggccgaccataaggttgcgaactgtgttacaaggatgcatccaacactctgcaggaaattcatgcaaaaaataaaataaatgactgtaggcggataccatcacctaaggctttaatatagcattccttacttaattagggggatccagcaagacctggtgtcacactgaaggaaagaagtaaatgccttatgtgtgtagtagctgtgaactgtttctaacttctgtattttaagtgtcagagaagagtcatgttttagcacagtgg

SEQ ID NO: 93325 - DNA, 1307 bp, Oryza sativa
agaagcaatgaaaggggtcaagcatcttcttgttcgaaaaactattccaaatgggctggtcttcgttggggagctcccctatggacgaaatagtggttttagccctaaaatggatcacctggtatgcaactacttggaactctctctatttcttttataactaaaaataataattcgataatccttcaaatcttttctttttcccgggcattttttgaccccttttgtgatgtgcaccactttgtcttcattctgtaggtgtgttttcttcctggtacccttgctctgggtgcaacgaagggtataaccaagaaaaaagctcttgaaaatcatttattgactgcggaagacatagacaatctgcagcttgctgaagatttggccaaaacttgtgttgaaatgtactttgtgacatctactggacttgctcctgaaattgcttattttcacattgaggtaagtggttcagcattttatggagtattacaatgtactcctgaattaaatctccattacttgttatttttcatatatattgatgtccattttgattttgaagaaaatattggcatgtgcattttacagggtaattctgagggaggacctgatggtgggaacaaaagttctcaatatgttaatgatatcataatcaaacctctggatcgtcacaatcttttacgcccagagactgtagaatcactatttgttttatatagaatcacagaggatccgaagtaagatataacactactttattatctttaggtcacctgccactcaattttgaataatgttatgggttagggttcatagggggtaaacaccgccgggaggatagccaggcaataatgccaccactgactatccttttattatctccttttcttttacacaggtatagggaatggggttggcagatttttcaggcttttgagaagtatacaagagttgattctggtggctatacttcattggatgatgtcacaagcttgcccccacctaggagagacaaaatggaaactttcttccttggagaaacactgaaatacttgtatttgctgtttggtgaaagcaatattcttccattagataagtatgtattcaacacagaggcccatccacttccaatcattcagtctgcacaacagatctctcattcggtatagtttccaagtgttttagtgggtgtagttcctctactatcatgtgaaaagtgtactaccatgagaaaattttaccaaacagataaagtgagaaaatagttacgcagacaaaattattggacaatgagagaaacatactagcct

SEQ ID NO: 93326 - DNA, 1814 bp, Oryza sativa
aatgatactgttcagcactcacctcctgttttgcagccacaagatgaacctattgcacatcgcagaacaaagaggagttgtggagctccagtccgccttattgaggaatgtgatatggtttattatgcttttatttgtgctgaacaggtggagaatactcttgagctagccacatacactgaagttgttgtttctggagaccgtgagaagtggatctcagctatgcaggaggagatgcagtctcttgagaagaatgacacatgggagcttgtgcacttgccaaaacagaagaagcctgttcattgtaaatagatcttcaagagaaaggagggtttatctcctagcgaccctccgaggtttaaggcaagtttagtagcaaaaggttttagtcaaattgctggtgttgattataatgatgtgttctctctagttgtaaagcatagttcaattcgcacattcttcagtattgttgctatgcatgatcttgagcttgagcagttagatgtgaagacagcatttttacatggagagcttgaggaggagatatacatggaccagccagaagggttcatagtgcctggtaaggaggattatgtttgcaagttgaaaagatctttgtatggtttgaaacagtctcctcgtcaatggtataaaaggtttgattcatttatgttgtcacatggcttcaagagatctgaatttgatagctgtgtgtatattaaatttgttaatgtgtcacctatatacttgctgttatatgttgatgatatgctgattgctgccaagagcaaggaacaaatcactacattgaagaaacagttgagtagtgagtttgatatgaaggatcttgatgctgctaagaaaattctaggtatggaaatcactagagacagaaattccggttggttatttcttagtcagcaaagctacattaagaaggttcttcagcgttttaacatgcatgatacaaagcctgttagtactcatattgcacctcattttaaattatcagctttacaatgtgctagtactgatgaggatgtagaatacatgtctagagttccatattctagtgttgttggttctttgatgtatgccatggtttgctcccgtctagatttatctcatgctatgagtttggttagtagatacatggctaatcctggtaaagaacactggaaagctattcagtggattttcaggtacctcagagacacagctaatgcttgcttgaagtttggcaggactaataaggggcttattggatatgtggattctgattttgctgcagatttagataagagaaggtcactcacaggttatgtgtttaccattggtagttgtgctgtgagttggaaggcaacattgcggcatgttgttgcccagtctaccactgaagcagaatacatggctattgctgaagcatgtaaagaatcagtttggttgaaaggattgtttgctgagctttgtggagtttattcttgcattaacttgttttgtgacagtcaaagtgctatatgccttactaaagatcagatgtttcatgagaggacaaagcacattgatatcaagtaccattatgttcgcgatgtagtcgcgcaaggtaagctgaaggtatgcaagataagtactcatgataatcctgttgatatgatgacaaagcatgttcctgttgctaagtttgagctttgctcaagcttagttggtatagtggtttagcccaagaggctatttggcgccgaaagtgtttttgtctttgttgtgttcagggtaaaggatggatcgtgcacctggggacgcccgggggggtgccg

SEQ ID NO: 93327 - DNA, 1455 bp, Oryza sativa
ggggagagctccggcttttcttttccatctcgaccatgccgccggccgtggagatgacggccgtcgccatcgccattgtaccgtggtcgtcttctctcttctaccgttccatactctcctcatcatgccgatcatcttctattttgacaccacgtcatttcatccactgcagccacgggaacgcagagctcgccgacgatgctctggagcgcgcactggacgccgtcgtcgggttctcgtcgtcgttccgaccgaaccgagccaccccaagccgaactcttgcgccaccaggatagcctcgacgtcctcttcgaaagccctcaagaaccccagccagtgccgcaacgatgagggagatcggcgtcttcttcctcaggtccggccgccgaccaccgtcgtcgattccttgatcccgggtgagcttcggcgcaattcctcactcgtgtagcatctttagatggtctttgagccgttccactatatttcttggcagcccggagtccggattgtggttgtcaccgttgccatgccgatttccgccgccgcggggatatcctctgcatcatcgtcactatccaggcctacccgtacctcgtccgagattcggtgagcaccctgcagcctatagaacatacatgcatgcatccctttgggtacatccagtctatagcacaacatgtctacccatgccaaaacatcctccgctcggactcgccgcggcgttactccgatgtcctctaaccgagaaaagtaaaggaatggaatcgcaataacatgatcttcattttgtatttttttcgcacccccaaacgagtcatcgtttgtcaccggcgagctcgagaacgagctcggccatggcttagctctgtgtcagctcaaaccaaggacctctgttgagaagaatcaaagctctaggtactagtttgtaaaacctacctcacacacagaacagtcatagaactgcgggttgatttcctgaaactctaggagcctttttgcatattggcctgaaactgacctgtggaccgaatctatttaaattctggaaaaatctaaatgaaatgcctaaagctttatattttcatcagaaaaacatgtaaatttgtaaaatccttaaaaaattggaaacaactcattttagagtaatacaaattactgttaactcatcgaatcatgaactttagtgttattgcataaaaacttgcactcacagtacaaatgtagcctctaaaatttatctaagataaatcatacataaagcatatacaaacttataaaatgcataaaaaattcatttcaactcattttatagcaaacttagtttctacagatccaccaacatgttctctaaaaataaagtaaaataaaacatataaacactttacatcaaatgcctctaaaactattgtctttaaaataactagttttgcatgaactgaactttagaagtttata

SEQ ID NO: 93328 - DNA, 910 bp, Oryza sativa
atcacttgtgggtgatgagaccgtcacacactgcccacgctagtccctgggtgccgtcacggatcttgtcgcggagagcggacaggtcggtgtccatcgcgacttcctggcgcagatcggttaacacttggaaggacggcacagatatcgcactgagcgaagccgtggcgtcttcctgatcacgatgtgagagcgcgtctgccaccacgttcacccgccctggcctgaactccactgtaaaatcaaaccccattagcttgcttacccaatgatgttgcgggatggtgaagaggtgttggtcgagcaggaacttgaggctgtaggagttcgtccatacagtgaacgtgcgtccccacaaatatgcccgccaatggtgcaccgcctgcacgagaccgatgagctcgcgctcgtacacggcgagccctgcatgtcacggcgccagcggccggctgaagaacgcgagcggcccgacgccctggtgcaggatggcgccgatgccggagcccgaggtgtcgcactcgacaatgaatgccttggcgaagtccggcagctggagcacgggtgcagacgacaacgctgtcttgagtgcgacgaaagccgcgtcggccgctggtcaccagcggaatgcctcacgcttaagccgcgccatagtcacgtttgaacttgcagtagtagccggcgagaccgaggaagccacggaccgcacgcaccgagcgcggcggaggccagttttccaccgcctggatcttctgttcatccatcgccactccctcagcagacacgacatggcccaggtagtgcacggtgcgttcgccaaatcgacacttggagcgcttgagcaccagcttgttgtcgcggacgacgtgaaggacggcgcggatatgttgcagatgctccgaccacgttgagc

SEQ ID NO: 93329 - DNA, 633 bp, Oryza sativa
gtacacacatttatctatcacgcatgcatgtatacctatatatatcttgtatgtatatacctgtaactataccttgctatacggtgcacggctgcacgctcacacacatacatattgctggtacacacatattattagtacatacagtatatgataatatagctagccaatctataataactaataatctctcaacaaatctcactcacatcgatcacacaagaagccaaaggcaatgcaaaagccatgatgcatatgcataaaaatggagtatagctaaattaacccaccaccctctgtcatcacactcgcgcatcggcgcatgcatgtatgtatctatgtatgtatgtatgtatgtatgtatgtatcagtacttccagatggtagcgtccatgttgcatgccaccgacgagatgtcggcggcgttgttctggtcggcagcatcctgcggcgacaccaccagcgacgacggctcgctcaccacgaagcctccggcggccatgtccatctgctgctgctgctgctgctgctgctgctggtagtacatcgacgggttcccaacaaactgctgggcgccgccgttgatctgaagcgggaagccaggtagagtggagtaggaaggcggaggcggag

SEQ ID NO: 93330 - DNA, 1922 bp, Oryza sativa
gtccctttgatccactcctatgaataaatggcagtttttttttttcttattgttatttagttcttgacatttccttgtccctcgttttcagctgatttcagcgattgataggcactgacactgtacagagcatccaataaaattcatatcagtgaagcagccaaatgttgtcaaattcaagataaaaccaggtatttcttactagatcatcatcgttagcaattatcatctagattctgaagttcttgcttgtatcttcatataattatcaaggacattgtgtaatattacattacgaaggccacatcatatgaataaaccaaaataatggttaacatgttgtgtaacatataggcgtactatatggctgagtgtagaataagtaactttcgagtttgatctattttttgttggtcatgtaaatcaaaatatccttggtttaaacttttcaggttcagattctggtgcttctgacagcagggcaaaaagaatttcttccttcttgtttcacccatttttccctctcgcactttctattcagcagacatatatgcagccaactgttgtcaatttacatttcaggagatagaaagatattgccgttccctcaattgtatttgtaacagttatgagcggtgcacagctcagtaaaaattttgcccgcctgtagtaggatgttttatcggcaaagatcttattataggcaaaggaaaaatgtggttttaggttctccctttgattatgctggaatgtacattttgtaggaatatggctgtctgaaggcaaatgtggttcatctaaaaaaaaggaaggtaaaatagagtgaacaaaatgagcttttattttgaattcattacgctgtctttccctcctgatccccaagtctttcccaggggcctagctcaatttgtcactgtacatagatcgtccatcttgcaacatggcttgtaggggtggcaatttccctgttggggtcagggacgggcgggggagaattctcacccacgtgtgagtggggacaaggccctgcaaaatttcggggatggggcagggatcggaattaacttgctggtgacctggaggggctcttgatgtgagttacttttctaaaaagctacccattgcaataatatagacccaacaatctcattcaaaattgacatataaaaactcaacgccttagttcccctcaactgtaatctttttcgttccatcaaccaatccacactgtcgggggctattgaaattttatcatactattattcaatgtattgcaatatttttatggagcgttaactccatccaggtaatgcggggccccggtcacccgccgggtcccctgtggaggcggggatgggtgatgtttttcacccgacttccattccggggccaggggcaggggcattccaagtttccaacccaacccagccccctgttgctacccctaatggcttgaaagtgttactattaaattagttagttggtttgatgcgatcatgatcattgactcagagataaacatcagtagttgtttatctaaggggtgtggactctggattatgggcttctgcagttaaccatttatttagtccaggaaaccccagcccttgacgatagatccgtctgtgttgagtgagtacttttgttaggtgggctcaaaggagagtaattatataagacttccagggatgtgataaaggacatcgaatgagcattatgaactatcaaactatccccaaactcgtctctctactgcttcttcctctcgagtttttttcctgttcttccacccctaaactcttgatttcttctctcaagctcccaatctagcttggcgtgacaccggcatatcgtgggttcttgacacttggatagcttgatggagttggaccatctatcaattatgatgatagtagtgaacc

SEQ ID NO: 93331 - DNA, 688 bp, Oryza sativa
cgtgacccgaaggtacacaaaatcatccactggaatttcagatcacggcgacggttatctgcataacttttctgccgagactgtgccacctttagattatcccgaatgattctgactttagcttcagcttctctcaggatatcagtcccgaacacttggctttctccaacttggtcccacaatagcggtgttcggcatttgcgcccgtacaacgcttcataaggtgccatttgtatgctggcttgatagctgttattgtaggagaactcggcataggggagactcttatcccaagtcttcccgaaatctagtacacatgcgcggagcagatcttctaggatctgatttagacgctcggtctgtccatctgtctgcgggtgataggcggtgctaaaattcaatcgagtacccagctcttcttggagcttcttccaaaagtgagaggtgaattggcttcccctatcagatacgattttcttgggaataccatggagactcacgatcctagcgaagtagagctccgctagtttgttccctccataagtggtcttcacaggaatgaatcgagctaccttggttaatcgatccacgactacccatatagaatcatatccaccttgggtttttggaaggccggtgatgaaatccatcccaatttctcccatttccattccggcacttggagagg

SEQ ID NO: 93332 - DNA, 1384 bp, Oryza sativa
cggagggagcggctggccgggtcagccgatccggtcgtgccgaggtggctccgacgtggcgcctacgtggctgccacgcgggccggctggaggaagacgaaggcgccggcctcgaatggacggcgggcggcgacggtttctccgggacgccgtgcgacgacgaggggcgacggggcgtacaccgggatgacgagggagaacgagagggagcgagccaacggcttggattcgccggagggagtccgtcggcggcggattgcggcggcggcaaccggcggagagaaaagggggaaacggcgacgaggtcatgagggaccgattcccggcggtgagagcatctacgcggctacgggaacccaccccttgcgccggattaggaggaaacgcatcgagggaggccggcgacgagagacgcttccgagctcgggcggcgatggcggcgagcacacggcgagcgacggcagcagtcggggcgacgccagctagctactggggtactacacacgctactaaccgagtctaaggggaggagatggatcgaggagggagaatgggggaatgcactaccgagatgaggcggggcgctgtgacgagaggctgacggcatgggagcgatctctccggcctcgtgccggggaagaggaagaagagagcgcgcccggagtccccttcggtgtcctcgctcgtgccggctcctccgacacgcgcgacggcgaatggcgaccagagcatggaaggcggcgacaatgaagtggaggcgatgggacaaaacgagaggagaagggagagaagggcgcttgggctttataggatggcaacgtcggtttgggaaccgacctaggctgtcaagggagggagctagcgctcggcggtcgcggccaaagcggcgacaggggggaaatgacgccgacgggagagaaaagggaaaaaggaggagggaaaaggggcttgcccccttgccactttggggaagaagagagggcgacgcagcagagggggggagctctgcctctgtcccttggaagctagcgcgcggagtggcggggctgggttgtgacgacggcgatgacggcgggggtggtgtggagcggagcggcgacacggacggcaggcgcggacaggcacggcagaggctgacggcggcggcgaccaggcggtcggccaccacggcgcgcgcgcgcgcgggaagcaacgggcggcgcgacgatttgggcggcgtcggcgggaagcggcagcgagagtggagggcgctcggctcggcgcggctcacgcgcacgcgtgcgcagcgcacgggcagagcgggggagagggagagagagagagagagatggggagggagggggagatgggccgagaggaattcggcccatcgaacctaagggag

SEQ ID NO: 93333 - DNA, 684 bp, Oryza sativa
gggcccaaacccatagttttttaatactctatgtcggggcagcatcgatctactgagagtcgcagggagtgtggccaccggaggccctgttcattttctttttcagtggattgggtctaaccacgggaattttttatggggattcctaatgggtgagtctgtgccagcacgctcccccacgcaggttgctcgactaacggcgctcttagcactgtcaggattatggataccacatacctaatagtagttgactaaatctcggcaggacccaccacataccatgtcctatacggaagcaaccttcggatataagaggagttccggataaggaaagacaaccagagttctacatggaaacgacgaggactacttggattgtattcatattgggttccctagttcaacttggacaaggagatacctacgggtataaatacaagcccccctaggaggagaggggacacgagacaatcaacacccaacacaatcagcatagaagcctacatacgccaagacacgccgccggatatcgacttcagggataagcacggctagtaccctacggtgtctccggatactgtcaggagaaacgaaagcgccatctctgatctcgccgggcacggattcgaggagaaaggctaccctattgtcgactacgagtcagatcgtcagaccgccatgttg

SEQ ID NO: 93334 - DNA, 733 bp, Oryza sativa
ttcacaagcagtaggcaaacaaaactacgctaggaatcacctcacatccgcccatgaccgtgggcacggctgttcgaacagtttaataacctctgcagagggggtacactttacccacacgacattactaacccgaatcacccagcccgtgcagaacggccacgtctggtgacataaaggttttcatgacaaggcatttcgagagcagacacagggttgccatatgccgacgagaggggtcccagaccaacaacaggttaggtcccagaccatactgtgccaggaagcccgggggttctctccgacaccaccccgttgaatccacatgtctgtcagcatcaaggctcccccgcttagcaatttactcagccaggggtgtcccattccacccatgtggtcgcacttgtcttatgatcggatgaaattccaaggaaacggtccttaagtgcaagagcgggaaaccgtacacccggtacgttccccggtccgcgattttggaaattcatttagttcgcaagcaccgacccaggtgtcgggttttccaagtcttttgtaaaacccaagttttacccaagatgtttctcagattttaagtttgaaggcgaccgtcgatactcgtgcagagtgcacgattaccgaggcacaactaggtggttacaagggaacatgatataacaattagcaatagaaggatcagatgcaacaagttaggtaggcccaccggtctgccttg

SEQ ID NO: 93335 - DNA, 746 bp, Oryza sativa
gtccgcgggcgtggtacgccttgccgggcgcgcacggccagcgcgcgttgggcacgcagaagtctgacgtcgcgcccttcacctccttgtagcagtagccccacgagtagggcccacctgcagggacacatgcgcactcgtgcataagacatgtgtacgtacacgtgagttccaacgtgacaagtaaacgttactacgttaccagaggtcgcgtgggaagtctgggccaggaacgcggcgacctcacgcttgcgggtgtcggcgtcgcccgtgcaggcgaaggccgggaacgcgccggccgcggcgacgaaggcgcggtaggcgtagaacccgcgggcggggcacgccgcgtcgtcgcggtggggcagcatgcgctcgaactggtccgacgtcacgacggacgccacgccggcgcggccgccgcccggcgccgtgagcagcaccgcggcgacgtcgtcgtcgccgccgtcgcgggagacgcggcactggctctgacagccgcctttgcagtagtcgtcggtgagaccgcaccacccccacttgttgcagcagagcctgttggggcaccgggcgccgccggcctgcctgccgcactgctcggcgcgcgccgtcgccgcggcgtaggcgagggccagcacggccagcgccagggccttcatggccacctgcaggtttgcagcccttgctgcgatcatggcaagatgcttatttcttcaacaaaatcttgcttttcagtggtgtgttgg

SEQ ID NO: 93336 - DNA, 711 bp, Oryza sativa
aactttattagtgatggaatcttatttatttactttgcaggagatacgtacaggagatatattcctcagtcggattacttttcgcggggactttacacgtttgacataggctaaaatgaccttgctggtgaattctactggaaaacagaggaccaagttgctgcatccattccgactattttgttggaattcgaaactgggctgaaggtttgtatacacagtattttcattcttaagcttttgcagtgcatggaacctttttttttttcttcaatggtcttcagtagtttgtagaatatggttttcagtcttcaaaaaataatctgtttgccttggccaaaaaataatcagtttgccatttttccatactggtccaactatgtactgtttgattgggaaaggacctactctaaacgttttccttctttttcagaaattatatgagcaaggtgccaggaaattctggattcacaacacaggtcctcttggctgcttacctcaaaacgtagcttttttcggcaaagaccgatcccagctggatgaacttcgttgtgtagcaaagcataatcgtgttgcaaagcttttcaacttacagctgcatgcactttgcacaaagttaagaggtgaattcgctggggctagtatcacttatgttgacatctacaccatcaagtacagcctgatcgctaattattcgcgctatggtatgca

SEQ ID NO: 93337 - DNA, 1562 bp, Oryza sativa
gtttatgctgttttgtgtattggaaatttggttgcaatggcgtgggttggattgtgattgggtggatgggattctggagccggataaggcgaggggcaagcgtgaacagccatgtctggtcgccatactacaagggcagaactgcacaagggtttctgcctccaggacggtcgctctgctccctcttactcttctctaaccagacgtatatttgtccttttatattgctagtaaattacccatggcataggataaaaaaataaacctctttgccgtgtttttagtagtagttatgtttatttttccggatttgctataaaccttttttcggatcagctgtatggcaaaacattggttcaatacccaaatccattaccgcatacaattccaccgatacaaatttgatggactataacatctggcatatctcttctctatctctatctctactattataaaaattaaatatgtttttaccgatactttgttacgtcatccatgtatgagtcaacttttaagttcgttcgcttttagaaatacaaatctgtatttgagtcgggttttaaattcgttcggttttgaaaatacagaaggagatgtataagaactttctttaaaaaaactcacatgctaacttgagatgatcggactcataattatagctcatgattttctagaaaaatatatatctaaacgaatactacagtgaattttaccttaactaaaccgtaaaataataataataagattaaaataatcttcacccgttgcaacgtacagatatttttttctagttaataataaatgcaactactcccttcgtttcacaatgtaagtcattctaacattttccacattcatattgattttaataaatctagacatatatatctatatagattcattaacatcaatatgaatgtggtaaatgctagaatgacttacagtgttaaacggaggaagtatataagaaggtaaactcctgcgtattgacttagattggaatatgccgtgttggtgttgcattaaatcagccttttttatacatagtcatacagaagtacagagtatatatactgtgtacatcattcttaaaaggttaattgcatgttctaatattgtacatcatagtagtaggtcttgtccctctaaaatgtatcaactaaatctacaggatccatggagcccaactcatggcctccctgagggaagcactcactatttaggaccgctagtttccgaaggtccagcacgctccaccatagcatcataaagctgtcggccgttctgtgttgcaacacgccaacaccaaatcaaattccatatgatacaacaacaaagttagtaaaattagtggacttacaaaaatcacagggaagaaatgaatttgcccttcgggttttgtttgggtctccttgaaataaaccaagataggaaattgtggccaccacagttcccaattcacaaatgttgagtacctgtgggtgcattcaattatcaggcattactactgttaccatgatcaaagcgatttatcgagcaagatagcccgacctttggcg

SEQ ID NO: 93338 - DNA, 5281 bp, Oryza sativa
  unsure (1)..(5281): unsure at all n locations
ggcatggaattttgcaggcggcccccttgccgccctcggcgagggcgattttgtactgtgcggggggccgcctgcaaatggccggcgagggggcatggaattttgcagncggcccccttgccgccctccgcaagggcgattttgtactgtgctctatattttttataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgtgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgaaaatcctgctggacaaggaccatcagtttcgtacaggtatttaacagtattaataaaaagtaaagtaccgtgtgggcgagggatcgacgctccgtgagaggaagaggtggcgaacgcgcccgaagaggtggcgaacgcccctgcggagctcgtggaagcgccggtcgtgcctgcgaacgtgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccgaagctagggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccaactggaggtacgacgtccacggcgctgcgacaggagaagacgcgcatgaccgcgcgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcgtccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcatgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaaagacgactgataaacttataacgcagcgaagttgcactaaccccacgtcgacaccagtaagtccccatcgtgggaccgtcctctggccactgcgcgctgcgaccaaccccatagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgtagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctacaagagcggcaaggagtgaccgatctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttgaactaagcgaattactaacacatattaaacaagagtacaaacaaacaaaagtgtttactccgaacactcatcacgataacattatgatacaacaccgaataattcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgtctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgtcatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgtcataccgagatccatcggtgtcgaacaatagagaccacttctccttaggctcattctcaatccactgagtgaaatttttgatggacgaccctgacctccttctcattgttggtgggtcatcatgtaatgcaccaagaggtatgggaggctcgtcaccttcaactagtggactgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcac

SEQ ID NO: 93339 - DNA, 1790 bp, Oryza sativa
tggttgcatgttacatacatttgctacaatgcttttgttatgaatattgtgttatgcatcctttctcagttaatatgcttggaagaggttctccaaggttgaccatgcttttagcgaaagctgcacaaaagaagaactctctgaaaggtcgtcctacaaaaaagcatggaggttctccaataggtatgcaattatagaacatgtgaaattcatgtttgaaattattaaatgtagattatacatcaattcttatcttgtgtagaaaaaacaagagcctcttggaacccagccctagagaagattcttgttgagttattgcatgagcacaacactcctgagtataggggtcagaatggatggacttcagaagcttggaacaaaatcgtgaaggaattccatgagaaggacatatatgtctgcttaacaaagtcccaaatctaagaaaaggagaaagagctaaaaagagaatataggatgctgaaagaggctagaaaacaaagtggagcttcatggaataaccagagatgcatcattgaggctgagcctgctatatggaacaatataatcatcgtaagattatttctgaccattacttaattttgtagttaattacattatgcatcatttagtgttttccttttattgtgtagtcatttcctaaagccaagaagtttcgcaccaaatctttccctctatttgaggccttggagaactttacgatggttagttctatcacaagctataatccttgttttcaatatcacaagttataatcatgccttcttgcttaccctttcctgtactcaattttcttgtgtaggacatactgcagaaggaacctacaatttcacctcaattgagccattgcaacatccaatcattactcaaattgagagtgatcaagatgatctcggtaacactgagattatctttccagattatgaggacactttggcttatcaagtacaagatgatgcagatgcaactgaagatgataatgcaaatgctgaaaggcttaaagagatgccgcaaagaagggttgttgctgtaccaagaaacaaagaagaaaaagaacccaagaggcaaaaaaagagtgttggcgtagaaggacttatggaaaggtaccttgatatgaggaccaaacaaactgaagatgaggctgtacaattagcaagagaaaaggaggctcatttagcaagagaaaaggaaattaatgatttttcaatcaagaggtgcatatctgttctgaattcgatggatgtgacaaaggcaaaaaaggtcaaagcatataccgtcttcaagaatgcagagaacagagagatttttgtgagtgcttgtgatgaggatccagaatctgccttgagttggttaagaagtgagatggcttgataggtacggcttctcttccatataaatcttttttggtctgctaagcgagtaagatgggcttcactctgtcttgtgtgactctctgttgttagttacctgcatgttgtttagggctgtaaaccatatacttcatcctagcaacaataggtgcaagttatatactgtacccttcaattgatttccttgtctttgattcaccaagaactagttctacctgaagacaaagattggtactgtatgatagatatgcatgttttatggttctagattttttgagaactcatgttcaagtcttttctgcattggccatatatttatctgttatacatgatttctgcatcttctgaaaattcaatcatttcaagttttgtttccttttatctgtttgtgagataggaaag

SEQ ID NO: 93340 - DNA, 598 bp, Oryza sativa
ccttgagtacgactacgaaggacatgaaaagcaccgcacaaaacagtggaatctgtgtcgaaacgattgacacgagtggtgaaaataagtcgtattatgggaccatacaggaaatatgggaactggactatggcctgaatatccaaatcccagtgctccgttgtgaatgggttaaagacacaacaggggtttccgttgatgactacggggtaaccatagtcgatcacagtaaaacaggccacaaggatgatccatgggttttagcagagcgtgtggctcaagtgttttatgtgaaggacccttcggatgaaagaaaaactattgtcatatctggaaagcaacagatcgtcggcatcgacaacatcgaagaccccaatgattacaaccagttcgacgatgtaacattgtttactgatcttcctatgcgaattaagaaggttgagagtacaatcgataaagcgaatatgtcgtacgttcgagcagatggtgttgccaaggttatttagtcatagttattttgtaacctttagttgtcattgtgttccaaatgtacgtgcatgaatttaagtcccccttatgttgtactcattagcatgta

SEQ ID NO: 93341 - DNA, 2129 bp, Oryza sativa
  unsure (1)..(2129): unsure at all n locations
ccgctccccgccatcgtcacctacaggtcagaaccccggccctctcccgctcttgctaccctaccgtacgtcgtgctctctcaggcagctaccgcgcaccgcgcgctggactggtttgatacaggatttgcgtccatttagcgcgtgttcatatgcacagcttgcaagttgcaacgtttcgagtgtttcagcttaccatgcatgattattcatgctttgctttgcttttggggttgtatacatttttcgggatggattttgggcgctccctgtttttttcccttttcttttgaatttttagcacagattatttactcaatgcttttaaaagtgtgatttctctaatgcttttaattagtacttatgcggctagactgcgttcgtttgaaacgattgggatctttttcctttcccacgtaaaccacataaacaggaacagtgtatgattaattaggtattggtttaaaatatattaatatgattttgtaagcaacttttacgtagaatttttttaagaaaataacatttaccacctcgtaaaaagtttgcgtggaaaataagaaagtagtagttaaaaaaagtgaagcgaaacatacctgatgaaccctgagttcatctcgacactcaaggctgttgttggcccgatctttcggtgagttgtgataactacgatttgggagaaacgttgacgatccgactacaactgtacaaatccgttgcgttgcgccttagcgatcgatacacctctccgtgggttgttgatcttgccggtgcaagatcacccttatccctgcaagctatcgagaccaagcaagaccgagatataaagcanctgaattgctagatagacaagacgcacaaagataaattgatacacgataaagtggggttccgaacaagcagacggacggtctagccgacacgcgcgctgcaagcgaagtagcaatggctaaacttacaattaatcaaaacccgcgaaactctgaaggggtacctaactatttaaagagataggaggacgaccaagggcactctagggtcgtgctccacctggttggggcgcaccccacttgggccccacttgggccagggtcccaaacgaagttacaagcccaaaggcccatgacaggtgacgcagcaccttgtttgttcatccgcggatgactaggatggaatttggcgatgaggctggatccattggaaagaggactccgtaggctttccatcaagtactcacgggccaaaaacggaggtcgtatgcagattcggcggccgtttgaaatcaacagtgcagcaggtggccgaatcggattccagcacttggagaccttgatcttgatgtcttcttgttcacgcattatgtgagcaatggttgtatccgtagtagccatggtcacatcagtacccgaggaagatccaagctttttctaactatttctttaggcggtgcagagaggatacgacaagaaaaataaaacggcaacttgactaaagagtgaacaattttattccttaatgctggccatatacatattataagagtcacgagctccctcaggaatcaaacactttgtagtttgtactctagtatttcctatactcactccgtcactcgtcaatacaatataggttaattcttcatgagacttgatatagtttttagtactgcgatttgtttcaacaagatgagtttgcgccaaggtacgatgccgtcgatgcgtactagatacatataaagatttcgcctgcttttctaccacatccagaagttgaatttagaagagtttgattttgaagtcattttatgaaaacaattttttaatataggctttcaaaccgctaataaaaatattaaaccatatttttgtttgcttcttttcacgtacatgtcagctgtggttttgaacaatcaaagtcgtatgtacccctgcattcttaaaaaatcaattctaattataaacgtagatatatgcgtgtcaggtttgtaaatagggtttaatcttcttttagacagagtagtaggcccaaataatttaagcgaccaagtagcatgtattttatttccagtacgtgacacttgtgctctatccgctattagtagaacttttttttttagaactggtattagt

SEQ ID NO: 93342 - DNA, 566 bp, Oryza sativa
aatgcaagtagtgatttgggagcattggcagtagggaagcaagcccacggtttgatggtgaagcttgggtttgaggttcagatatatgtgaagagtgcactggtggacatgtatgcaaaatgtggttgtattgctgacgcaaaagaagggtttgatcagttgtacgaggttgacattgtcctttggacagcgatggtttctgggcatgtgcagaatggggagcacgaggaagccctgacattgtatgccaggatggacaaggaaggtatcatccccagtaaatcgactatagctagtggtctgagagcatgtgctggcattgcagcactggaaccagggaaacaattgcacacgcaaatcgtgaaatatgggttaggtttgggggcccctgttggaagtgccttgtctacgatgtattcaaagtgtgggaaccttgaagatggcatgtctgtcttcagaaggattcctgatagggatgttattgcatggaactcaatcatttctggtttttcacaaaatgggtgtggcaatggtgcactggatctttttgaagaaatgaagatgga

SEQ ID NO: 93343 - DNA, 3000 bp, Oryza sativa
gccgccgcctccaggaccagcagccgcttcgtccgcgaccgcctccgtctccgcgaccagccgccgctttgtctgcaaccgcctccgcctccacgaccaactaccaccgctcgtccgcgcctctcctcgcctccgcctccgtgcgcggcatccgcctcatccgcgaccgccgccgcctccgcgtccgaccaccgcttcgtccgcgaccgcctccgcctccgcgacagactgccgccgcttgtccgcgcctctcctcgcctccgcctccgtgcgcggccgccgccgcctccacgtcagacgccgcctcgtccgcaaccgccttcgcctctgcggctgactgccgccgctcgtccgcgcctctcctcgcctccgcctccgtgcgcggctgccgcctcgtccgcgaccgccgccacctccgcgtccggccgccgcctcgtcctcaaccgcctccgcctccgcctccgcgaccgaccgccgccgctcgtccgggcctcgcctcgcctccgcgaccgcctccgcgtccgtgcgcagccgccgcctcgtccgcgaccgccgccgcgcgcgcctccgcgtccggccaccgcctcgtctgcaacctcctccgcctccgtgaacgaccgctgccgctcgtctgcgagctagccgctgggagccagacggccctaacggtccgtgaaagttctccatcccatcccacctcaatcccttctatcaaacaaaaaactataaccatcccataccacaaaccaaacagacaactggaaccatcatatcctaaaaaactgggataggtctaacccatcccactttgtctccaaaccaaacacacgctaaatttcttggggggaggggatagatgtgatgtttttttcggaaaaaccctcgagtttttcatgtttacagcgttaccctctaggagtagaactttatcttcttcgtgttgtatttctataaaacccgagggttgtttcgtataaaatgaacatgatgttagtcggtggaagaacgtgcgcgctattccgttcaaacacgagaagttttttttgtaaaactaccagcacgcgtcattgagaccggtagaaccggtaaaaaaaaaggaacggctccattgcacacccaatcgaggagcttctacacctgcaaaggctgtttagttcgcgaaaaaaaaatttttgggtgtcacatcagacgtttgaccgaatgtcgaaagggattttcgaacataaataaaaaaaaactaatttcataactcgcttggaaaccgcgagacgaatcttttgagcctaattaagtcgtcattagcacatgtgagttactgtagcacttatggctaatcatgcactaattagcctcaacatattcgtctcacgatttcaatgcaaacgtgcaactagtttttgtttttatctatatttaatgctccatacatgtgtccgaagattcgatatgatgtttttggggaaaaaaaattgagaactaaactgggccaaagtacatggcacagctgacgaggagccaaaataaatttaaaaaaaaagagaaaaagggtagcactagggcttttattaattgatgatttgtcgaatccaatccactcgcggatggcaatctccaaaaaaaaccactctatataaatttactgcacaaggctaacagtagatgcatgtttttctatagaaatttcatttgtttgtcaaatccaatccactcacgaagaagaatgatagaaggcattgagtgtgtttagttcacgccaaaattagaagtttgattgaaattggaacgatgtgactgaaaagttggaagtttgtgtgtgtaggaaagttttaatatgatggaaaagttggaaggttgatattattaaatcttcatttcttcatttcttcttgtactagagtagaaaaggttgatattattaaatcttcagatgaagtttcagctttgttgattcttgtggttatcagggtactgaaatatataaatgtattgaacggcaataactattaagatgttaatgcaatggttgtaatatgtgaaccattacaaccattataatggcaattacagtgaagcttgattctttgttattatgtaaatgcaaatggattgccttgtttatagagtctacaaaatgtagcttgaatcaagatatatggtgggaaacatgcatttgcatgtggctatataattagcaatatattaaaccattcattttatttttgcctgaatcatatgtttgatttgtactattatagttgtagcatttgcccatgtatttgatttgtactattatagttgtagcgttagcatgggcaagttacaaaaattgcctgttgatgatatgaagaaatatattgccatgcttgaaaaccctttatctgccttgccttgcatatgctttatcattcacaaccagggaagatgctttatcattcacaaccagggaagatgctgccaggtagtcctttcttgatccatagtagagcttatacaaaatcatatatgcgaatattgcagtgagtatccgtaaaattttgtggaatttacgtcaactaattaagttttgagattatgttgttaatattggcttgaagataatatggatatgggcgcaggctggtaacatgcttgagagaggataaaagattttctcaaattttcaaggtggtggatctggtggtcagttgatagaagatagtgtgaatttggtgcagaatttattgtaatttgagacttttgagtattgcggatgtacggtgacgaatgacgaaagctttacaactaataagtgtttactactatctttagttttatggtttgtttgattttataaaaaacatattctaactattgtactgttatcttgtccggatataatgataggaattcgatagtgttcctagcagcttgacaaatgatatgcggtatccagcattagtgatgttagtcagcaatgctcacatcacacctcgacctaccttaacctaacaatagtgtcct

SEQ ID NO: 93344 - DNA, 1532 bp, Oryza sativa
cactgcagcgcgccgccggggacgacgtcgaggtcgacaatgtggacgaggcgcttgccgtggaacgcctcgaggatggcctggttgcacgccaggtaggcgaaccgcgcgaacggcgcgacgttgtacagcgcccggaacgcggcgttgatggccccgcacgacggcggcggcgccatgggcgccacgacgccgacccacgaccccaccagccgcgccgccatggccctggcgaagtaggccacgagccgctcgccgcacgacgccgcgtacggcgaggccatctgcgacagctcgagcagcgccccgttggcgcccgcgaggttgcccaccgacatcgccgccgcgcactccatcagcagcgcgatcatccgcacgccgtgagcctcctcctcatcctccaccgccacctgttcgacgtcggcccccgccatcgccacgcccgtcctctcctccgccgcgccgccttcctcggagtacacctccttgcacgctcctaactccggccgttgctcgaacgtcccggccgccgccgccgccgccggcggctcgacgaactccggcgagtcgtcctcgccggcgcaaccctcattggcttcaagaaatcggtggtgatgggacaacaaaggctgctgcagtggcaggttgctgctactgctgctgtatagatactggtgatgatcaagaaactgcatcaagcctagagaatcttgcatgtctgaacctcttcccgtcataagttgatttatcaaggatcaatcaatcaagtagggtttctgcatagctgaagatgagtggagcaagagaaagcaatgtgcttatatatactccctccgtctcacaaaaaacaaacctaactggatgtgacatctccagattcattgtactagctagaatacatcacattcagtactaggtttgtattttgtgggacgaaaggagtactttttgtggcaaccagcagaggctgcttgcttgtttattatcaaccgcaatcaaattttaaattttaaaacttaattttagaatattagctgtagctcaaataaaatgtttccattaccttaaaataactatagtgtgtgcaaactccgtagtatccaatacgtaacttaaaatattgaatagggaggatatctagtcctctgtcttttccgaattttttcataactatttatgtactttacaattggaaagagattagagcgccctagttatcatttgagtagtattactaggtcaacctggaagctagtggcagtgtgagagcaatctacacggcaggaatctgcgaaacatcaatctgatgattctttggctgtattcagattggccagtgtaagcttggccggtacaatgagccagcagagctgcatggttttggtaagagtctttggtaattggttaattagctcatagtttcactgaatatttaagcagctaatgatcatcctgatcacatgtgtacatcaatccggtattttccagaaaattcagaggtaaatttattggagcaaagcaattctgcatct

SEQ ID NO: 93345 - DNA, 1307 bp, Oryza sativa
  unsure (1)..(1307): unsure at all n locations
ttgacctggtattgttacaaggccatgcgaacatatttatatatgtatatatcctgctaattaattcagnctacaagccaattttttggggggcccccgggtttaaaaagaaaaattttggttaaaacccccccccgggtttggcncccctttaaaaattttttttaaaaaactttttcccaaangcggatttaaatttataaattggggccccccaatttttcccccaaaatttgcccgggaaaatttccgggataattgnnaccaaattgttaattttaaactacgtatatatactgaagctgatgatgcctaccgcttgcctttgtctgcacttacatggacgcatccaggagatattgcagagacaaacctggcaaacagacgacgatcaggaccaaaatccaagtgattagtgactgattttgcatttcttttagataatactccctccattttaggttataagatgttttgagtcaaagtcaaattgattcaagtttgactaagtttatagaaataaaatagtaatattttcgacccaagataaatttattataaaaatatatttaattattaatttaataaaactaatttggtaatgtaaatttactatatttgtctataaacttagttaaatttaaagcagtttaactttgactaaaggcaaaatatattataacctgaaacagagagattataaatgtattacatcttggcctattccataatacacggtcaatgagtctttaaaagaacaaagaaaaagagtgtgggacatatctactcttaagtaacagattttgtacgcacgagtggttttcaaataatcaattgattgattacagtttagttaatcatcaaacaagcaagctagtaagcatttggcttccagacagcgttgcatctccttttacccaagtcctaatctgtcttgacgcattgacttcggttggcgctggacatggccttgaccatccccttgcagatcttccggaaccagaggaggttcatcgccgacatcgccggcggcaccgccatcatactgtagaaccctagcgggaacaccgtcctcacctgcaaattaatcgaacagccaggaactaatttaacaacagactgtcacaaagctgaaccctgaagagaagacgattggttgattatgattacctggtcgaagtgaaggtacacatgagcgaagaagtatacgaacagtatgacgcgagcaacctgcatacaagaacaagaagatcagtatcacttggagtataagtgaattgttagttttttttcatcattttaatatt

SEQ ID NO: 93346 - DNA, 4535 bp, Oryza sativa
ctgctctacaccatcctgcaacaaataatatctttctttattactttttttaaaaaaatcaattcatatggatttgtaatttttgttacctgttctcttgtatttttaacctttcttctcttcttccttggcaagtcaaactcaacgtgtttcagagggcacgttggaaatgtgtgatctgtcctctgaaaatgactgcaatgatatagttctttttgctgtatttcttccctaattgtcttgtatctttgagctggcctgcctttggattttgcaatatctggatccaacaatatttcttctgtattttcctcagattgttgattgccttgttcatgtgagttcaaattgtcttctgcatttggatctgaatcattgatctcctgctctgcatctttatttgaacacattaattccaattgtttagcgattttgtccatctcttccactgcaaactggaaagtttcattgcttttcgatccatttgatgctatttctgcacttttccttgacaaaatgttgaatctcaggattgagctctatgctaaaggtatatttccattgccttttcccccaagacctttgtactctttttttgtccatctttcaataatatatttttctggtatcttcattgcattgaggtggagcattactttcaatacatggcagcatagaagtccatctttctcaaactttgagcaaatgcagttgaaatcctccttttccaagtccacaataacaaggtacttccttcttctgattacttgaatattttgattcaatgccaaaaaaacttcataagttttgaacttctctacttcatttatttgaaatctagttgttcttttcaactcaacttgaaacttgatgaagattttgcgattatacattctcattgcttggtactcaatgtagtaatgggaccaaagtttgcttggtttctttgttcttgaaatgtgatcatcaaactgttccaagttttgaattgtatccattactctttcatactctatcatgaagtttgtaatgttgtactgtggaccaacattattcttaaaccttgagttagtcccttcactgagagctgtgctttttataaatggacagaaatcacccttgaaatacactggaataaatctttttctaattgaccacatgtgctttagaaaattgatatgctgaacttcaaagctgtcaatcatttcttgccataaatactcaaattcttcttctgtaactgagttatttatgatgtcttcatactcatcatacaacccttcttttgctttgaacaaatttccagatagattgaaagctttctttacaatatgaaagaagcaatttccgtgctttgcattttgaaatacttgagcaattgctgatctcattgctccatcctgatcaggaatgattatttttggttctttttgtgacatagctttcaaaaaagttctgaacatccatttaaatgtttctgaagtctcatcatgcaaaaatgcacaaccaaaaacaattgtgtttccatgtccagaaattccaacaaagggagcaaacgggaggttgtatctgttggtgaaatatgttgtgtcaaaactcacaacatcaccatatttctcataccactccctcgatctcccgtctgtccaaaacagatttttcactttcttgctctcatccaaatcaaactcataaaagaaatgtggatctttttcttttttccttctgaaaaattccaaagttttcatcatatcattgctgcttgtctccttgttaattgtggttctcacattgcttatatctttcttcgtataaggcaaagaagtcaatcctcctcttagaacagataaaattacaatcatgtgccttgttggtattgtcggtgacatgggaccgggggtatcttgactagaggtttggggcagctgcagtcacccatgtggcctgaccccctcgggggggggggggggtcgggcccgagggtgatgtgcccgcccctccctctgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcaccccacgccgcatttaatgcagcacagcacactcgttcggtccgtgacaggtcacagtgtgtgaccggtcacagaccggtcagatcgcgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctaaactgacacgtggtggacaagaatgatcggtctgtgactggtctgacgccggtcgcgtcatcggcagacaaccgtgctcccacgatgcatctgcctccggtggagtggaggtaggtatgacccatctcgtcggatggtcatttggaaagcagccatggcaaatctccgcccattaatgagggagtaacagggagatccccggtgtcaggcgagtgacggcgctgagcctcactcaaggacaagttgtgatttagcttccaggcgaaggtgcaagccaagttttggtcaagatagggtaggtccccacccaaaagaaaagtaggtagaagtggtgcatgtggtatccccttgagatataaaaggaggaccttgcccaccaaaaaggggggaaaaaaagaaaaaaggacgctagaggggttctggagcctgaactctctagctctccggctctctgtaactccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgtccccggccgaaccggcaaaggggggcctgcgcggtctcccggtgaggagctccacgctccgtcaggtatattacattccttcaaggtccttatgagcattttttcttctgtagtcatgtgtttgtgtgatttgagaaatctcacttcatctcttggacttagttgatgattgtggtctaattgtacccttgaaatattccaaatctcattcctctctgaaataaccagagcacacttgcaatctgttgcatcattttcatttgtatttctttccgaaaccactgtttcctctgcgcttactgatttggattgagaagttggtttgccttgtctattacatctgaacgttactctagtcacttctccattccttttcttgcttgttgtgtggtagttgtgagccctgacaatagaaaatccagccaacagagcatagaagttaaagaattcatgtgcttttgtaatagtcttaaattgtgttccaactcttggtatatatctgctatcaattgctgcattattaccctttgtagcttcttcctgttcattctctacgaaaatatttatgtcttcttctgtcagctcttgttgatttgtttcagagttatcatttggattattgtcatcatctcttgttccttgaactgaagtacatcgatgattatccattgaacttggttcctgcaaaaaaaaagcagttccattagtttctgaaattaattttctagcctattcattgctaatctgaattattcaatttaattttttaagaaatattaatgtttgtactctttttttgcagactatgaaacttcaatcatcaatcattgttatctagagaaaaaggtacaaccaacaaaaattaccttttcaccatctaacaaattgaatatatcaagattccaattatccattgcatcctcttcattactctcatcttcctggaatttgaattacattacaaagttaaaatttactaaaattatcataatttttaatactacaacaggaagtaatacatccaagacaacatgcctcatttgccgcatcattattccattcttcaatattagcattagtacgatttgttgttaatatcattgaattctgcaaaacaaaatttttatatcaatacttatttgcttttgaatttgaattattagattcaattaaataattaatatttcatacctgaaatgcacttggactcgcaacaaaagtagagtgtgctgaattttgttcctgtaaattccaataaaaacagaaatattacaactaaattatatatgatattcaaatattgtttttcttacctgcatatcagaaatcgtaggctgtgatgatatgatttgttccattaagcttgtgtacgacatatttgcaacctgcaaataaattttcatatagtattttgactaccaccttcaaatttttcctttaatagcaaaaactttgtaatatgaacttactgaattcattgatccgaaa

SEQ ID NO: 93347 - DNA, 3057 bp, Oryza sativa
taaatgcataaaagttctgtgcatcagtaacaagatgaaaacccacatttgctgattcctgaaacactgaaaagaactggtgagtgtcatgatgcagaaatttcaagagaccacatggtctacacaacaaaagtaatatcatacctcagaatttatcacagtcgagttgacagtcatggaagatgcaagaaggttggtagagaaaataacatagtgccggagaactggattttcaagcttttgcacattggagtactccatgtcagcaaaggatttaaagtagtctactgtcaatctcattgaaaggcagtggaggctcttaggtaatgtctgaactccaagccggtaaagatatgcaccttgtcttgcatgaaaatgagtttcatcctcagtcatatcaagcaattgcctcagttttttctcaaaattagtgcattctatcagacatgattttgctgcagctattgtcttctccatctttgccatattggctccatggcttcaaaaataacaaataatcactataacaaaacaaataatcattatagcaaactctaaacctatggggaaattttctgttccaaagtgaatctgtataacacattgagccatcagatcatcagtccactcatcatttagaacttactgctacaattattggtaaattattcatcccaatatcacacttttagcttaatacaatgttattcgatcaaactacagagtgttaatacatttcacaaaataataaggactacgaacatgctaggtgatgaaagagataatcctaaggaatcattcaggtaatgctcaatcaactgtaggctgtcaattatgcataagttatcttgtatacgtgcatattagacgacagtggatatcaaaatctgtgaaaataaaaaacaaacagtgaagcacaacagttagtaggtagaccatttttggtgcaaagtcaggctgcttaaatacccaacagtttcatgtatggtaaaatatcaatttctgaagttagcagtgccttatggattaaagatgatagcttaaaaatgagaactaaagaaagtatttctggaagattacttacaatgcaggaagatcagcatcacatatggcttcgctgagcatgtgctcatgctcttggatactttgcttcatttcatgtgaaagtttttccatcccctcaagttttgctatgcttggatagtaagctcttgcaacaaagagctggtctttaagtctcttcactacagaatctttcatcacttccttgtgttcaacagaccaaacacaatagcttccaaattctagttggcacgattttatactctcatcaccaggtaaaccttgttcaaaattgtccttaggatcagcatcagtattctgcaacattaggtgaaaaataaaaagtatgtaatatatgataattctgcaagtccgcaaacaagttacaaaggattattgaaatgtttctttaaaatattgcaaaagcaaggtgcatatcacatgccctgctcagaaattcatgcgaaagcagcatatatatttactgcacgaacagacaagggcatgttaaaaataactgtaaagcatattagctcttacactcagtaatgatatatcatcaaagatcacgatttgtttgataggaaggcctgcacattacaagaagaattaaagctgtaacttgatatttaaaattttaaaactaaataagtggtcaaagaatgggccctgcttacctggatggattgaggtattgctaatcggtttgtcaatacttggttgattgttggtcccattgctttctgcatcagaattaccggtatttgttttgctccagtcctgtgaacgaacaactaaatcaattaggtaacgcaaaaaaaaattgcatgtttcggtagatagacaagattttcagatgatgcaatgcaatttttgggacatagtgacaaacagttagtaagttcaaaaccccattcagctctgagcctcttacatgccaaaaggaaagaaacagtgccttgattgcagtagaaatgcaaaagagggccatgtgaaacaagatccatgatatggcaaaagcagactgacatttccaaaaaaatggggccatggaccatgtattaaaaggcaattccactcaaacactacccatgagaccacaatcggcacgatagcaactcacaacaagcactctacttggataaaatttcacgcatgaacaaagagaaaaacagctgcgggcgatgggctcaaatgcaaaccctttcaatcgatggcggaaaatttgtcgtgtcgttgactggcagcctgtcattttcctgcgaaaaagaaatgcatcactgatctaaagataaattctcttcccgcagtataccccatcagtcatcattgccaaacctaattaggataaatacacctaaccacactcccatgtgattggaacatttcaggtaatagaacaaaaatatcccagaaatggcaatcatgagcacaccccctacctgcgatgtatttggctcccaaccaccaccctcgctgccgccaaacacctgtgcaacagaaacatgaggcaaaaatcttaacagcaatggattaaacaaatcaaatggcttaagcatgagctactagttagtttcaatctcaattgacactcaccgacacggcgctctcgtcggccaaatacactgtgatatcaaaagacaaaacaaatacaaacaaaatcgagtcaggggagcatagagagagagttgatgagcccctagatcgagcgcgagccggcgagccggacgggaagcccagatctgggagcggagaggctgaagagaaaagtagggttttggcaggggagagaggggtgggtggttacggactggacgggaagcgctggtggaggccgagcagcacggcgagcggcacgccgacggagaggaacagcagcgccagcgcggcggccgcggccgccacgctcctccaccgcctcttcgccggggcccccgcgccgccaccctggcccttcatccccgctcccccccgcccgcacgcacaggggggagc

SEQ ID NO: 93348 - DNA, 2940 bp, Oryza sativa
  unsure (1)..(2940): unsure at all n locations
acgaacagcattcgaccacccagcgaatccagctccttccacgagtactgggcctcgctgatggtgatgggcgtcggcggcggcagatccaccatctcgaacaccttgaacgccgacgctctcgggggcggcggggcttgtaaaggaggaaacggagcgagccttaccaccatgaggagataccccccggactccaccaggtagcgcacgacgactttcttcccgtggtaatcgcgaccaccacgcgagaagcgacggatcaccatgggcggtatctccaggttgcggttgaggtattcgtggaagcccggcaccggaaagacatgagagttgtcttctccggtgaggaaatggaaggctcccctgcggagtatgacatccttcagatttgttgcgctcatgatggtaggaacagaaatactcgttctcttcaacgcaggctgatgctgccccatgcgccagaatctatgaactcgcgggccggtctcctggcagtagtggcagatggcggcggcgaggcagtcctcgttttccggcggcgaagagagggtcgcggacaccgtcgcccaggacacgtaggggtaggggatgcggagtcggtggtgggtgcggaggctgaagagcgcgtagtccttggtctggccgaacgcgacgaacagccaccggccgtcgtaggcgccgaagtagcgcgcggcgcgcgcgtcgcccgggagcgggaggcggaaggcgtgggtggcgcatccggcgatggcgcacgcgaaggaaggctcgacgtcggcgcgcgggacgaggatcgacgggagcggcggcggcggcggcttctgcggcgcgacggcgacgcgccagttgcggcagactcggcccatgcggcgccggtcgacgtggcacgggaggtggctgtggatgagtcggaggacgtcggcgtcgagttcgcgccatggcgcgtcgtccattggagaggcgggaggcgcggcttgccggtggcgaggagaggaggcgagacgatgcgctgtgcgtgcgggattcctctgcttctcgaagcggaatgggatttttttttttttgagagggagaagcggaatgagatggtgggttggtttggaaggaggaggaggtgggccaccaaacgatagaactaggccttatttattgggccagtattcttgggcccgaaggtttgagtcgctgctgtgtgtttgctgtgtagcctgtgtactacaagaatctctcaaattcgactcatattttttagagtaaaacgacacagaattaaagtgatcatttcatcaggaattcaggataccgcagagctaaatgtcattaatctctcaaataattcttttggtcttataagaagcccataataaacgcttaaaataccagaaggattagtgtcgcgtgtgacagcattttagcacattacacccttctctctcttgaaataaggaatttctggggattccagagctattctgaaatctgaatcaacctcggttgtcatgccatggccccgtgaatcagtgattcacggcaaaagcattgcttggcattttagtataataagtaattaagcaaccaaccgtctaatgaactgttttgactgtaccatcagagatatcagacagattgctacaatattcagagaagtgattctctgaaaatgaacaacccttaacagatgagcagaacatcctctgttcagtagcagtgattcagtggacaaagcaataaagcacctaccacatacctgtatggttgtgttcaaaagattgccgggtcggcngaaagattcggtcgaccaatttcattaagaaatgaagggtacattacaattaaagagcttacaacgacagtatgctgtcgaaaacagattggggcaaaagcccacacccggtaagccagaaaacttctacaaattacaatgcatattacgtgatctcgctattgcacgttgtgaacactcctgccgtcttccagacgatgacctcttccttgatattttgcacaagctgttctatgcttcgaaatttctgttcaaagacacgcgcattgcgttcttcccacagcagccaacatgttagcgcgaatacactgtcgaagatgctcctgtagcccgtccgaaaagccatcctcgccttcatccaccaatgtgtgcttcaaaagatgatgaccacattggacaaataaccatctcacctgttactaatactcaactttttacatcatgtacatagtccaggaataaataatgtcacaggaaaaataaatccagtggtatcaacaatagtaattgcaaaagaacaaatagcacaggacagatcatttactactaggtaacttgagtaacccccatataacttatcttaaagcagctagtgctatcaagaaagctttacttcttgcacaggtagctcaaaccggtgcatgatgacgatgttatctcagtataacaaattaagaagctgagtgttgaaactaacttgtagcatccaccaaggattctgaatttctgactagatctcctcagaagagaattgaagcaactgaaagaaagctgcagaaacaattcctcctcattgaaaatccactttatatatgcagcatggtgcactaatgcaatccaacccataccagaaactaaaatacttgaagatgttatgataggtccagcattgcaagtacattgtactaactggattactggacaatcaacaactgcaaatatgtgaacttcagaagttggctcaaagaaaaacagaaaaggttcagagctggaacggaaacaacaaaaacagttcactgatcagcacgacaacaacatcacacggacgcctcgatgtgaggcaagcacatctcatccagatcgatcggcagaaagctcatcttacttgggaaaccaagccggcagtgagtagtagttcgacggtgatgccaagcttc

SEQ ID NO: 93349 - DNA, 1481 bp, Oryza sativa
ttaaatagggggagagggaaccggacgtggccgggagaggcgggaatcgccggccgacgcgggggagtggggagaagagagaggcgggattcgattttcgaatcccggccatctcgggcgcgggcgcgagcgggagagagaggggaatgggcgcgggagattcggcgcacgcgcgggcgtggtcgacgtggcccgggggaggcggagacgtgggcgcggcgacggttgcgggcgcggcggcgcgccgggatcggcgggaggagggagacgggcccgacaggtgggccccacctgtcggcgaccccgagagaggaggcagcggggcggcctggctgccgggctgggcctcggcctgcggccggcccagcggagaggggggggggaggaaaggagaaatgggccgacggcccatttgacaaaaaggaggaaaaagagaggaaaaagaaaaagaaaaaggaaaaaggattttccctggaataaaatattgcttgctcaattttaattggttaaaattatttctagagctctgaaaattccactaaaaatcctgttaatgaattttgacatgtagaactcaagaaaaattccacatgtcaagtccgattattatttgcattactttcttagggttttctcctgatttcacctgcattttcttggggtcatttgtaaattacaattttggcctaggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaaccgggtaaccttgtttctggttctcctttcgctggtatcaagtatgcgaaccggcttctccacataggttaggtcctcctggatatcaatgtgttccgaatcagcctgttcttcaggtacccttaaacacttctttaattgggacacgtggaacacgtcatggatgccgatcatattggatggaagttctagctgataagcaacttctccccttcgttccaagattttgtatggtcccacgaagcgtggtgccaacttgcctttcgtctgaaaacggtgtactccccggagcggagtgacacgaagatacacgtaatctcctgcctcaaaagtgagctcccttcgacggttatccgcgtagctcttctgtcgagactgagcaatcctcaacctttccctgatgattctgactttctcttctgcttccgctaatacttctgttccgaacagttgacgttcgcctgtctgatcccagaagagaggtgtgcggcacttccggccgtataaagcttcaaacggtgtgtcacgaccggaaatcacccaacaggcgttcctgacgtgcgtgcattattccttgtcccaggaggcaaggtacaccaaaagttgatacaattcagagtttaacaa

SEQ ID NO: 93350 - DNA, 1334 bp, Oryza sativa
tatattttttttattgtacttgaaaatagattgcatatatatattgtcaaatttctaattagatattttttgcctgatttttacagaagttaattaaattattgtgaaatccatttaaatattacacatttggaaagttcctttgatgcggttttatttagaacatccaaaggtttacaatcatcctaaggagattcattatattttggtaaatactaaacacgtttcattactgaagtactgataatagactgagggctcatttataaattaaaatccactgcaggaccaaagtgtaaaattgcaggcacatcgttatctcctcccaagcccttcctggccacatatctgcgctgcggtcgcgtttgtcttcctgtcccgaatggccacatgagggcgaaggccaggcggcggagaatctgaacatatattcttctccaatctatctagctcactcatcactaccttctcctccactactcatccatcggagccgatttgagagggaatgccttgtggtagcgacggctgaaagactggttggctagatccaccatagggcatccaagtcagtgccttggtagatccaccgcaggatgtctagatcaggagcagtgttagccatcggttagttggctctggtatgggaggtggtatttgtaggaaatggggcagtggggatggcaggtgttggggcagtgcggatagcaggtgcagcaacatcaagcatggctgagagcgaaggtagccccgagagctcatctttcttgattgatttccattttacataatcaagtttttttaatcattaagtttcttgcttggggatttgtattaattaagaattattaaatcaactgatcttgttttatatgcttttaggatatcaacggtagaggaagcaagcagggatcgactcatatacatgtactgaaggtacatgcatgcatttatattgaatgttattaactctctatcttagaaataaacaaagtaatccaaggattcctttggcaagtgcaagttgtacgttacatctgacaatatctaatgaacataaaaattaataggaacatatataatactattcttcaataaaaagtattggctgaaccctccttttaattggttcttttgggccttcttgacgataaattacctgcagacgaaagtccatattattataatttactaatcaaaccaaatctaaagcaccaacattttcccagaagtaatatgttgtacctaatatgagtatcgggtgggtggtcttctaatccttgttgatctgcatcgactggattgctcattcatgtgaactttaatgttctcaa

SEQ ID NO: 93351 - DNA, 693 bp, Oryza sativa
gtcgccgccgccgcgcttgccgtcgcctttggttgttgccgccgtccactgccgccgctttcgcgtcggttttgggccgtcgcctccgccgccggatgccgtcgccggcaacacgacgtgcgcgtgccgccgccgtcagccccgggtcggccggtcggctttgatgccgagccgagcccggcggctgcctccaccgccgccgtccgatcggcccgagggcgatctgggccgtcggtcccgtggaccggcgatggaccacccgcgtggtcccggtccacggtgaaccgctcacccttgagtcgctgaccagtgggccccgcatgtcggcgccgcactccccccctgtgctgacgtcagccctggttaatattgcgccataaattatttaaggatttttgttatagtaataaacacagtgaatcttctaaaattcataactaattcatccgagctccgtttaatcccactcaagtctcagtaaatcaagaaaaatgtgtagaatccattaaaaatggttttgttctctgtttcagtagtcttatagcctgtttgcaatgtttgctttgtatgccgctagattccgatccctccgacgctccggtgtacttcgagatagtcgccgaggttcccccagcagcagagcaaggcaagtcatgcttgtcacttgaacatgttgatcctatattgccaatg

SEQ ID NO: 93352 - DNA, 859 bp, Oryza sativa
gagcttctttcagaattgcatctttcaaatctttgttgtcagggacacaaattctttcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttttgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtatatacctctgtacgagtaccgaaaagataatgacgccaaatcttcaacgcatgaactactgcagctaactcaagatcatgagtagggtagttcttttcatgcggacgtaactgtcgagatgcataggcaaccaccttcccatcttgcatcagaacacaacctaacccaagtttggatgcatcgcaatacacttggaaacccttctttggatcaggcaaagtcaaaataggagctgatactaagcgattcttcaactcttgaaaactctgctcacattcttccgaccacttgtacttcatatctttctgaagcagtcgtgtcatgggcttagcaatcttgaaaaaattctctataaaccttcgaacaacccatacctagtggtaaaagctgtcttaggtatatcctcc

SEQ ID NO: 93353 - DNA, 688 bp, Oryza sativa
tttcaaccaaacaataaactccataagcctgtttgaattaccacttccagacagactatacacctggtcgaacaaaagagaagttccagtcctggcaaggatagaccgagcttttttcaacaatgcttggaacaacaccctcccaaacacctccctctcttcttgcactagaaccacctctgaccatgttccacttcttctcactgcttctacttccattccaaaatcgaaaactttccgctttgagaatcatcttttggtggaccgagattttcttccttcagtcatgcacaggtggccacaacagctcaatatgaatgatccggccgcttgccttgctgccaagctaaaacagacaagatctatcatcaaagtttggatgaaagaacacaggaaacgtagttctctcaatgaagactgtaagttcacaattgatctcctcgactatattgaagaactcagacctttgaatgatggggaacgctgcctaagaaatcttgtacaggagaaattgtttcaggccatccaaagcaaggttgcatactggaaacaaaggggaaaggtcaagcggctaaagattggaattgacaattcggcattcttcaaggctcatgcatcaaaaaattacaggaattcaaggatcagatcaatcaagcacaatggggcagaaattgcagatcacaatgga

SEQ ID NO: 93354 - DNA, 636 bp, Oryza sativa
tggaaattggtcaaccgtctatcactcatatgatatttgaatatttctaccctgatggatgccgacaggaagtatgcagggagagattgctgttgagaagacttctctggatttctcaaatttgtcagaattgatttcatcaaaccgaaaatcggctgggagctcaaaatttgcaaaattttcataagcaaaccatattctagagtcctttggaaatccatcatagaagttgccgaaccaatccttaaagagttcagccaataacttggatccggcgtatgtagatgctgcctctccaaaagacatacatcggcgagttgtgatctcttggccatcctcatctatgatcggctgggatcttgggaattcagccttagtcagtgctggtctatcaaccaccctcgtggtatgcaaattcaaccaagtctgtaacaaccaccatgggccaccagtattgatagcagagcctgaagcaattcttgctgatgccaaatttagggtctggtacagatatcctagcaagaatttacccaaaggaaattgtttcttctcttcaagggcttcgactacatgttgccagtttgtggtgggaccatagcttgggccacaaaacagaaatttttctgaccacattag

SEQ ID NO: 93355 - DNA, 730 bp, Oryza sativa
gtagctcatcaccaactacacgtctccggcacagtggaagtctactgtgcctcccttatttcttgctcctgactcaatcgcctccaccgaccacagctgggccacctcccatggcgtcccagcacggcggcgacccgcgcctcgaccgcctctcgcgtgccctcgcctccgaccacccgccgccggcggccgccgcggtccacgcgcatctcgtccgcgcgcacgccggcacgccgccccccgtcatccggtccctcctcaaccgcgccattcgccgcctctccaagccgcacccgcgcgccgcgctccgcctgctcctcctcatgccgcgcctccccgtctcccccgaccacttctccctccccttcgcgctcaacgccgccgcgtcgctccggttgctcccgctcggcgcctccctgcacgcgctcgccctccgcctcgcgctcctcccctgccgcctccccgtcgccaacgcgctcgttgatctctacgccaagtgcgacgatctccccgccgcacacaccgcgctcgccgacatcgcgggccccgacgccgtctcgttcaactcgctcctctgcgcgcacgcccgcctcgcctccgtgcccgacgccgagtccctctttgttgccatgccatccagaacccaggtatcgtggaacgccatggtggtcgtctacgtcaatgcaggggacgtctcttctgctcgccgcgtgttcgatcaaatgcctac

SEQ ID NO: 93356 - DNA, 647 bp, Oryza sativa
tacaaatggtaattgcacataaaaaatagtacaaactaatatgcaaaatgttgagtgcaattgttcatcaatttgcgatatgatcacacatcgccttacataccaccattacataactactaacttcttagatgcttacatgcgactcaacaatcattaccctttaacatttttttcccacaccgtccatgcgcatgtaaggcttcacggtcttctgagtagatgtctcgacattcttaatcttctgtacaaactgactataaagtgtcatactatcgtattgattgtaatcttcgacatcttcaaccccatccactcccaatatcttttgtttcccgggtagcactatatctttcttcaaatttgaagggactttcacataaaacacttgtgccacgcgattggcgagtacccaagggtcatccttgtgacccacactcgccaggtcaacaacaataagaccgaacttatcaacattgaccccgttcgggtatttttgccactggcacttaaatatggggaattgcattgtgtgcccatagtcgatttcccatatttcttcaataaacccgaagtatgattgtttttccctggcttcatcaattgcctccacacggacaccgatgttttgcgtacaggttttatta

SEQ ID NO: 93357 - DNA, 1676 bp, Oryza sativa
cgccccctctattcaaaatccctaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggccggtgtcctgttgctgggggctcagtcctgcctgcctatcccgggggttccggccgtaggtgggattgggtcggtactcttgtctatggctaggatgggttggaaactatgtcacgtcttccgtctgtataccgtggtggtatgtggcacgtggctacacgtgaggaagatgtgtcttgtgggtaaagatgtacacctctgatcagagtataatctattcgaatagccgcgccctcggttatgggcaagccgagcaatgtacccaagttagtgttttaattcttaaaacttgcttatcaactaaaatgtggaatggttggcctcggttggcttgggacgagctgggacccagggtcgggttgccagttcggtctgaatcatcgtaggccttgggttaaggcaggtccgtgtgggttcacggccttgattaataacattgtatagttctagaatcgtgtttacaaaatagctttggagcaactaaatatctttaaatgctgtttactgcaaccctaaccctctatagtataattcccttgtactcccttgcatttattctgcacttgcgggtgtgtcttgttgagtacggtggttgtactcagtcttgctcaatttttcccaaccccagaagaggagttccttgaagatgaaggctttggtgtctagctcgtgcctgccgtcaagcgcctgtggtcgtcgccctagtcttccgctgtttcccgtttgtctttgtgtgtgctgggccttcgctgcccatgtaataaattaactatttacgcttccgcttgttaaactctgaattgtatcaacttttggtgtaccttgcctcctgggacaaggattaatgcacgcacgtcaggaacgcccgttgggttatttccggtcgtgacaattatcatagtacgattaaccatcatgagctaccagtaaaaataaccataaataataatgtagtatgattcatcccattaatgagctaatgtttctaagcatggctaagcaattatatataaagcatttagctgaaccaagtcaatatataaggtccaagctaatcaatttattacccataggaaaataaagtcatcttcggccattaattaattgggaacggctcaccacccgatgacattcgaaaataatgcataagttgaaataaaacattagatttaaacgggttcaacatgcaaaaatggttgtttgggatctgtgtgacttgccttgagcttcttcaaatgcttctaaaccttcctcaacgtaaacgctctacttcagaacgtcggaaactaaagcaaatgaacaaaatcaacaaaacagtacaaaacaagcttaaacagtacatgaggatatttttaacatgtagatcttgactttagatgaatttagca

SEQ ID NO: 93358 - DNA, 756 bp, Oryza sativa
ttatactgcttacgccaatttggattaattattttaactttttaaattctttcagagatgatggccttcctagttggacttgatctaatgcaaactgtccattctgtacaccaaatcatctactagtcttaaattaattagctaatagcttagcttgttcttagcctcactgcaaggacctaattaaagaatagctagctttattgtccaggaagtcacgcctgcatatatatgtacctttcaacgtttttgatcaattcatagcaggaattgatgcgaacacgaacaattcaaactggcctgaccggaattcatttcgaattgtcaatgttggtacgtagccgaaatgaattgacttccgtagcaacaaagaaaatgagaagaaagtcttgtgttaggccaaagcaaaaatatttatttattttttgacctccgttctgaccctaaaatggcagaaaaattaaagctctgcaaaattttatcttgcagcgagattgactgtcaagaccttggagctagtggatccgtctctctccgggtttaggcgtttagggctcttttgaattggaggagattcataggactttttcaaaaaaaaaaagagatacagagattcgtaggaattttaattgtaagaattcatttcaactgtcaatgttagtacgtggccgaaatgaattgatttgtgtagcaacaactacaatgagaagaaagtcttctgttaggccaaggcttgtggacctccatttctgaccc

SEQ ID NO: 93359 - DNA, 580 bp, Oryza sativa
cctccgccgttccaaccgtaagtgtctactatctcagatcatgctacgctaggattaattagccctttttctcgtgtcagttcttcattagcagagtaggagtactaacttagagcacattttatgtgttgtttcatcgatcagctggcgagcgtgaggatgctgccatgggcgaaggcgaacatcaacccgacggggcaggcgctgatcatctgcacggcggccgggatggcatacttcgtggccgccgacaagaagatcctctcgctggcgaggaggcactccttcgagaacgcaccggagcacctcaagaacacctccttccagggcgccggccgccctcaccctgccttcttcaggccatgaatttctcctaatcaactagctatagaaaaaaaaaatgctgcttgcattgctaggctagctgctgcttcagaaagtgtttgctgtgtacttggatcgatgtagtatactgtatgtctgtatctccagtttgtagtactaataaacaaatcttttgaacttgagaacgaattacattgatgtggtggttttgtggttcatgtgcattctacaagtt

SEQ ID NO: 93360 - DNA, 1394 bp, Oryza sativa
  unsure (1)..(1394): unsure at all n locations
gtcagcactcaagggagttgtctccaaggatatgcatgtcagctcaccaagctctttcaaagatgattgatgtgaccctcacactcttaaggctgtgatgctgctcttctggtattgatctcagatctgcagaatgtgcaaaaatgaaacattctgcacgtaccgctgcattacntaggatgtgaaagggagaaattttaagtgacatttccaccacacaactactaattttcattcatagcagtaataatatatgaatggcaactcacagtcaggtagaaagtctccagagaaggtgcagcatgaatataagaagccagggacaaatagtcataggctgggaaatatccaataagggcaatgctcaagtgcctgaggcagaggaatttgctacacagcttcggtgcaaaggccgtctgcataaagaggtcaaattaattatgctacaacccataagacagaatctagtctcattcatgtgtcaggcaaaatttctcatacctctttgaatgacttcatggcaagagattcaagatttggcatgatggatggaagttcagcacgagcatgataaacataaccagagcgaaccatgcataggctcttcatttgcaaagtttctccaagtttcagttgcgttttgtccccttgaaatgcaaaaatggagacattaggagcttcattttctatcagtttcagattgtcgcacccaaacaccttcagggagatgagccgctgcagtaggcaaggtaccttcaggcaaacaatcctatcgcagtacctgatttccaactgctcccaatgcaagagaatgggaaagaaagcagcttaactcgttctccgtaatacgcacacaccagagatacaatctcgtcagacttcttaagccaccaagtgtgactgttgggtggaaggaacagttagaaaggtgaagatattggattgagtctccactcccattcgacagaagagagcatgggaaattgtactttgcctggaactgggtcagtgaaattatgagttcttcaatccctggtttaacaccaatctgaagccaattgttgagatatgaagagcccttcccactataatctgaatataccttaatcgtaagttttttcacgccgatgcctgagtgccttttgagaatgtggtcgactttgctgtagaaaagtccagccaattcttcctttccacatgcatttctattcaacccaaatgcttcactactgaaattgaggttgggatggcatctccaggaacttagaaaggaacgagacacacaggcagctcgggcagcagctcgcattggcatcaaggaatgtataagacgccagatgtcctgcttgcacaagcatatgggagagaagttaaacattgtactaattgtgaag

SEQ ID NO: 93361 - DNA, 613 bp, Oryza sativa
gcattaacatcatgatcagtagccagttatccacaacagagcgagataagatatccatgaaggaagctcctgctcatatgcatagcttttattagcacccacaccttaattaattgcacttaggcatatcatctcacaattttcactgcatataacacagtgaacacacacatgcatgcaagaacacagaagagacaacactggtagtattctctctgggataaaaagggcatgtcattgatgccatattgctgcaaatctagttcgattttgtgagagtatattcagatttagccctggcctttgcagcctcgagggagtgcttcctggacagctccaccaccttcttctccccggcgatgaagtaggccatgccagcagctgcatcattaaccaaatcaaccatgaattaatttcccagagctcttaattatcagttgctgatctttttcaagcactattatctgttgtagtaattagctagcatcaaacatttttaccgtaggtgatgatgactgtcttggcgactgggttgcccagattggcctttgcccacttggacatacgaacactggcaaactgcaagggatcatatcaaaagttgcattggttc

SEQ ID NO: 93362 - DNA, 997 bp, Oryza sativa
tacttcctcggtttcatattataagactttctagcattatccacattcatatatatgttaatgaatctagacatatatatgtgtttaaattcattaacgtctgtatgaatgtgggcaatgctagaaagtcttataatatgaaacggagggagtatgtaacatgttctcttctaccacttagtgaagaccgggcatacaaaaagcaccaaagaagcagtcaagctcttcataattaaaaaaaggaacattatggaactaatctgaaactgcacaatattccatgtaagataagttggtgatattttttttcagaattccatgtgctgctgttactctggtactagattcattaagggggtttctaaagaaacactgtatgcttgaagatattgatcttttgaattatatatatatatataacagcaatattgtaccacccaatcaagcgatctcgttgaaagaagtcgacccgctgaagtaaagttccaataagatgacgcatgtaatcggaccaagaaaaaaccaggaatactaattagcgggcacgcgctagcaaaagaagtcacgcgcgttttccgaccgcgtcacgacaactagggttagggttagggttgccgggtggggtgggggaaggtggcgctgggagggcgggcggtgggccggtgatggtggcgggggcaaagcgaggcaaaggggagggggaggaggccggcggggtggggccgcgccggcacgttgacgcctttcggcgccggcacggtggcggtggagaaaagagctaacctgttaccgagggaggaggagcgtgctcgccggagcccgcaccggagggtagccgctccgctgcctcggacggactggaacaacgatggcgatgggaagagattaaaaaaaaaaaaaaacaccagttccgcaagaatctttacaaggcatgccacgagagggactccgggaagggatgggggagggtgatgcagggcaggaattctaccatgct

SEQ ID NO: 93363 - DNA, 915 bp, Oryza sativa
ctgcattagtgcacaattgcacataatgcataagtatgtgctgtatttacaaatctttatagctttggccttcaaagttcacaccaactagctaggggatgcatcatgcatgcatacagtcattagtaatttgtaatgcgctaacacatgttgtcagcgttcatacatagcattatgctgtttttatctttttcacttttttccctttgtcccggcaagaaaatgttctgaataaagggcagacaagacagcaaggaaatttcagaggaagttcagaacggagtgaaaaaaaaaacaaggtactagttctcactgatttcatcatcatcatcttcatcatcaaaactaattaattacattacaacttatagaaccattacacagcaagcacagccatattgtagtagtagcggtttatccaggcttccatcagtcactgtgaagttcagtgttcctcatggcctgaagaaggcagggtgagggtgcccggtgccctggaaggaggtgttcttgaggtgctcaggtgcgttctcgaaggagtgcctcctcgccagcgagaggatcttcttgtcggcggcgacgaagtatgccatcccggccgccgtgcagatgatcagcgcctgacccgtcgggttgatgttggctttcgcccatgacagcatcctcacgctcgccaattgaatttttttacagcagcagatttcatcgcaagatcagtacacaaggaaaaaactctgaaaatctgaatgtttcgttgtcagtttagctcaccgttgggacggcggatgccaccgtcgccaccgccgcagccttggctccggcgagcgtcgcctctgcaacaattcaaccaccaatgtaagaaccaagatacagtgactgaccgtcaggtaaatcacttataagcagcataaatgt

SEQ ID NO: 93364 - DNA, 3641 bp, Oryza sativa
gacacgcacggttgccatcaccgttcgacctgctgattcattcctgcgactgcgagtgctgtttccttgtcgtttaaatgggcaattcggttgcggattaggattctccgggggtagatgtgtggtgccatctgcatttatgacggaatatcgtccaggcaactagtaatgatttcttcttttaagatgctctttgccatgctactactagtagttgcttttgctgatgattggtttcttggccaatggtttggttgttgttttttttaaaaaaaactttcagggggctctgatttcttgtttcagttaaccgcccatacgaaggagtctactggcaaaattttgctctctattttttttttctgcggaatgatttcattttgatgtatgatagcacttcatagtatgataagtctggattttgattcactgcataatcttctgaatcataaagttggtgttttcctcggtgtcgatagtgctcgatcttaattgggcatgctttggttttaattagttgatcgcctagcaaaagttgctacaaattataatgattaatcatttggactttattatttttccaggtaccacaattctagcagagattataaatattcagaaatgggtgccaaagataatggggaagtaagagacgagaagggggttggatcagattatgaaccggccagagtttcaggagtttccaagaaactcatgagaaaggatacaagagaaaatagccctcgcatggcaaaaagcagtggcagccgtcaagttcagaacaagctgcaacataaagcttcaaacaacattcagagtagatctccaaaacccaggaaagttgttaacgctgcgaaatctgctgaagttagaaggtcagatactgtaagagttccttctcgtgctccatcagagctttctgaggaaacagacgatatagttagcgaggctggaaccgttgatgatagtaaaggcaatgaagaggccaaggagattgatgtgctagatgaagctccacattgtgatcagagcactggtactgacgatgaaattcctgaaattgaagaaaagatagttgatgatgagaaaccagttgtgtatcaaaggaatgaggagttacaatcaaagattgacaagttggaacaagaacttcgtgaagttgctgcgctcgaagtttccctctactctgtattgcctgagcacggaagttcggcacataagctgcataccccagctgggtgtctttttaggatgtacattcatgcatcaaagttttggtcctcagataagatagcttcggtggcaaaaagcactgtgtgtggcatagtgcttgttgcgaaatcatgcagtaacgatgcatcaaggtaaaatatggccacgatatgcctctatttcaccttgaatataggtcataaccatcaatttccttgaattaaactctgctctcttgtagattgacattctggctgtccaaaacagttgtgctaagggagataattgcacaaactattggtatctcatgccaatcgtcttcaaccattacagccatcaacatgaatggtagtgcaaaaagtcttgatgggagaccgatgccaatgctatggacaaatagctccagtgggcaaacaaaccaaatttactggcatgcaggtaccggatgattggcatgaaacaagtacacttttgggtgcattggagaagattgaatcatggatattttctcggatagtagaaacagtgtggtggcaggtaaaagttagactatattcttgctgacacatgcatgaaactgagcatcccttgctccaaactggatgttctagttgagtgtttcacaaagaaatagctcgcaatgatattgttctgtgattatatctgatttctccatgttgtcaattttctgaagaacgtttgttgttcaggcactaactcctcacatgcaaactccggtggaaggatcgtcaaccccaaagactgggagagtgttaggtccttctttgggtgatcagcagcaaggcaccttttctgttaacctgtggaaggctgcatttcacgatgcattcaacagaatatgccccctccgtgctggtggacatgaatgtggctgtttaccagtattggcaaaattggtattctttgacatccttagcttgacaaaaagaaaagaaaaacatttcttactgaaaatattaatataaatgttatattcatgtgttttgtgaattatcaggtgatggagcaatgtgtaggccgtttagatgttgcaatgtttaatgcaatccttcgtgaatcggctagtgagatacccactgatcctatatctgacccaattgttgacccaaaagtcctgccgattccagctggtgatctaagctttgggtcaggcgctcagctgaagaattctgtatgtacttgattcagtaccttttaagtgctttctcagttttcctttatttactcacaatgatttatgcatgggaagctaaacttccgtgcataaactctagaatgcaaacgtgttgttttcttaccattgcacttaaaatagcaaatttatatgaaataaaatgcatatgcagatcggaaattggtcgagatggttaacagataactttggaatcgacgctgatgactcaaaggaggatggtaccgacacaggaagtgaaagaagtgcagctgaatcaaagtcttttcaactgcttaatgaattgagtgatctccttatgctcccaaaggacatgcttatagaaaaatctatcatgaaagaggttagtgctcatgcatatttcctgatgaataattgtactgttatctatctacctatctagcaatcagttgagctgtgtttaatactataacctctttgtcagatctgcccttcgattggcctcccgttagtaacaagaatcctatgcaacttcactcctgatgagttctgtcctgatcctgttcctagcatagtcctagaggagctgaattctgaggtgttgtttctgtcttgaggaaactttgtagtctagccttacaaaacttgttcccacaacgaagatgcatacagtgcaactttgtagttaacatgatacttgatgttatgcagagtttgctggagcgatgcaccgacaaaagtgcaaccagcgcatttccatgtatcgctgctcctgttgtgtaccgccctccatccctactggatgtggcagagaaagtggcggacactggtggcaatgcaaagctagacaggagagcgtcaatggtccagaggagaggatacaccagtgatgatgatctggatgacctggattctcccctcgcatcccttatcgacaaaagcgctccgcctttgctgtctaaaggtagcgcgcattttactgctcaaagaggagtttccatggagaatgccagatacacattcctgagagaggtatggttggagaggcagtgattggtgaacctgtacaaatccagaatctcttctttagctaccttaaaaagggttgggaaggaaaacctgctgaggtgaaacctttgagagaagttgctcacttgcagagctagttaactaaacaagaatggctactgtcaaaatgcaaacaatttcgtgtacattcatatacatatgttgttcgtttgtagtataatagaag

SEQ ID NO: 93365 - DNA, 1883 bp, Oryza sativa
attatgtggtagcaatagcatacaatctgactatttaattgaactatttaattgaacttgcagggatcagactcgaaaaatgaagaattttataagccgtctgtttcgtctgatagcacaccctcacatttgtcagttcattcctcaagtcaagataaggaagtggatggggaatctacagatgagggcaactctggatctccaggatcaaagaggaaagggaaacgaaagaagggtatttttgtatcccctacaaagagtgtggcaagggttaagcgttcagattgttggaagcttttcaaggttgtggatgttccatcaaaaacggagaaaggggtcactgagacgaaggccaaatgaaggttttgctataggctcattgcctataagaaaggtggtgctacttcaactctcaatcgccatataaagaagtgcacggcatatttgaacaaattaggcaggcagaaggctcaagctttgcttggctttaatcccgacatggcaggtgcctctctcattgctactctttttgattatgatcatgaggccactcgtaaaatcattgctaagatgataattgtccatgaatatccatttaggatggtagagcacctctggtttaatattttgatgaaatacatgaatgcagcataccaatttattggtaggaaaactattagaaaagagtgtgtggatgtttacaatacagaaaaagaggttcttaggaaagcttttaaaagtgttgatcatgtaaacttgacaactgatttatggacttcaaaccaaaatatttgctatatggcattggtagcttattacatagatgcaaattggaaaatgcagtgtcgtggactgaactttattgaattggatccaccacacactggagttgagatagctcaggccatctttgagggcaataatgaatgggatatagagattaggttatctcaattacccttgacaatgcttctaataatgatagggctgtggccaattaaaggaccagttcattggtaggggttcataagagttcatgcctcagtatttttatgtccgttgctgctcgcaaatagtgaatttgatagtgaatgatggcttggcaccattgggacctttgctagtaaccttcgagagacttgcaagtactttaagaagtctctttctcgtatgcatagatttagagaggtatgtaacaaaatggattgcctatggaaaaggtttgtgttttgatgtgccaacaaggtggagttcaacctataagatgctttgtgcttgtgagtttacaaaggatgcttttgttcaatatgcttatgtggatgctaaataccaatggcaacctttgcttgctgattggttagtcttttccaaaattcatccaatattgaaggcacttgctgaagtaactactgtattttctggatctacataccccacaacaaatgttttttatccaagcattgtgaatgtgaagagggcattgcttgctgcatctaagtctactaatagggacaaggttttgaagaatatggttgaagctatgttggaaaagtttgataaatattggaaagagaagaacaaacttatgatcattgccactacccttgatcctaggtttaagatgaggtatgtgagttggtgttttgttcaaatgtatggtgaggaagctggtcaagttgaggaaataagttgattaactctttgccacggctgaaacgacgcatcgccttgaaaaggctgcaagaaacaggggaagggatgaaacatccacttcaaccattgacacaagtaactcattagcttcagttaaatcttcaagtgagttctagatatttttgcaatctagctctgcaaatgtatctaagtcagaatggctaatctat

SEQ ID NO: 93366 - DNA, 1574 bp, Oryza sativa
tcaccgacgggaggaacggtgtcggcggcgagttggggataggaagggatggaaggcggagggtagcacgcgaccgagcggcggcgcacggcgaacgacgccgaggcggcgcggcgtcgaggcgtgtgcgccggggaaggagagatggagtgcggcgatggggcggcgcagagctcctcgtcgactcctcgtgcgcacgtcggcacgcgcgacggcggaggaagggcgacaatggcgcggcggcagagggaagtaaaacgggaagaaaagagggggagctcgggctgggttttataggtgaggaggagaggtcggtttagaggagggaaaccgaccttggcggttgagcgctcggctggcgctcggcgggcggtcacgagcgggagcggcgttttcgtgggctgcgcgaaacgtggcgacggcgaggatgcaaaggggcggtggaggcggtggatcgtgcggcgggaattgaatcacgggcgcgggagcatcggcgtggccggtcaaagttgggggcacaggcgtggcaggacgttgtcggcgtcctctgcttccgcgcgcaagaagacaagggcgagaggagagaggctgggtttagaagggaaaaagtgagggccgacggtggaaagggaagcctctcccttctgttttgggccgcgggcaggcgaggcgcgtgggagcggcgtctttgccagtcggccatgcgtgcgagaaacggcagcgcggttgggattttgggcggcgtcggcgggagtcaatgagagagaggagagagatagagggtgagagagagcgaggaagaaggagagagcgagtgcacacgcgcaacgcacgtgcgagggggaggaggaggagcggctgagaggagatgggctgaggagaaaacggcccacaaaaattcgagggggcaaaatagactttttcggaggagattaattcgaagagaatttgaacttggaatttgacttagatttcggaattgggatctggatgagaggaaggagtcgacggaggattcaagatggggttttggatattttggatctggggaagtattcggcgatgattcaaagagagggatagaatttcagagtttgatttggagacatgagtcggaagaggaatttcgaggaggcaatttttgatggtgacgagagggatcaaggacggatttgaattgagatcttggcacaacttagattcgcacacaaagaacggaaattttcgcatataaaattttgccgaattagtttttaacgtctcacgaaaagcggagcgttacaattatccggattatctacttatttacaaaaataaatcaaacatatttaaaaatagcattaaaatgttatatataagtagaagaaagtttttttaagaaaatatttttcaaagcgcaaaaacaaataatccaacgaatattttttttaaaaaacgaggcacgagtttttcttatattggggcaatttttgggttccttttgagttcttcaagactaaatggaacctccatgatacaccagtgattttcatgatacatcgatccccatatgataacaataaaaacatactcaa

SEQ ID NO: 93367 - DNA, 1544 bp, Oryza sativa
aaaagtacttgtacctcaagcttatagccaaatgatatatttttagatggaggtagtatgcatttttacttgcataatcatcttaattattagattcgtgcatacatatacttatctaccataacatgcctaatttttttgctgctgatgacgtaggaattctgcgcgaagcacaagaaggacatggccgacgagcaccccgtcatctcgtcagactccatgttcctcaaagccatccttccgacgctcaatgtctcaccgtcaaccccctaaccatcaccggcggcgccggttcaagcactgtcaccgcggcggccttcgctggcggaagctcttcacctgcaccacttcaagttctggttttccagcagcaatccactggcaacggcaacgtggaaattagcttcaacagcaatgcttcgcctatggccatgtaggcgccagccgataattctatgatatccttcaacaacatcactgctgcaccggtggccaatgcggtgatctccttcaacaactttgctcagtcgacagccgggcaagcgtcggcgacgatgggacatcatttgtcaggtggtgtccagcagctggatgctccctagcaaagggggccttctcctaccaaggccctttgccaccttccatgcgcacccacatcaacctgtttctaacggccttgccactgcagattgggatagccattgacaaaggcaaggctcctttgatcgagccttcatacggtatacccatggatgacttcctcgtcggacaaaagtgcatatgggggggccggaccatccatcgaagcccctgacgccccggccggtgggtacccctacatagatgcattgaccaataacgttgcagctggctctctcatggcgtcaccaatggagccaacgttcagcatcaccgagccaaccgtgttgacccagggtgagggatcagagacgaatgcggtagcaacaacacgtaacaacgccgcaccattaatggtacctgatcaagttactgctgatgctgcaatggatgctgaagaagacatcatgttttcactggagtctctccttgggctggactacgacatgctgcctatggaagacagcagcgccgccgaagccgctgccgctgatgattcagctggcatggacattggctgggacctcgacctgcatgatatcttggtggagaatgccaatgacttcgtgttcctggacagcattgccgggagcgagtagtcggtagtcatttcatagcaaataaattagctctagttaagttagagattagagagaggggatgtgaactctctatgataaaacaactttagtcttgttgcaagtactctgaacatcgatgatttttcctccaactgagcaatcactaattttgtgttatggtcacacatatatcgatggaggtaaaaaatactacaattgtttcaccagacacaaatgatctttttatattaaatgtgtccttcacatatcctaccctccctacacaacacacacaaccctaatacagggaaacaactaaatgtg

SEQ ID NO: 93368 - DNA, 752 bp, Oryza sativa
agtagctcatcatcctcaaggacattatgaatggcttgttatgccatgaggattaaaaaatgcaccagcaattttccaaaggaaaatgcagaatatatttaacgaaaaccaagaattcatattagtctacatagatgacctgttagtcttctcaaggacttacaaagaacatattgctcatcttgaaatattttttagaaaggtggaacaaaatgggttaatattatccaaaaagaaaatggaaatatgcaaagaaaaaattaacttccttggacatgaaataggagagggcaaaattcatttgcaagaacatattgctaagaaaattttagaatttcctgatgctatgaatgataaaaagaaattacaacaattcttagggcttgtaaattatgctagaaatcacatcaataatttagcaaagttagcaggaccgttatatgctaaattaagaaaaaatggtcagagatattttaattctgaagacatcaaattagtaagattaataaaagagagggtgaaagaattaaaacctctagaattaccattagaagagagttactttattattgaaactgatgcatcgcagcttggttggggtgctgtattaaaacaaaggcctactaaatattcatctaagtcagaagaaaaagttcgtaggtatgcttctggaagctataaattaaaaaccgtaggcaatacagatagagaaatacttgcaataatcaatgcgataaatgcctttaggttat

SEQ ID NO: 93369 - DNA, 3008 bp, Oryza sativa
ggggtgtatatgtatgctagtagctagctagcgcggcggcggctgcagggaggaggcagccatggaggacgaaggtctgacgacggcgtcggcgtcggagacggcgccgtcgtcgtcgtcggcgtcgagggcggtgtgggcgtggccgaaggcgcgggcgtggtccttgagggagcgcttgtgcttgaactcggagccgcagaggcagtaccagagcttgccgcagttcttctcgtgggtgcgccagtcgcccttgacggcgaaggccttgccgcacttgcggcagaggaagggcttgaggccgtgcttgcgcttgtagtgcgtctgcagcgtgcggaagtccttgagcggccgcgcccgcgggtggtcgatgttgttccggcaccccgccgcgcagcagtagcacggcagccgcagcatcgccgtcggctgcaccccgcgcagcgactccggccccttcctgtactgcgacccatgcccccacatatgcatctgcatccatgcattttttttcaacaagtttcattaatttccatctcgtttttttttctgatcgacatcaaaatgtatatattcaccaaatcaatactccctatgtcccataatataagggatttttgggtggatttgacatattgatctagtaaaataaatctaggcggtccgtctatccagattcattataatgtgtcacatctatccaaaatcccttatattatgggacagagggagtagtatatacaatgtaataaaaacaaattcagaagtttttttttataaagcttcatgtatatatatgggatgtcgatcgtcctctccaggtatgagaacacacttaattagatccctaacgatcgtatcattgcatgctcaatgtttcttactttatctaaaatcatatgctgatgagcattcatttcaaatgcatcaccttttggttatggttggtttgtttcaggaaatttagcaccattatttcacatttactcctactagtataaccaaaaagaacaaaaagaaggtgatgtatttcaaatgaatgttcatcagcatatgattcgagtaagtatattgcaggtatttaatgcaccactgcagctatagttgcattgctagcaatattcagctgcggcaaacctgagagaactactcgaactgaagctgctgcatgcatatgtcaattagtgcagctgctgctagctagtgtgtgatcttttgaaagtgagggctctactactccaggcagctatgccccctttgctagcttggcttgtgtgtttgttgtgttcaatgtgttggtgttgttcctttaaagagtgcagccagagtggcactgtgttggctgcatgcctacaggaagcacactgcagatctctcttgctgttcttgggagatgtgttcagcagcagcagcagctccataatcttatgctttccaaaccatgaaagcctgtcctgaaacaacccccatgcatatatctacccaaatcttatttgagccctgagtcctgagtgatcaggattcaggactactaggtgcatgatagcaagtgtagtactagtactagtacaagtagtaactacacctccagaaaggagtatatgtaatctgatgagatcagtggaagtgtactaagacagtgagagaagcaaagataaaatcttcactgggatctccactgcagcttggccactcatatgattctcccaaaagccagacaactcaaggagagaaaagcataaagattgcatgcatggtaagctctagctctacctctagctatagctgctcctggcatgccagtctagttcaatcacacaaaaggcagacaccactactgttgcatgctcctgtgagctcaagtctatttcatggcatgcatctgctctccaaagctagcagcttgctacccacctcctctgtactttaattgcaatcaacaaaatcatgaccaaccaatccttgcaaagttatcacaatcatattgtgtgtccaagaacaagaattaagatcaattattcagatgagatgtttctagctagtagtactagctataataagaatgtgattaagatgattattagctctgacctgcaaagttatcacaatcatattgtgtgtccaagaacaagaattaaacagcaatataagatcaatcatatattcaaatgagtagctaataagaatgtaattaagatgattattagctctgacctgcatgttattgtatctgttgaaggttttgaagcagacagggcaggagaactgggttgggccgatgaggatctgcgatggcgtcggaatccagtactgccctttgttcagcttcccgatcggcgtcgacgagaaccctagcggcaccacctcgtcgtcgccgccgctgccgccgccgtccaccttgcagtcctcctcctcctcctcgtgttcgacgccggcgccggtgagcccggagaggagatcggcctccgtgccgccggcaggcaggccgatgcgcagggcgaccgcggcgtcgatgtccgccgttgtcccggcgacctccacgtccatcgggtcgccgccgtcgttgtcgtcgccgcagcaggtggggatgcagttgaggtcggcgaagagcggcgcgcgcgcggcggcggcggcgggggtggccgtcgacccggccgccgccccctcctgatcctgcaggtggtggtagcagcagtcgccgtcgtcgtcgtcgtcggagtccgagtcagccgctgcgtcgacgacgccgccgcggcgcgccggcgtgggcgacagggacagcagcggcagcgcttcccgcagcggcggcgacggcggcgcctgatgctgctggtgcaccggcggcgggtggaagaatgcggccggcgggtactgatgatgatgatgcgcgccgacgccgacgccgacgccaccggcggtaggatacagggcagcgtaaggcggcggcagcggcggagggaggtgagcggcggcggcggcggcggcgggcgcggtggggaaggagctag

SEQ ID NO: 93370 - DNA, 1376 bp, Oryza sativa
acccgggaggttggtacattattaattgagttggtgaaatttgataccccagtcttttttccaccccaacttaaaaagaaataaaacacttaaggaattccaaaagatttcaaacaaaagatttaccaaaacaaccttgcctcttctttccaagcttgcatcaaacacctaaattcccgtgacttgctgagtacgaaagtactcacccttgctctatataaatatatatagttcctccgccctgaagagaagataaagtgaagtgaagattagggtttcgtcctggttcccagccgtcgcctgtggtgttgggtgttagtccgttggttccgctgctgctgctgttgttggtgttttcctcgtccgcgtcgtcggttgcattctcgggctgttctgagctgcaacctaagttaaggtaaataagtcctttatttattttaaggattgcaatgattcatatttttcatcgtgggtaccagcactatgtcctgggactggtactgtaatcgcggattcgtaagaagcggttcacgccgttttttctacgacacgctcctgtcaggtgccgttgtatggcagtgccgaattggggtgtgacaataatctactgaacagtctatcaaatggacatgatctttgcaccaccaaacctactatgtggcatccacaattcgacatgccacctcccctccaagcggccgtactcgattcatttttgcttaatatcatatcacacattaaatattctctctatcaaaaaaaagtcgaactctagggatgaatttaaacatggtaatgcatccctagagttggactcatttcgagatatagggagtagtttggaagtaagttggaataatatacttaatttaaagtgcgatgtgcaggcttagtccatggcgtgcactaattgaggcccaatcatttatcctcttcagattgcatcatgtactgtgacgagttctttaacttcatccgcgttacgttgagagtcaactgtcgaggtcaacgctcgattcaccatttagcaaatcgcattcaagtcaatttgctgtttcagtcgtatatagtgtgacaaatcagatgcaacgcaacattaattaattagcaattactgataattaatcacagtaactttttcagcagcaaaaaaagtttcaaagcatagtctacactgtacaccatattatatgacaccaaccaaaccggcgagcttgctgcgaggctgcatgccacagatgaaagctccatcgcggggaggacaacgacgaccgtgtccaagtccactcatgcctggcaatctcttttaccctacgcgattgcatcttgcatcaagaactcgatcgatctgatatatattactatgagctaagctg

SEQ ID NO: 93371 - DNA, 2818 bp, Oryza sativa
taaagaggatctttagtcccggttcaaaagggtaacgggcatatttgatctttagtcccggttcgaatgctgtcagggcatgtcaggccccccgggatctttagtcccggatggtaccaaccgggactaaagatcgtaactttagtcccggttagtattaccaaccggggctaaagatcctggtgatctttagccccggttggtgctaccaaccgagactaaagtcccacccctatatatatatatatatgtcttcttcctcctccagctgcccgagcaagcttcaaaatttcttcaaaaaagaggggaggtcatgccaaaatttttattgaatttattttggtgattacatacaaatcggaggtgcctaaaaggtttgcaacttcatcctccaatgttttttttttgtcatactacatttgcacctatgtttttgcacacttttttgtctccaaaatttagttgtaagttgatgagagagaaaatgtgtgtggggaagaaagaatatatagaaatttagttcatttgctaaataaggttttataaaatagttgagaaggaaaactctagtgaaagttaatctttaataatagaaaaaaaaacttaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttatgtacggtttttttttgactcatatagatggatcggcaatggatgtacgctgaccggcggtctaaggagtttattgacggtgtgcactattttttgagagtggccgaagctaacaggtaaaggggttttatttgttgtccatgcaataagtgtaagaatcagaaggagtattctgcatccaggactattcatttccacttgtttgagtcggggttcatgccaagctataattgttggacatccccacggaagcaagggggttgaaatggagaaatattaagtgaaagacaacaatattccggactttgctcatattttggatttgaaaaaatcaaacggccaggaggaatagcttgtgatggtaacacgttgcggatgatcttggtcaaatgttgcaggatgccagggaggactgcgaaagtgaaaaggaggcccataaattggacaagatgttggagaaccacaaaacttcgttgtacccaggttgtgagcaggggcacaaaaagttagataccactctggagttcttgcaatggaaggcaaaaaatggggttagtgacaaggcatttggcgatttattgaaacccgtcaagaacattcttccggggggaaacaaattgcccgagacaacgtacgaggctaagaagatagtctgccgttaggactggaagttcataagattcacgcatgtccgaacgattgtatcctatatcacggtgaggagtatgagaacctaaaagcatgccctttttgcaaagcactacgatacaagattagacgagacgatccagaagaagttgacgggcagctaacaaagaagagaatacctgctaaggtaatgtggtatttccctataataccacggctaaggcgtttgttcaggaacaaggggaatgctagaatgttgcgatggcacgctgaagagcgtcaacaggacaggatgctgagacaccccgccgatggttcgcagtggcgaaacatcgacagaaaatttaaagaatttggaaaggacacacgaaacgtacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaccctggtaacgacatcgatgtgtacctaagaccactggtcgaagatcttaaacagttgtggaagaaggaaggtgtccccgtgtgggacgaggacaaccaggaggagtttaacctacgagcgctgctgttcgtaaccatcaacgattggcctgcacttagcaacctattcggacagtccaacaaggggtacaaggcttgcactcactgtatggatgaaacagaaagtacgtatcttaagcactgtaggaaggttgtatagatgggtcatcgtcgattccttgcagcaaaccacccggtacggaagaaaggcaagcacttcgaacataaggcccaccaccgtacgaagcctaaatatcgcagcgggaaaacagtgtttgctatggttaaagatcttaaagtagtgttcggaaaggggcctggaagccagcctatagagagcgaagatggtcacgcgacgatgtggaaaaagaactctatattttgggagttaccatattgggaattcttggacatacgccacgcaatcgacgtgatgcacctcactaagaacctttgcgtaaaccttcttggcttcctaggtgtatacggaaagtcgaaagatacactagaagcacgtaatgatctgaagcatatggaacaacgcggcgaccttcacccggaaccaaaggagaaaggaagccattacttgagtccagccagctacactcttagcaaggcagagaagggaagtatgtttgaatgcttggagagcataaaggtaccgtctggatactccacgaatatcaagcgaataataagcacgaaggagaagaagttcacaagcctaaagtctcatgactgtcacgtgttgatgacacaactggtaccagttgta

SEQ ID NO: 93372 - DNA, 1136 bp, Oryza sativa
tatgtcataagatccagtgagacagtgagcccggtacttcaatgaggtgttgaaagctttatgttgtcttgctaaagatatgatacaaattaggtcaatagagacccttcaaagatagttagtaatcctggtagattctacccatattttgaggtatctcacgtgaaatatacttattcaacattctaattaatgtaaccactttatgtttgtatagtaataatttcttctaacttaggattgcatcggggcattggatggcacacacatccctgcatttgtcccagagaatatagttaacaggtttagaggtcgcaagtcctatccaactcagaatgttcttgctgcggttgactttgatttgaggtttacctatgttcttgttggatgggagggttccgcacatgactcagtggttctcaaggctgctcttagaagatcaagtggaattcaaatacctgaaggtgtgcatgaagctttagtattttcaggtgcacaatattttgtgacaaggcaataaaaccattcatcttctgttgtaggcaaatactatttagctgatgcagggtatgcagcaagacctggtatactaccaccatttaggggtgttcgataccacctgaaagagtacgaaggcgggaaatcaccagaaacacctcaagaattattcaatcttcgacattcctcccttcgcacatctgttgagagagcatttggaaccttaaaaaaccgtttcaaagttcttgctagcaagcctttctttccatataaagtccaagtgaagatagtaatagcgtgttgtgtactgcataattggatccttgataatggtcctgataacatcatatatgatgaagctcgttggtatagtaagctacctagatcagctagagtagcgacagattatggcgaggagcaccaacagtggatagaatttcgagaaaatctagctaatattatgtgggaggaacattaacagtggtgttgtatggcatggatattgttctatgactgttagctatttctaatgaattcttctttcagctcttcatattatagcattttctactttatgtttttttgttggatgccattattacctactgtgcattgctttgtagttcataacatggata

SEQ ID NO: 93373 - DNA, 1157 bp, Oryza sativa
cgggcggctagggcgcggcccgagagaagaagcgcggctcggccgagctaatgggccggccggcccaagaggactcggcccagcagggcgcgcgggaggggaggagagagggagccggtggaccgggctcacctcgcgtggtcccgagtgggacccgcttgtcggtgacacggttcaccgtgtggagcgagcacgcggcgcgcgctagggttcggggagagagacgcggtgcacgcgcgcggttcgcggaggacgcggtgcggcgggcccacgtgcagcctcacggctcgcggtggaccgcgcgcgcgagggaggggaaacggagggagcggttggccgggtcagctgatccgggcgcggccgaggtggtgccgactggcgcctacgtggcagccacgcgggccggcgggaggttgaagaagacgccggccggaacggacggcggacggcggctacgaaaggcggggcgaaccacggcgatacaggcgaaagcgagcacaccgggtggttgttcgagacgaggggagacgagccaacggctcggattcaccggagggagctcgacggcagcgaattgcggcagcggcaaccggcggagagaaaaggggaaaacggcgacgaggtcacgaggggccgattcccggcggtgagagcatctacgcggctacgggaatccgttgctagcgccggattaggaggaaacgcatcgagggaggccggcgacgagaggcgcttccgagctcgggcggcgacagcggcgagcacacggcgagcgacggcagcagtcggggcggcgccggctagctacggggagggtactcgtgctactacccgagtctaaggggaggagatggatcgaggaggaagaacggagggaggcactaccgagcggacggggcgcagtgacgatgggccgacggcacgggagtgatctctccggccctcggctggggaagaggaagaagagggcgcgcccggagtccccttccgtgcccttgctcgtgccggctcctccgacacgcgcaacgacgaacggcgacggcgaacagagcacgggaggcggcgacaatggagtggaggcgatgggacaacgagaggagaagagagggagggcgcctgggctttataggatggcaatgtcggtttgggagagggga

SEQ ID NO: 93374 - DNA, 716 bp, Oryza sativa
gggtggattgtcatggaaaaaatatatagattttgatgaagctttaactcacgccagaaaaatattaggaataaactactacttggaaccagcagcaaaagaatatatacaaaaatgcaaaaaagccaaaaataagaaagctccagagaacccatattgttcaaatattaagaatgaaggatcatcccaaaaacctacgtataaggaatgcttgactaagggagtagatcctttggatggcgaatatatcgattggaaaataattgaaaaatttgaagaagcatccccccaaattaaaaaagaattgaaagaagaaatacttaaagaattaaagaaagaaatgaatgataaatttgaagaaatgaaaaaagcatatgatgaaaaatttgaagtctccttttctgatgtagatactatggatttaggtggtcatgggcagcctgaccaataaagcaatataatataaattgataataaatatccattctttgggcgaatgaccaaagtatgaattgaatttgaatcaatccaaaatgcaaggacagtgaatgacattgactgttaaaaatactgtggagaatattgctttcggcggaaaagaaaggcgcaggtacagaggtgtctccaccttggccaattcaaggacaaagtaagccaaaaagaagataagcatctccatggtgcgagccagctcgtgaaaatacagtatctagaag

SEQ ID NO: 93375 - DNA, 841 bp, Oryza sativa
acctttcccaatggaaaattttttgcaaccaaaaagtttttaaccctatcaaaccaagccataggagcttgtttcaaaccatacaaagctttaaacaatttaaaaacatggttggaaaaatcaggattttgaaaacctggtggttgtttgacataaacttcctcctatataaaaccatttagaaaagcacttttcacatccatttgatacaatttaaaaccttttgaagcagcaaaagccaacaaaaatctaattgcttcaattctagcaatatgagcaaaagtttcatcaaaatccaaccctcaacttgagtaaaaccttgagcaacaagtctagctttatttctcacaatcaaaccatcctcattttgtttatttttgaaaacccacttggttccaataatattatgtctagaaggtggttcaactaaagtccaaactttgtttctctcaaaattttcaagttcttcatgcatggcgttaatccacgattcatcagttaatgcatgtgacacatctttgggttcaaaagaagcaacaaatgcagaatttgcacaaacatcatgagtcgttaccttagaccttgtagtccgctcacctatattaccaataatttgttccggcggatgtcgtcgttgaatgtgcaaaggagcagcgacttctgaagttgatccacgttctgtatcagtactggtcgaagtagtaatctctggaggaccatctcgaacagcatcaacagaaccctcagccgacgaccctggccggtctgaccgcacctcctgtgccggtctgaccggaggtgtgccggcggtctgaccggccgagccgacctcatcgccgtc

SEQ ID NO: 93376 - DNA, 5886 bp, Oryza sativa
aagttctgctgattgtggaaatatttttgctacattatcaactatgccgcttctttctagcttgcttctttctgcaagagatgagaatgaaccactttgctttgaggctctccagcccatgtccaaagaactccacaggtcaattatcagagggcaatgggccaagggcacattggactacccgatatttcttagccacactacacatctcaagtacttagctctaagttggtgtaatcttggggaagatccactggggatgctcgcatcacacttgtcaaacctcacttatctaagactgaacaacatgcacagttcgaaaactttggttcttgatgcagaggcgttcccccacctgaagactcttgtgttaatgcacatgcctgatgtcaaccagataaacatcacggatggcgcccttccatgcattgaaggtttatacattgtatcattgtggaagctggataaagtccctcaaggcattgaatcccttgcctccctgaagaagctctggttgaaggacctgcacaaagacttcaagactcaatggaaaggtgacgggatgcaccagaagatgctgcatgttgcagaggtccgtatatagatgttgcagattggctctttctacattagtattctttcttaaagtctgtctgcgtgcaagtacatcacacatttagttctttccagtaatttgtcagatttgcatatgtatggtcggtattgttttctttggtaacatgtcatgcttgattttttttcctaaaggaggcccccataatttatgtgttgtttcaattgccttcagatttatttcatgtaagaatcatgtcccatttttatcaacggcatcttcctgtggtgttatcaacgttggaacctccttgttctcgtctgataacagggcttcgcggctgttttaatcgagctccatgcctagtgtggtctgtactggggttggctttggtgcagacatgcagtgcaccggcgtgagcccatatcgcattctcagttgtagtgtggtaattaataatgctgcatgttgtctccattttatttcttggaaaaatacaggttccaatgtattgattttgctaaagatctctagatgtgtaacaaactagagtcattcaaattcaggattttgattagagtaaaatacaccagcggtccttaaacttgtcaggaggtcttacttagatccacgaacttgcaaatgtgatggccatccactttctcttgttagtgtggccaattttttgagaagggttaacagtctgacggaaagcagcgacgacatttgccaccgattaggttctcaggttgagaaggcacctgcattccaagaattgcgggaagttcttatgagtaactatggcaatctgtctgatcatcttgtcaagacatgcctgctatacatgagtgtattcccaaagggttttgagatcaggagaaacagtctagccaggagatgggtagctgaaggatatgcacagtctgtgggtaaattcacagacgaaacggtggcacatcaaaacttcaagaaactgcttgaccagaatatcatcgagccgatgggtgcatgcgacaatgcaagagtgaagacatgcagaactaatgctgtcatgcgcgagttcatgctgcacagatccttctgtgatcacttcatcgggtctcttgatacaatgtcagagtcagatgacccaagtacctttcgtcatctcttcatccagaattgcacaaatatcaacatcctcaggttggccaagaagaaacttcgtgcccgttctctgacaatctttgggagtggaggaggaggagctgtttcttgtatgagagatgctccggtgctttctactcgtagtattatactaccagtagaactaatctgaaccgtttatttttttagggtagattagtataagacagatttggggtagatttgacacttaatttatttctccgtgtgggtctcgtggttagcgtcgctcggaatcctcatctatctcaatcgagcggaggtggagagcgtgactccttccgccggcgcctcgactccttctgccggcggcgcttgtgcattccgttcccttccgccaacggcggaactctccggcgcccctctccttccgttccccttctctgctggcgtctagccgcttccccaccggcctgcgcgcaggagcttctgctgtgggatgtttttctgttcatgattttgtatgggttgcgttttgcctgaattctggtgtgaactgaacagagaagggaaaacgttagttggaaatttatctgaaatgctgtagttcgtttcatagatatatggactaatccatgttagtactgaagaccaactgatcatcaattgtttggtttagttttcaacagtaactgatccttctgtttgtctctgtctgtttggttaattgaccctactccctgcatccctgcatgtatctgaattcttctggatatgaagcaactcgtttcaaatatggatgtggatttaataccctagtatgtcacaatgtgttgaattcttctgcatctgtggcattccgtttcagagatgaatgggcttatctgaagaatcatgcttttaacttgcagggctagttgaactgttggatcgcttgcataaagtaaatattttgcccccaagctgccactcttatacttcctccgtttctaaatatttgacatcgttgactttttaatacatgtttgaccgttcgtcttattgaaaaacttttgtgaaatatgtaaaactatatgtatacatataagtatatttaacaatgaatcaaatgataggaaaagaattaatcattacttaaattttttgaataagacaaacggtcaaacatattaaaaaagtcaacggcgttaaatatttagaaattgagggagtatatttaagtgaaatcccaagctgctaagttgccattcttatatatttaattgaaatcccactcctatgtactcttatgtagcaaaaccgttttactgtagacttgttcgatggtcgcaaaatgcattgacagtgatatgctatcaaccataaactctggacagaaagttaattagggttgatcaaagaatagtttgtcaggttttgctgctatcatgcttcttcagcaagctctcccttggtctgttcaatggtatatgcaaccaacttcgtatgtgtcagaaaagatgcaaagcaaaatgctcaattcagtagattgtcgacaagatttttgacgacatcgagcaatggagcagctgcgggcaaatgtgctggtgcatttctctcagagagctagataaacgttggaggcggcggaggcgagtgcgtcgggaggcggcagacgagggcgagggtggcggagcaggcgaggtcggctgaggcggcggaagggaggagtcgcgagggaggttctctcggcatgggctccagatgcaggcgtcagttccagaacgaaagaagatagggtagctattgttataaagtgaaagtgacgattatacccctccgtaaataattttatgtagacaaaagtacccctccataattctactaccattaagtgaggtggtagtagagatagatctgaacccttcgatcaaataagatcaacggttcagatttttttctactataagtagaaagcaccggagtgagacttttcttgtattgccgagtgtgaactgttgcaggccttagatctaaaagaatgcaatgattttgatgataatcgtgtcaagggcatcatgaaggacaatctcagtcgtctaaaatatctgagcctcggaagcgctactacgaaacttccaaaggcgattgagaacctacagtgtttacatacactcgaattaagaaagacaaatgtagtggcactgcctatagtagtcataaagctgccccatctagttcacctgtttgggaaggtcaagctcaggaaaaagaggagtattcatgcggtgcaggtaatagatgatatcatctcaaacaaaaaaagtatcggacaaaagagtaagctgcagactctatcaggatttatcatagacaaagactctataattccgcaactgatggttcatatgaggggactgagaaaggtcaagatatggtgtgattattccactggtgaaggtaacactatccacctcaaggaggctattgaaaatatggttatgtacgaaatggacacaggtgttggcgttcgttctctgtcactgtacctcggaaatgccttggagaatcttcttggtcttctaggtgaaacaaatggttttcttaccactctgaaactgcacggcagactgagccaatttcccaagtttgttacgtcgcttacaggcatcaaagagttgtgcctttcatcaactaatctaactgggagtgatttatcaggatcaggcctgggtgatctaccctgcttgctttatctcaaactggtagaatacaaccttgtgggcttcgtcattaaaaaaggggattacccagtcctgcagcgcctatgtctagtggtggagagtcctaatcctatcctacctaaaatcgaagaggaagctttgccagaacttgtttcacttcacctgctttgtgtgcgccttggtgatcttgctggcattaatattagaaaccacacaaatctccaggaagttgctcttgattcagctatcagtatggaaaccataattacttgggaaaatgaagctcggaagcacccaaaaagacccaaggttttgttcttcaaaagggttggcacacccaacactgggtgtacggtaaagtatactgcgaccgagaggcctaaaacacctgagagcacggggcccggtgaatcgatggaaatagataattaaggtcctctccgtctctgactgatcgagctgctaaatgctcgccatgttcttcaaggtcagtattattactcttatcatcgagtattattatcctgattattagtgcgctctacatacatcgagtaaattgttatctacatgctaggaacatgtagagcgcaatttactttgcaaatgaaaaatgtcagggtttttttatcctgcaccttttgtattgtacctttattttatattacaagtctctttgactttttctttagttaaactttttaaatctgaccaaattatagagaaatataacaatattttcaacactaaacaaatatgttatcaaaatatactcaatattaaatttaatgaaatttatttggtgttgtaaatgttgctaaattttcctatatttctagttaaacctaaaaaggttttactaagaaaaaaatcaaaacgatatataatataaaacggatagagtatttgggcctgtttgggggagctttagattctgagaagcagctgattgatagccagcttctgagaatctggaaaagctctgaaacccagcttctccagcttctagcttcttagttcatatttcagaatctgtaactacagattctcagaagctgtggcctgtttggaacagcttctagtagaaacagcttttgggaaaagctgcagctgggacaaactcccccaaacagggcctttgtcttggcaccgtcgctggttgcaacttgcaaggttgtattcttctcgtagaattttaacatgacgttcatttccattttacagcatgtcgatcgtaaagctgttgttccgcaggagctgtaagatcggcgcccgaccaccgtctgttgaatttccatatttactacagtgaaccatgtcgtgtgtgatgtgtcaagtttccttacagaatgagtaactttcgtattcatattatcatgtcggcctgctacaaaaataaaatcagaacaaatgatgatttgtggtgtgtctatcaactatagccgagtagaaaacgctggtttg

SEQ ID NO: 93377 - DNA, 2896 bp, Oryza sativa
cacgtgatatctgctaaaggagttgctgtggaccccgaaacggtgaccgccgtcactgattggaagccacccaagacagtcactcaagtccgcagtttcttaggtttggcaggatactaccggaggtttatcgagaacttctccaaaatcgctcgacccatgacacagttgttgaagaaagaagagaaatttgtgtggagcccgcaatgcgagaaggcgttcagaactctcaaagaaaagctggttgcctcgccagtgttaatcttgtcggatactcgtaaggacttcatagtgtattgtgacgcttcgcgccaaggattggggtgcgtgctcatgcaggacggtcatgtggtggcctatgcctcacgccagcttcggcctcatgaaggcaactaccctacccatgatttggagttagccgctgtggttcatgctctaaaaatctggcggcactatctcattgggaatcgctgcgaaatatatactgatcataagagtttgaaatacatcttcactcagtcggacctgaatcttcggcagaggagatggttagaactcatcaaggattatgatgtgggaattcattatcaccccggtaaggccaacgtggtggccgacgctctaagtcgaaagagccattgcaacactcttaacgtccgtggcattccacccgaacttaatcaacagatggaagccctgaacctaagcatagttagtcgtggattcttggctgcgttggaagccaagcctaccttgctcgatcaaatccgcgaggctcagaagaatgatccggacatgcatggactcctcaggaatatgaaacagggtaaagccgctggtttcacagaggatgaacacggaaccctatggaacggaaatcgggtatgcgttccagataacagagaacttaaacagctgatacttcaggaagctcacgaaagtccttattccatccaccctggcagtacgaagatgtacttagacttgaaggagaaatactggtgggtcagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggactcccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaatttcagcaccgcgtatcacccgcagacagatggacagaccgagcgtcaaaatcagatcctagaagatatgcttcgcgcatgtgtcctagatttcgggaagacctaggataagagtctcccctatgccgagttctcctacaataacagctatcaagccagcatacaaatggcaccctacgaagcgttgtatgggcgcaagtgccggccaccgctattgtgggatcaagttggggaaagccaagtgttcgggactgatatcctgagagaagctgaagctaaagtcagaaccattcgggataatctaaaggtggcacggtctcggcagaaaagttatgcagataaccgtcgccgtgacctggaattcgcagtgggtgactttgtgtatcttcgggtcacgccattgcggggtgtacacaggtttcagacaaaagggaagctcgcacctcgattcgtgggtcctttccgtatcactgctcggcgcggagaagtcgcctaccagttggagctgcccgcctccttgggcaatgtgcatgatgtgttccatgtgtcgcaactcaagaaatgccttcgagtgccatccgagcaggccgactcagagcagattgaagttcgcgaagacttgacctacgtggagaggccagtgaaaatcctggacaccatggagcgcaggaccaggaaccgggtaatccgtttttgcaaggtccagagagcaaccacgccgaggaagaagctacctgggagcgtgaagacgagctgaaggcagcccatcccgatctcttcgccagtccttccgaatctcggggtcgagattccgtttaaggggggtaggtttgtcgcgtcccaaaacgactctaaaatacatcctcgaaattgtgcatagaataattaaaattcatgtgaaagcctccaacaattaaaatgtgctaagttaaaagtcaaataaggcttggaggatttttgtatatttcctaaaagcctaaaatgcgtaaataaattttagtggaattttcagagcacaaataataattaagaagaaataaacaaagttaaaatggttttataaaaagaaaaaccctaaaaaatctttttccccccccccttcccctcttgggccggctcggcccagctccctccctctctctcctctcccccgcggcccatccggccttcccccgcgcgcgcgccgctgacgggcgggcccgcccgccaccctcgctgacgggtggggcccacccgtcatcccctacctcgcgccgctcccgccgcctcgcccatgccctagcgccgccgccgccgcggattccgccgcatcccgccgtccccgcgcgcaataaagagggggaaatcactccccgtgattccctctccctttccccccacttttccctctctctctccctcggattcgtttggaatcactcccgcaaacttcgccggcgcatcaatggcggccggatcttccgcggccgaatccccctcatcagaccgctctctccccctcc

SEQ ID NO: 93378 - DNA, 2391 bp, Oryza sativa
gttcgtcgtctgtcaacttaccgatggaaagacagtactgcaccaattctcaaacttctacgtcttcgaaccatagtatcactgaagcattttcatcttccattgatatgttgtcctcagttttgtctcactcaagctaccttactgttctcgagcttcaagattcagaaatcactcaagttccaccatctatagggaatttgtttaatctacgttacattggcttacggaggaccaaggttaagtcactcccagactccattgaaaagttgctgaacctccacactctggacatgaagcaaacaaagatagagaagctaccacgaggaatcactaaaatcaagaagctaagacacttgtttgctgatagatgtgttgacgagaagcagtcggagttccgatactttgtaggaatgcaggcacctaaagatctatccaacctgaaagaactacaaactctggagactgttgaagccagcaaggacttagctgagcagttgaagaaactcatacaactaaaaagtgtatggattgacaacataagctctgctgattgtgataatatttttgctacactgtcaaatatgccgctactttccagtttgcttctttctgcaaggaatgagaatgagccactttcttttgaggctctcaagccaagttccacagaactccacaggttaattgtcagagggcaatgggccaagagtacattggactacccgatattccgtagccacagtacacatctcaaatatttatccctaagttggtgtcatctcggggaagatccattggggatgcttgcgtcgaacttgtcggacctcacttatctaaaactgaacaacatgcagagtgcagcaacattagttcttcgtgcaaaggcattccccaaactaaagactcttgtcttgaggcagatgcctgatgtcaagcagataaagatcatggatggcgcccttccatgcattgaatgtttgtacattgtgttgctgccgaagctggacaaggtccctcaaggcattgagtcccttaactccctgaagaagctctccctgttgaacctgcataaagacttcaaaatccaatggaatggtaatgagatgcacaagaagatgctgcatgttgcagaaatctgtgtctagaagttgcatgctttatttaccttaaagaggctctttgtaattttgtagcacccttgaatttttcatttatttaaaaatcttgtcatttaaacattttgagtataaatttggttcttatttgattttgtgccaaataggtctcaaatcctctcttagaaatcccctcgagttgttgtcaaaaccctaggacaaaattcaaattagattcctccaaaaactccccaaaatttcaaattccaaatcctagagaaaatgtgaaaggtcaaaggtcactattcatttgggcctctttttttcctttttcttccctcagcccaactccctttcctctcctctctctccccgagcaggccggcccatggccttcccgcaccggcccagcccaccgctgtttgtcttcctcctccgaccggtcgcgcgcgcgcaccacatgttcgacgaaatgtctcgcccgagcactgagtcgtggcagtgctgcgtcgcaccgagccgccctcccatgcgccgcgcgccgtgccaggaccgcatcgcgccaaagccgcgccctgccaagccgcatatcccagtgggaatcacatcccatccctcgctccggtttctctccgggagacacggcgccgcgtcgtcccgtcgccacctcctcgtgacgccacgccgtcctatcccgggctcccgcggacgcgcgccctctccacttgtcacaccgcgccttgtcgcccgtctcctaccgggaagccgccgagcccgcgcctatctctctctctcgcgtcgcgttgccaccaccgcatgacgccgctcgcgtcccctcgctctgagaagaaccctaccgctcgattcccggccgtagccgccgtccgtcgcgcgtcaccattatcccgtcgccaaacccgctccccgcgcgtcacctcgcgttccatcgccgcttcccatgacgtcgcgccgtcaccatcgtcatcacgtcgccgcgccaccgcatcgtcatccgctcgccgtagcagctagccggctatgcccggactcgcggtgcctagccgccagatcgccgcgtcccgccaagctcacgccgccaataagaggagagccgagccccatcctcaccacgccatccccatctcttctctttctctcctctctttttgccgccgctcgagcccccgcacttgccctcccaagcggaagaagatacggcactcgtcatcgccatatcttgtcctaggtggtgccggcttaggaaagggagggtggt

SEQ ID NO: 93379 - DNA, 5837 bp, Oryza sativa
accgacggttccttgcctcagctgaaagtagtatccattcttggatgtgcaggtgtgggcaagactgcgcttgccaaacaagtgttctgcgaacttcgagggcgattcgagtgtcgagcttttgtgcaggtctcaaggatgccagataccaaaaggcttcttcgaagcatgctctcacaatttcgacgccataatcgactaccggctgatcgctgcacagtgcaagaccttattgacaacattcgtgatcatattcaagataagaggtatgctaagataagaggtatgctaagtttaaaagattcgtctcgcaatttacacgcaatctatgtaattagttattttttcgtttatatttaatactccatgcatgtgtccaaacattcaatatgacagggtgaaaaattttgccagcggatctaaatagggcctaataattgctaaactaagcaacaccatttttctcttatattttgtagtttagtcattgggccaccggcccaccatggcaaataaccgagttagcatgctacatagacaaaaatgctctgcgaaacatctcaaagtttaatgggttcaatatccagcctaataggtcggggattctagatggaccctttactatgttagcatgataaattttgaaattatttggcaggtatttcattgtaattgatgatttatgggaaacaacatcttgggatatcattaacagtgcttttcccaagggacaggactgtagtagaatattaatgacaacaactattgaggatgtagctctagagtgctgtgattatcaatctgacgatatctgtaagatgaagcctcttagcagagatgactctctaaacttgttcttgaacagtgcattcggctctgaacaaaattgttctgaacggttgagggaagtttcaactgaaattgtcagaaattgtggtgggctgccactaggaattatcaatatagccagacttttggcgagcgaagtggacaacttggagctatggcaccatgtgcagaaacatttattttctagtatggcaacaaatcacacttcagaagacaagctcagaaatatagtccgcctttgctacagatgtcttccctgtcgtttgaagacctgtctgcaatatcttacaatgtatccagaggggtgcataatctggaaggccgatttggtaaaacaatggactgctgaagattttatcagggaaacagaaagggaagatgccaatgcagtagcagatagctattttgatgagcttgtcagcaggggaatgatgcaacctaataacagaacctacagtgacatggtgttgtcttgtacagtccatcacatggtatttgatgttgtcaaggacatgtctgttgaagagaacttcaccactgcattagattactctcaacctattacaagacttaatttcaaggtccgtcgattgtctctccatgtcagcaataccaaatatgcaacaaaaccggtgcacatatcactgtcacaagctcggtcactcaacttctatggactagctgagtgtctgccttcgactttgcagttcaagcaacttagagttctaatacttgaattttgggatgatcaagaggagtttgatctcagaggaattttcagattgttacaactgagatacgtgcaggttacaactgatatgatcgttaagctaccagccaccgtacagagcctacaatatttggaaacactgcaactaaatgcaagagtagcgaatgttccatcggatattgttcatctcccgaaattattgcacttacgtcttcgagatgtggcaaatctgcctgacaacattggctgcatggcatctctatgcacgctagagtcattagacctcagcaataactctgaacaaaatgtgtggggtcttggagagatgacgaacctgcaagaactttatctcaactgctctacagaattgtctggccgcctgaagagaaatcttaccgctctagcttcttctctagggaaacttcgtaaactaagaactcttattctggctccttcttcaggcacgagcatgtacatggattgctcgagcatcgtttcatctccgcccctctgtcttcagagacttgagttattacctaccatttgcatcttttccagactgcccaaatggatcggacagttaaagagactccgcattctgaaaattgttgttagagaactgctatgcagtgatgttcatagcctcacaatgttacaggagctcactgttctctcattggatgtccagcaatccactgaagaaacaattgtctttaacgacaaggcattcccagttctcaagtatttcaaattcagatgtggtgtgctgcgtcttgcttttcaggcggaggcaatgccaaatctccggaagctcaagatagaattcaatgtccacaggggggaacagtatggtgatattcttaccggcattgaacacctgttgaaccttcaagagatcattggacaaattggagctgctgcgggtgcagaggaatctgacaagagagccgctgagtttgcgttaagtgatgccactaagaagcattcgaggatttctagattcaacatacgatggattaattgtgttgaagaagagtaagagcttctcctttcctccaataactgattttgagttttgaaataaattacagtcctctgggtagtagcaataagtattagaatatagaacataccaaaatttcatattaccaattggggacgtttcaacttataattactagtgcatcagctattgatatcaagttcgtttgtgtaaattaatttatttacaaagtataaattaaatacaaacaattattgaaaactggttaaacaatcacagtctagatcaatggtttgcttattgaacatataatcgtatttgctatataatatgtaagttttatttctgaagtacaattggatttatcataccgatataatacaaatatattaaaaatcataccaatctaaactataacctgtctgaaaatcaatggtgtatacatttctcttttgtttgataaatgttgtgatctctaatcctacaaaaaaatatggtgatctgtagctttcacaaagaatgtggtggattcttttcacctagttttaataatattagttccctatgaacatgttcatacaaataaactttaattctaaacttttttgtatattggtacaaatacagataaattaactattcttttaatagtaattgtaaaatctagaaaattaaattaatttaattattagatcaatagttcaaaattgggaattccaaggaaaacttagttatatgaggacacaatgcaaaaaaaaattgttatatgaaaatgtaattttttcttgttgcctctggctttaattgaatttactggtctgctagtgtcagggtttccaagatttcagatttacaaggaatatcttcaagttcaggtactctactttagtccccactatgtattttgttatataagaaaactatcacacaaataagttaatagttcatggatttaacattggtctccatctctttatcgtgttttaaagaggatacctgtgggtgtgtgtatgtggtggtacacacatgaatcttccatttaatacatgtaatcgaaaagcaagaattcatagtgattgatgtggctaacttgtctcgcgtgtctagagagaacttattaaattgctttaaaccaaaatttacttctatacaagtttagatatttataaagaaaacaaataaataaacactgtttcatattaggaaagttctttttttgtgaaaataatactaggaagttgacaacaggactattagttcaaaacccttgtaaacattttcttctttgaaagcacaaacacattttttttagcttttatatgatttctaatataatatgtagtaatataatgagaaaaatcgttgtgatccatatcattattacatgcttttttcattcactggaaccagaatattaggttttgatatgttaacatgtatttaacttactagacaaaaacctattatataggagtaaatttagcaaaactacagacactttgataaaattgtcacaaaattatatattcaggttaagtttgtcttaatctaatgatttattaccattttcctctcaaaattacatatgttagattctccctcccaagcatggttgtccttactccttacagaacttttacaatatgtagttttgatagttttgcagtaatgcagcttaaaaaatttctgtggttgttttgttaaattatttgtaattttacaaatttatagtattaaatatgatctattgggatcatatagttacaaatacgtacagttttacactgaagataagctattaatgcaatttttttagatgaagaaaagcaaaaggctaatgagccaagtgggacagatattacgattgaggacgagtcgccattttctcacgagccaaattatgatgttccacgggcatacaaggtactagttgtaacagacttgtgtgtaccagaatgcttccagaagttttcaattgaatcatttcgttttttatgtagtgaatattaattctatgttactaccatggtctataaacctattgtagactgataaactttttttttttggggggggggatttactttagactgataaacttattgtagatgtaaggaattaacacgttctcgaaatacagagaatgcttcccgaatccaaataacacttaatccaagctaaataaaatatttgactctgaataaatttatagaaccattactgcaaagctgtcaacacctgacggatggtatatgtttataggtggcaaaagtaataacagataaatcccatttcagtatccgctaatctcttggctgaattccgcttagatatatcgctacaatgccctggcataataagttttcaggttctgtgggcatttgcaaattttccgctaattctaaatattttgtaacaatgccatttgaatgatattcgtggtgatatttttgtaaatttgctagtggtaagtttgcaataatgattcaaaacagtggtaaatttgcaattgctcatgtgggatattttcagttcctcaccttaatcatcaacgcctcaacagctatggtgaagtaaatttacatttatgtatgcccagaaataaacacagtaaattgataaacagaatacacgttattgtcacctcggatgtgctttatttctgaagcaataatgatagtgcataagggtgtagtggcatctgtgacaattaatttaataagataacatgttgttcgtcattcataagatatcaagccgattttctgattaatgcaaacgtaaagatagcaacagtatacatttgtaataattgtaatgaaattaagctccttagatttcattatggaacaaaaaaaaagaacacatcattaccttttcagttttcactttgcctcattttatttaccgtgaaagcctaccataagagaagttgaataaattatgtccttttcctaccatggcaggggatcatgaatgattttacgaattttatgttctatttgcaaaaacagaagctgtatatgttgcaatgatgcacatttttactagttagtaccaatgacttcattcacaggcagagatagaaagcgaagaagttcctcacgcggaattagcagatgcctctcgcacaagcgattcaatcgacaatcgtcgacggcaacgccggtcaatcgagccttctttctcccgcgatcgcctcagccagccgaggaagcactcggtcgcgtccgccgtgccaaagttcggcgagtg

SEQ ID NO: 93380 - DNA, 3547 bp, Oryza sativa
  unsure (1)..(3547): unsure at all n locations
actcacttcacatttgaattgatctagtgcaacacccgataaatcctggtcaagaaatttcttcactgcaacttcctgcaatagatgaggacaataaattaccagagcaagaaactcacaaaacaatggcaatttaggtgaaaatgaatcatatatgttttgtttcttccagcttggtaaatttgttacagtgggcctgatatttccctattttgttttattggccttcctaggcaacaaacctttgatatccaatagttacctgttaaaagtcactgctttgcaatacaatgaaccagtggtggctctatttatgagctagttcgtacagacacagtagttatccagtcctgtactgtcttactatttaagctatagaccttacgaccacttcgtactactagcaaaatataatataagaattgctcttcaaatatgtgacttacagtgccattccaatctgcatgatatacttccccatatgaacctgcaaaaataaatttagtttagaacacagagagtaatggtacaaaagaaaagtatccaatacattacagagtaatggtataaaataacacaaaatttaacttagttcagtatgtaaaaaaaattaaaaaggaaataacgatggggatcacattgcaaaatccagctaatttattccactctctagcctgaataagtgcagttttatttttatttttcagtgtctccataatacaactttggccaataacacagaaaacaccattggttgacagcgaattataacgcaatgaaagtggtgttggtttagttgtaaaagttcataatttagaacaccttcattctaaaactgaaccattagcaagttcctgaataaaaaaaaatccatgatacgcgcagcagatatcgtatattttggaaattagaggcattcagacaagcaccagtcgttaaaatagaacaatgtctgtgaaacaagatcgatttcacaatacanagcttcaaagtggatgactaccanaaatgttaaggaagaaccataaaaagtctgaantttaatcaaataaatgaatgtatttattactaatgtatttagtgccatgtagagagcaagagacatttactctttctgcatatatattcatgtaacttggtgttcattgtaaacttgaaatgcagtatgttgtccccttagagaagctacctcttaataactacttactgctatactagtaagtggtaatataagatcttggaattaatgcagatacctagaccaatgcgctctccaatatgaagatcttcccatggtatttcatagtcagcaacgtcatctataacagagctgattgttttcgtgctagaacagctcgacttgtccaagtttccattgctacttcctggcatcttcaccaaagagtcctcagaaaacctttggtcctcgttggcaatggcatgagctgtatgatcatgcaaatccaaatttctgccaattgcttctgtattccccacatcatgctgtgcatcttcatggaaacaattcactactgctagtgttttggtattgccatgttgcaatggagaatcttccgctacatgaccatttggcaaattttgacctgttttagcgattaccaaccatcctgcagttttgtcatcttcagaagcagtatgtttgcatatttcaggtttctcataggtgggtagcaatgcagtgccctccaggagcaagtcttgcaaattttgtgcaaactgtgggtccacttctgtgggcactaaatacatgggagcatcgttgactttcatcagatgcggaatttcccctccatcagatatggtactttgtttaagcgggttctctgtgtggaagatgtcttccagctgtgaacttgcaagtgctaaagcagatttttgttcagatgaacttccccccatgtcacttgtattcttacatccagcactaatctgctcaagggctatgcatagttctgcaacactctcctcgatggcatcattgctcagttgactattgttggagtcctgaaactgactgccagaaatatctgaagggattaatgtgcctggagctcccatcagatcaactatatattcaacactgcaataggatttgattgttatatatcaacacagaagatgtcctaatattaaatactgaaagattgtaaagatacaatgtagatacctgtcaaaatcaattttaaccaagttaatagccccttcatctgtccccgtataatatattcctttgacaagcttgcatggtagattaactcgatcagctagtacctgaaaccaatctgatcagttattttctttgtccaacagaaacctacttacgtagaaagctgtcaccaagatatgtagtcaatgaaacaaggttcaaaggtgtttctttttcatcaaccatttcaattatccattccatacagcaaattcaagatttaccgatgcccataaatgaactagattggcttccacagttggactaccacagctcataatggacaatataactggttgaaggtgagtactaaacatctaaacatttttcaatatcataactggaatcgggaatcatttgtgctttaaacaaccattccacaatgtaaattgtgcaacaagatggaaattgttaccatggggctattcccatattttcttacacttgacataatttaatgccctatgtgaatgactggattgaagtagaatacagtacttctgcagagatactaaccttaaatagcaaagatctgtggcgcgacaacccaatgcgaagcaaaccaagagggagaacaatactgttgcgctgaaggcatagcgcgcggctcttcactccccattccctgttcatttcatcagcatcatccaccggaccgcccatagcatcaaccacaaggtttgcaatcttctgcacgagctccggcgaagcgactccaccatgctccgccctatcctgcgcggcaattgccagagccctcccttcgagccgcttcagcgccggatcacgctcccgattgaccaaaactgccacgtacgcggcgtctccaccgacgggaaccgccctgagggtggtcagggaggggaatttggcctggaagtgcggatgcatcggcgcgccgcacacatcgtagaacccgtcggagagcctctcgtcgtagttgacgacgcagtggttccagtaccgcgcggagagggcctccatggggccccggtccccggcggcgccgccgaggctgatgcgctcggcggcccggatctggaccgagtcggcgtccacgagccccgcgtgatccgacgccgagatggccagcgcgagccgcacctggtactcctcctccagccgcgtcatcgtcgcgtccgcccccatccccctcggctccgccgccgccgccgccaccggagccgcaacaggagccatcaccggcgccgctcggccgccgccgccgcggcgacgaccggaggaggcggcagcggcgggggctgcgccgacgaccgccgatgctgccgcgggcggtggtggtgctcccccgacggggcc

SEQ ID NO: 93381 - DNA, 1848 bp, Oryza sativa
tgacaaattgtttatcagaattcagcaatgcccattaaaatggagggatccatgttcctctttaattagcaattgcatcacaaaaagcttcatgtcgtatagactaataatattgtaaatacatgcattttttcatgcaggtgtcagattttggcatgtcaaggttgaaacatcacactttcctgtcctctaaatcaacagctggaacagtaatatccttgatgctctggtgactttctttttcatgttttacctcgttttgattgtatgataaggtgttttttttttcatctttgttctccagaaactctggaatatcgcactattgcactttacacggctaggatatgcaaatcatttgaactttagacttcaaaataacacattgattgctctgcctggtgtttagatgcaatatttgaggcattggatagtgccggtgtcctcaaacagaatggtttatgcaaaacattgtgcaatgtagtttgctctgcacaactaattttgtatagatcagttcaagccatgctctctttaccctagttactttcacagggtctttttatttttttctggaagtagagcctcaccctttttagacaactcattgttaatccaagatcatgtagtggcatagtgtactatattaataacatttttattgttcatttggtgggtgtttcctgtaattagctaattattccatcaccttgaccatattttatgttgggctacagccggagtggatggcaccagaggttctacgtaatgagccatcaaatgagaagtgagttgcttagttttctcatgacatgttggcctttccatttacttcctgtcatgttctcctgctgattgaaaattgaatgctggcatcaggtgtgacgtatacagttttggagtaatcctatgggaactagcaacaatgcgtgtaccatggagtggactgaatccaatgcaagttgtaggagcagttgggttccagaacaggcgactagaaattcccaaagaaattgacccactggtggctaccataatatcttcgtgctgggaaaagtaagaacaaaccagcccggataacatgctactcttctcattctacctagttttacctgccacttgctccactgataatgacccccaatgttctttcgtgcagcgatccaagcaaacgaccatcgttctcccagctcttgtcaccgctgaagcaattacagcggttagttgttccagaaaactgctgacatcccttcctgagaaaaaaaagctcaggtcaaacaaaaaatacaagtatgtaagctctactactacagaggccaagtttttcatgttgaagctttgtggagatgtattcgcagtctctgcatgcaggatggatgtgcatggacgaaggttctatgcatcctgttgtgaaaaaaaaaatgtgacaaaactctctctgaagccgtgcaaaggcgctgctggagaaagcaatagtgtgttagttccaagtgaagaaatgtggtgcaacacgaagtgctctgtgccatcgaaataatttgttcagttctggaatttggaacggtgattctgagaatcagaatttaaccacaaagataggatcttggttttcgttcttttttgtcttgcttcataattggaaaaaggagaaaaggtcaggttaaaaaaaatggaaaagggaaaacgaaatcaaaagttttgtggcgtctgcaaaagttgcggcccggtatttaaccagatgcaaatcttgtatatcatttatacagagttttactctgcatcgacttgaatatgcatcttaatatcttattaccttgtcctctttcctataatattgaatggttacta

SEQ ID NO: 93382 - DNA, 6838 bp, Oryza sativa
aaaagacatgaacacaaaccgcagttaggcaagctgaattgactcctccctctatcccccaaaaaaccgcagttaggataagacataagctagaacaacgaatttgaaaacgctaaaagtaaagaatccctacaaatttgaatttggacaacgttaaaagaaaagaatccctatgaatttggacaccgctaaaagaaaacaaaaatgaagtgaatttggacaacgctaacaaaaaatctgacaaacatgaacatcactgtacctcttttacttgcataacaattcgaaaacatcagaattgccaagtttatcatatgagcagcagccgattcacaaggaatggtgtgtttccgatgatgattcgatggatagtgtctttaacaactaagaactacaagatagaagggccaaaactcttaaaaacagcacacagaaacgagagcacactcaatatagactaatataaccacaagctgatagtgttttctttttcagaatcatgaactattttcgaacggtaaatccaaaacctaaatagctcatttttccacggtatccttgctccaacgacgcctcacttgaagcatttcgcatccagcaaagcctcgccctcaaatggctcaaggtcctcaatcatggcgctgacgcgctccttctgggcctcatctgagatgtcaaccttggtccactcatagagctccatgtcgtagacctcatccatgacgaacttggggatctcggggccacggaagagccaaagacccttcaccttgaatggcggctcagagccgatcacaagcatcttcccgaaggcatatttgcggcacaggtccattcgctgcaggaacccaccaaccttgttcatggtcacgaaggacacggtgttctcatcattgtatttgtagtcgcagaaccacagggagtaaccttctgggtcatacatatcccagaaacctgcaatacatgagaagataacttgagtacaattcacagcagttcaaactcaacagaagttggtgtagatgagaaataatggtgtagaagagagaactaattgacagatcaggatcagctgaggtagttgttttgactgcaactttagcagtcaacacatatagccatccatcaagccaccaatgggctaagatgttgagcatcttctctaactaagatgttaattttctccatccaacaacaagaggctaacagtttttgcatgctataattctctagctaagatgttaattttctctaaactagaatgtttgagatacaaattgacacaagaatagcatagttaacagtgtcattttttaaagttctgaaaacaaggcgtttttttatttatagtccaacttaatatttttattaattttctgtttcattgatttcatggttttggaaatattcgataaagaaagaaaggaaaagagatgctcttggtctagccattggttgcttgttggattactggatgtgatgactgctgaagttgcagtaaaagcaacaactccaggccttcagctgatcctggacagctagctagttcacagttgaaaagtaactaacaacatataacatctaaaaaaagtcacatgcatgcttgctatttatgatgctacacaaacaaattctaacgggtatcctaatttgtattcatatcctttgcaacaaagcaatgcaataaatttgtctatctggaaactttttactgactagtagattccaaaaaagaaacttacccttgatagcaacctcacggaagtttgtttttgtgtttgagtataacctcttccactcatcaaggatcattttgcttggagggagcaaatcaagaggattctttggctttggctttggtgcttcctcttcctcctctggtttctcagctgccttaggctttggagcttcttttggggcctctttcttggcttcctttggcttctgctcctttggtgctgcagccttcttttgaacttgtgggacagaatctgcctgcttcacatcacccatgactttcttaaagtttggctggttaaccatggtccagaagtacctctcaacatgagggaactcagaagtaaaattcttggtcatgatccgagcaaagcccatgtagaggttgcatgtcatcacaatatcagcaagagtcactgaatggccaacaaggtatgtgtttgatgcaaggtgtgtgttgagggcacccaatgatctcttcaaagcagcaatagctgcttcctcactctgttaggcagaaacaagattagatcacaaattgctaacaaggagaacacaacgatacccacttgaccatacttacgacagcaacataaggagcaaatccaagacgtgggaagagccattttccagtattagcatcaacctctgtggctgaaaagtcaatccactgctcaatgtgggcctgaaagaaacaagaaattcaaggagctggtaaaataatcaagaatgatcctaaatgtctatgaaagatcaacctgaaagaaacacaaaattctaggagctggaaaataatcaagaatgatcctaaatatttatgaaagatcactcacatattcaatcagtgaagacccatagagtgggttgtcagacttcgagcgagtaacttcaggaaaatgagaggaacttagaactaaatcaagcaatagagagaaaaggattaaaagaacggaatccttgctatgtatcacttaccatatcgtgcaatcgcattgctttcaaaaacaggaccatcaggagtctctagaatagggacctgaaaggaaacgtgtccaaatcagattctgtgcaaatgtaccaaaattcagaggtggttttgctcaaaccttcccaataggattcatcttgagatactcaggagtcttgttggagacacccatctgaaagttctttgccaactcaaccttgacaccagagtactcggcagcaatgagtgccttgaatgcattcttgtttccatcgaaagtatgcaatacctacaccaatgcaagttacaaagttgagcgtgaaaataggttagggaagtgcatgacatgacaacactacaaggacagtttgactagcatgtccataaggatggatacacaaacatgataaacaaaaaatatacaaacaacgggacaaattcatagatcaagcagcacatattacacagtgactttagccattcaatgttctacagagtgatggtcaatacatacatattatataattatgtgcacaagtgctgagctataatgtctgcatgagacatgtctacatgctcatcggctattcagaaagcgaataagacttcatttccgaaactccaaataatcccatttgcatcaaacaggaagctgtaagcattctaggaaagcagagccctgtgcgaatctctacaggataatgtatatattgtcaacaaactgtcatgtgatcaggctttcatttgtatgcatttgaatttggtcttacatcatcaaatgtatataagaaaggctaactattggaaaaccttggcaacaatctttaacacttgggatcaaataatcagaaatatagactagaaaaatttcgaaggcaggtccttgcttcctcactgcacaaattatttaatattcacttgatccgccagcatttgaaccagaaagtaacaaagtaaaaaaaaaaaccagaaatctgcatttcaacgagcttgcaagacaacattaagtaaataagagatgctagacatagaccgaacattgtccaccgatctaaataaaatccgtgacacctaaactgtcaccaccctaccaaaaccctccctaaatgctgggtagaaatgcgcaccaaatcaaccctgatcgtgcagaaaaaaacgatatgctttacagaagactcatacagcaatccacagatgctacaatttgaaaatgaaaaaaaaaaaactacaccccaccgcatcatgccaagcttctccactaaatcaactaaagaacacgagcaaacgaggttagatcaagaatcacttacgagcgccatctcgacggggccgccgccttagctcccactcactcgatttcagatctgcacatcatgaggaaacaaaaatccaaaaaaatttaaaaaaaaatccgcaaaatcaacagtacgcaacaatggcgcaagcacactagttagttgtagcgaatcggggagatcttacggtggcggaggcgaggcgagcagtggagggagcagcaagacgaaccctagtggaagaagtagcagcggcagcaaaaacagtggagggattcgacgcagccgattctacttacgatctcgcctagggttgcgcgcgggtgatctcggccgtccgatgagtaagccttgcgacagatcggacggcgcagagcagatccaaccactccgtaggcgggcattcgtctggcactctggccccttccagtcgagcccgttggatcgaaacgggccttgggcattttttctaaaaaaaattaaatccatttctttcccataaaaaaattaaataaattttagaaaattatatatatataggttaatttatcataaaactacatacaaaagtattgccacacttgtctaagtgaggcgatcaaattcttggtcacactttagcaagcctaagaaaatcttgcaacacatttttgagtcaataacgtatatgactcgtttattggaagagaatcttgccacaactgtgactacaaccaaacaccctaaaatttactcaaaattaaactaaccaaagttattaaggggaaggagattagtattacagaatactgagtggagtaaggaccaacgttattaaggggaaggagatagtattatagaatacgaaatggagtaaggaggatttaatgttcgcatggtggtgatgctgtgagttaatttcaaggcatgtataaaggtagagtctaatatgagctctttatattaattaatattactagagactatatcctactacctccgtttcaggttataagactttctagcattcttcacattcatatagatgttagtgaatctaggcacacatatatgtttagattcattaacatatatatgaatattagcaatgttagaaagtaaacggaggaagtactaaagtaataaagacaataagttttctaaaccattaatgtataaataaatttttattatacttctttcatttttctccactctcatgcaacaaacttttcgttaatgaatgctaagagtcgactctgagccgttgtcatgcgtatcaacgatgtttttccttccttccatctctttctttcacgtgactctgaggagccgttgtcatgtcatgcgtccctctctttctttcacttgactctgaggagccgttgtcatgcatagcaacgatatttctccttcattccctctatttcttccacattaactctaaaccctaaaccgttgtcatccgtagttgtttctccttccttccctttctttctttaacgtcactaaatttactccgcaaatgcttaggcaagttgacacattgacaaaacgcaaatctctgatccatgcgttgtagatcccatttttgattcaggagattattatccggcttaccaagctatgcttttcatgtaaaaaatttctatataatagaagtttcttggaaatatttttctaaagcaaaattttaaattaatagtaattcgttcattcattcatttatataccctcaaatagccatcaccaaaccagataatcaagaaaatctcaatagaaacgaacatggccttcgtctgcgtgcccagcgctgaaagcaaaagaaaaaaaaaagaaacacaacaaacatgaacaacagaataaaatacataaaataacccagcaccataactcgttttgttgcctatttccaaaacattatcagaatggcaagtttaacacatgagcaacagcagattcgaatggtgtgtttctgacgatgattcgatggataagtgtcttaacaacttaactacaaggttaaaaagggccaaaactctagcaaacagtacaaaaagaaaagaccagcacactcaatattgactaatatagccacatggtgatagtattttttttttcataatcatgaactattgtagaagggtaaatccaaaacctaaatagctcattttccacggtatccttgctccaacgacgcctcacttgaagcatttcgcatccagcaacgactcgccctcaaatggctccaggtcctcaatcatggcgctgacgcgctccttctgggcctcatctgagatgtcaaccttggtccactcatagagctccatgtcatagacttcatccatgacgaacttggggatctcggggccacggaagagccaaagacccttcaccttgaatggcggctcagagccgatcacaagcatcttcccgaaagcatatttgcggcacaggtccattcgctgcaggaacccaccaaccttgttcatggtcacgaaggacacagtgttctcgtcattgtatttgtagtcacaaaaccacagggagtaaccttctgggtcatacatatcccagaaacctgcaataagtgagaagacatgttgagttcaattcacagaacttcatacacaacagaagttgggagcagatgacaaataatggtaatcaaagagatataacttgctaacagttgacaggtcaacaaacaaatttgcattgactctttagtagctgttataatttgtaagccaatttgtactcatatctttctagtgtactcacagcaatgtagtaaacttttctctgtggaaacctttttagtgactactagattcccgaaagaaactatacttttcta

SEQ ID NO: 93383 - DNA, 830 bp, Oryza sativa
  unsure (1)..(830): unsure at all n locations
cgatgtaggtgatcggctcgatgccagtggttcatcatggtgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcacagctacgttggcttgccacgcattacttgactgtaaaactctcactcttacgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatggcatctagtcactcaaagactttaggctataagagggtgactaanagccaatcaatctcatgccaaaatctag

SEQ ID NO: 93384 - DNA, 1700 bp, Oryza sativa
tccaggagcaggtatatgtgggggagatctcgcggtcgggtgttggtgctagggttccgggacctctcgattgacaatttgacatggttgttgtttggatcggctgcaggagcgggcgtacatgatgcttcgcatgggcggaggcgtcggcgagggcagcgattacgggagctcggatgccgggagctacgagtacgacgacgaggccgaggaggactacgaggaggagctggagcaccacctccgcgtccaccaccacgagcacgccgttggggagggtcgtggcgagggagagcgagatggggagggggctgagggaagcgagttcgaggaggaggggttcgacgaggagtatgatgaggaggaagtcgagccagagctagaccccgcggagtacgaggacgatgaggcttatgcacgagctctgcaggatgccgaggagcgcgaagtagccgcgcgacttatggctctcgcggggatcagcgattgtgagtagaaaaggagtgctgtttcttcagttcatttcacatgtttcagttattgctgtcgataatttcaatttgatattgctttgtagggagacctgtggagcctgtagaggagcatgcgaatgatccacaggtaatggtctatttttcttgttagttggacaaattgtgtttgttctgatatgtgggaatcctagagttggatgaaatgatcttggagtaataacataaatgatgatatagtctccttaattcgttgttgttgcaataaaatttacacctacattatgtatgacaaccgaaatcatatggaatttacacttgaagtgatgaatgtgccttgcaactttccttgtttccacgcactgttgataaacgataagactgcccccaaattcattttttgggtaccttccagcatccaaaatccatcttattttcagttgaacctggaattctttttcttgctcaccttcagtttcatatttgagtgataaactcatgagcatccaaggtttttatgtactttttatcacatttacagatcatgacttctataagaagtgttggttgtttacatcaggtggatttttaatcgtttatactttagtagagcttgtactgtccattagttgagcaatagtaagaccagaggtggtatgtggttcatgctgtggcttgtcaaatttgcatgctgtcctgtttactccatggattttggcatgctatattatctccaatggaagctgcatacttgaacttgggaaaatgtcttttcattttttccttactccattactcattgataatcagcttttatgaactggaaaaacgtcatttaacacgttgatatatttttaccaaaacccaggatgcgtggcaagaggttgacccagatgagtattcttatgaggcaagtttcattgttatatgttagccttctggcacctggcactgcatcagaagctttaagatgcaatattaatggttctctctatatgacttcaggaattagttgcattgggagaagcggttggtacaggacacagaggcctctctgctgctacacttgcttctctaccttcagtaacttacaaggcagaaggtgtccaagatggcaacacagagcagtatgtgtgaataatttgtctcataagtcataaccttactatcttacattaatcacatattaagtcctaatgtatctattgt

SEQ ID NO: 93385 - DNA, 1434 bp, Oryza sativa
attaatgtctatgaagctatcttgttgcgcatacttgtgcttggacagagggctttatttgactgccaggctgcatatgttgctaagttttgtgtcaaagtgtggcaacccaagattgtctccaaatttattcgccacattagtgggaagtcttttttataggaaatgagtctgtcatgtgggtttaagggctaagaaaatgtgatattagttatttttatagtgggccctaaatttactagcaggccatatgttaggttcatggtttatgtctggatagaatttttgttattcttgctgtataggtatagttgttgccttgtacctttgtttcaccttcaggaagaataaaggatcactttggtagacctactaagtactagtgacattcatttttggtacaaaaattaggccattatatttgaaaggtttagcaaatcaccaaacatggaaaactcacgtgcatcagtgcataactagggaaatagttttgttgcatttgaaagttcattcctcttgggtgataatgcagtcttacaaaataaatccaatctgccaaagcattcacgcccttttattagttttggctaaaagatgtttgggtaacactaatagcactgcggatattttggtcatttgtgttatgcaatttaaattctgataagtttaagccaacgatttgatcatgtgaacttgcctctcgtttttggttgctttactgcctgcgcacattgattagctaggtatagctgtatatactgtgatttcattcatatttctctacccactacccaggtgcatcatgttagttattgtcttacgaagtacagtatatggattattcacatgtagctttctctagtttcgagttgtttacaatgtttaacattagtattgaacgtttaaattttataaacacgataccggtgtgtagttatcagttggtgacgaaatatccttgatgtgcaggtttgcccgatgtgcagcgcggaagtttccacatcggacagcaaccaggcatgaccaatctttgctgccattatggggcttgatgggagcaaatagcgggcatcatatggtcgcatcttgtaatgttggggagaaggcagataaaactttcggacacatgcgagggaccagcactatgatcttttgcgttcttcagtcctctcctggcttagctccactgtactctgtttgcccgtgccgctatgctctgcattccctgtgggggcctcatggctgttgtatgatccataaatgtacaatggttatattattatattatatattgctagccattcttttactacctcatatagcactatcgttgtaatcttgctttttgaatgacgtttttttcctctctttacctagtcacgtacttaaaaagtttttgatcaaatggcctctcaatcatttaaaaagttactt

SEQ ID NO: 93386 - DNA, 2103 bp, Oryza sativa
acagaatacagacgtacaagtcataggaatatggtccgccgcctcatagtatattagtatatacagaaaacaatgatgtactgctacagatatgctgcaaacaagaatgatattctgatggcaaagactataagatcgaaacaagtacctggaacacctttgccagtataaggttaacctctggtgaagttgactaatgaaaagactggaacctgtaattgcatctgaagcatgaacaaaaaattggtgaagtgtacagtcatcattgagcagtgaaaacagtctaactgtgaggttgcacatgtgcgcgcacacacaagagcaagaaccttgaagtaaagaaaatttctcttatagatgagcgaaatgtaatatacacgatacataggccaaagagagtacaagatgctaatctcccaaaactatacctccaacaagagcaacttaagttctgaccatcaaagcctacaaacccccaggacacctgaagcaaaattacctctcagcatgaaaaacccaacaaaaggtgtaactttaacaacttttttcctatgtcggggataaaaaaaggttttaccagagtataaatagaagccacccgatgtatgtacagtacttggtcattgtaaagaagaacagctttatattcttctttcatgccttccaacaacacaaagtgatttaatggtatccttttgcacctctggattggtacagttccaatctgatcttggcctctggcaacaagctctcaattagcggatcttgcatcatgaacgactgtttggaggcccattcaagaaccgtaaggatctctgcttgcgccaactcctcgctatctgggacgttgtgtgcaatgtaacatacaagggcgagtgctgcaagctgaaccacctgctcactaaaatacacgagctgaacaaggtgcttcgcaccacccgcactgatgatcgctttcgagtgatcaacacgcaggtagttctctgtgcatgcaaacttggtcagggaaagtgctgcctcccgagagacatcagcttccctctcatcaagaagcttcaccaatggcccaatgatccgagtctcagttgcacggaaggttctggacagacagcctaatgagataatgcagggaataaggagatcatcatactcagccttgtcgacaacacgtaagagttggtcaacaacagcacgggcagcaggagaggttggcttaaatgctgaccgtcgcaggtcagaattctgctcagcaacactgcagatttccatgagagccatggcagaattgtattgcacatcaccttcgcctttctcaagtagcaccgcgaagcagagcagagcccttgactcagtgatgctcttgcagatagctgcattgcccttggcaagatgccacagcgccttcgcggcatttgccttcatagatgcctttgtctcagggtcctcaaactccctgcccctcgtagtcgctcctgacaacgatacgttgtgctgcttcgatgcgacgacaccgccattactgaccttaccactgctcccattaggctttgcagccatggtggaatgcaccaaactgtacatctcgttcttgctctgcgaaacgtgtccacctgggtgcctcgtaccgccatgctcccccgcgtccatcaagtccgggatcaacgccccgcgggtgctgttcttcttgtccatcaccacggaatgtatggacatcttggacgacgtcacggcgtacttggagtgctcctgcaccgtctcgaacgcgaggtggccgacgagcagccggatcacgttgtgcgacgcgaaggcgtcctggcacttggggtggttggcggccagctccgagacagcccaggccaccgtggcctgcaccttcatgggtccctccttgagcaccttggcgaaggcggtgcacgccccggcgtggaccatctgctcgacgcactccgggtcgcggccgaggaggccgatggcgagcgcggcgttctcctggccctcgagcttgccctccttgaccagcctgaggagcggggggacgccatcctcctcgatgatgagcttggagtacctgtcattgtcgcgggcgagcgagacgaggctggc

SEQ ID NO: 93387 - DNA, 1494 bp, Oryza sativa
gaggaagtttatgtcaaacaaccaccaggttttgaaaatcctgattttcccaaccatgtttttaaattgtctaaagctttgtatggtttaaaacaagctcctagggcatggtatgatagacttaagaactttttgcttgcgaaaggttttacaatgggtaatgttgataaaatgctttttgttcttaagcatggtgataatcaacttttcgttcagatatatgtggatgatatcatctttggttgttcgactcacgctttggttgtagattttgctgagactatgcgcagggaatttgagatgagcatgatgggtgagttatcgtactttttgggattgcaaattaagcaaacacctcaaggtacttttgtgcatcaaacgaagtatacgaaggatcttttgagacggttcaagatggagaattgcaagtcaatttcaataccaattggttctacagctgtgctggatcctgatgaagatggtgaagctgttgatcaaaaggaatatagaagtatgattggatctttattgtatctaactgcttctaggccagacatacaatttgttgtgtgtttgtgtgcacgctttcaagcttctcctcgtgcttcacatcgtcaagcggtcaagcgaataatgaggtatttgaatcatacacttgagtttggaatttggtattctacttcatcttctatatgcttaagtggatattccgatgctgattttggaggttgtagaattgataggaaaagtactagtggaacatgtcattttcttggtacatcattgattgcatggtcttctaggaaacaatctagtgttgctcaatcaactgctgaatctgaatatgttgctgctgctagttgttgttcacagattctttggcttttatcaactttgaaagattatggtcttacttttgagaaagtacctctattttgtgataatactagtgctatcaatattgctaagaatcctgttcaacactcacgcacaaaacacattgatattcgttttcactttttgaggaatcatgttgagaaaggagatattgagttgcagtttttggacacaaagttgtaaattgctgatattttcactaaacctttggattctaatcgctttgcttttcttcgtggtgaattgggcgtaattcatccttttggcatggtttgagggggagtttgtacctcatggttttatcaagcaataatatgacaatgaaaaaattgataaaagagagctttgtttatgcatatggtattttcttgtgcatgctagcaatactttgaaggtttatttgtctctagcatagcttgtatatattctagtcttttcatgagatttagattttgcttttaagagagatgaggcatgacacttaaattctatacttgaattaagaaaatatgcaatgttgatgctagcatatggtttgatttataaatgctatatatatatatatatatatatatatatatatatatatatatatat

SEQ ID NO: 93388 - DNA, 521 bp, Oryza sativa
cattgtacttaagcatagactgagacaaattactagcagttctaggtttgcatgacttgagatgcctaagcaaatgaccagtgccaccagatgaatgagcagacaaagtttttttttgcggtgattgcatttagcagaaacgcgaacctgcgcgccattaggtgattcaaagagttcttcgaagtcatcccataccttggatgatcttggccgcttgttggtagcactggagtcagtgccggacggcgcgcctgtgccaccatcactgtcactgccactagtaccgtccacgtccggctccgtctccagctgcaacccatcgaagtgaggaggtgacgaagtgattccgaacacctgcacgcgtacctcctccaagtcatccttgtcatcaccccgcatccccatcaacctcaactcgtggttgcaagaggatggatcgtccatcgccggcactccggctcctcaacggcggctaccgctcagcgacctgcaagacacacagaatgagatgagagagcagt

SEQ ID NO: 93389 - DNA, 3929 bp, Oryza sativa
atgctttgattgcgaggatgttctatacatcaggtcagaatatagcatgttttttttcagttctaacattatcaattttgttttgtttatgacgtgcaactaattatatgtgtgcatttggtttgcaggtattcctttcaatgttgcaagaaatccatatttcaggaaggcttttcagtttgcttgcaacaaccaacttggtggttatacccctccaaatttcaacaaattaagaacaacacttcttgttcaagagaggacaaatgttgagcgcttgctgaatgctctcaagtcaacatggtctactaaaggtgtgagtattgtatctgatggatggtctgatgctcaaaggcgaccaatcttgaattttcttgcagtgacagaagatggaccaatgtttttaaaagcaatcaatactgaaggagaaatcaagaggaaggaatatattgctgagaaaatgtttgccatcattgaagaggttggcccaaataatgtcgtgcaagttattactgataatgcatctaattgtagggctgctggattgatggttgaacaaaagtacagccacattttctggacaccatgtgttgtccatactttgaacttagccttgaagagtatatgtgctgccaaaaactctagtggggatgcttttctagaattccaatggattagtgaagtggctacagatgcatctgccataaagaatttcattatgaatcactcaatgaggctctccatgttcaatgattttagtaagctgaaatttcttgccattgctgatactagatttgcatctactattgtgatgcttaagaggtttcgtgctatcaaagagaacttaatcttgatggtggctagtgaaaaatggaatacctatagggaggacaatcaagttcaagcacaacatgtcaaggagaagattttaaatgatttatggtgggataaagtgaaatatatcattgatttctgtgagcctatctactctatgattcgtgctgctgacactgacaaaccatgcctccatttgatctatgagatgtgggattccatgatagataaggtgaaaaaaatcatctatcgtcatgaagggaaagaactagatgagcaatgttcttttttctttcatgtgaatgagatcttacacttccggtgggcaaaaagtactacccccttgcattgcttagcacattcactaaacccaaagtaatgatgttctacctcttttcaatttttatgtgcataatttataattgttgctagcagctcaataatcttttttacaacatgtaggtactactatgagacttggttggaggaggctccaaaccaccaagcccctcatatggatgaggagatttcagatatgagaaataagtgttttagaagatatttctctggggatgaattgagaaagatcaaacaacaatttgcagatttctcattgtttggcagtgggtttaattcctttgactcaattgaggatagagcccatatgaatgcaaagcaatggtggggaatctatggtaactctgcacctgagcttaaaaagttggcactaaaattacttggacagccaacatcatcttcttgtgccgaaagaaactggagcacttatggtttcatccatagttcaatgagaaacaagtttagttccttctcttacttatttagtttcctgtatgttagtaatgcatgaaattaacacaattgcattttttttagtcttaggcctgcacgtgctgaggatttggtgtttgtgcaccaaaatatgcgtcttctttctaggagatctgaagaatactacagtggcccatcaataatgtgggatgttgcaggagatagatatgagttgtttgatggtggtgctgattttcttcaacaagctgaactgacacttgatgagcctgaccttgagagactactggaagatcttggtgcattggacatacaaggcgataacgggccttcatccacttcggttccaatggatgaaatcaacaatcaatttatctagtcttgcaatctagttattgagttgaatttgaagtcatggacaagttaattaattctaattagtttagcgctgtggtgatgctctactgttgatttatctactatgtgaacaattttatctaccatctatttgaagaacacatgtgttgtgattcctattttttaagtccatatttcacacttagtttttttgtatttttaaattgtatatatgtatatattcgcgtatccccgtatccatgtttttaggaagacggtgtatcccggtatcaccgtatcgcgtatccgtatccgtatcagcgtatcggggtaacgcagtagaagagtcggcggcttcttccagaatccacagacttctcgtctgcaagcagtcatagttcaaatttaaacttcaacaaacttaaattttaaagttcttttggttttttaatcatagttgattttttacgttaactttaataccagttaaatatagaaatataaaaaatttactgcaaacttttttcttcgtttatgggtgtgtttagttgaggaaaaggaaatttttgggtgtcacattaaacgtttgaccggatgtcggaaggggtttttagacacgaatgaaaaaactaatttcagaactcgtctggaaaccgcgagacgaatcttttgagactaattaagccgccattagcacatgtgggttactatagcacttatggctaatcataaactaattaggcttaaaagattcgtcccgcgatttcctccataactgtgcaattagtttttctttttatctatatttaatgctttatacatgtgtccaaagattcgatgtgatgttttttgggaaaaaattttggggaactaaacaggccctatttctcaacgataactctatctcaaacgattggggtatggtgacaaaatttgaagagaaagaaaaaaaataatttaaaaagacacttctaatattcgaaattgtttgtgacttggaatatggccaaaatttgtcagcgttgggagatttattatacaattgattaggtctataaaatgtcccatatctctctcaaaattcaaaatccatccatttgctccatcgttatattatttgacaaaattaaccatctccattcttttacctcccatcaactttcataactactctcaatcttaaaccagaaggacaagaattactctcatcatagtgattactacagttttattgtgccaacccttgtaaaccttcacaaattttttttttagagttgtcactcacacgttcatcaactatcaactagcaagcgcaggatagcccgccacaatcacctaaaaagactagagcccaaaaatactatatttcttcgtcccggaaaacttgtcgttttatggttgagtgaacaaattaactacaagtaaaaattaccatattacccttatttaatcattgcatttgtcacttcagataatcacttctagtagaccatctatcgcattgtacacacatagatagcactagtagtggcacggttgtatagggaaatagtatgccaaataaatcgatggaatagactaggctcagctcgttggtcaagatgctgtcaagatgctagaacgataaattttgtgggacattttttgaatagcggaatgacaggctttccgggacggaggaagtattccacttactaaataccaatatacctaaatctgagaaaaatataaacccatactagtcgaataaaaactacattttaaccctacattttatctgtttatcttactttttcatcacatcaaaactttcctacacacatgaactttcaacttttccgtcacatcgttccaatttcaaccaaacttctattttttgtgtgaactaaacacaccctagttcgaagatagaacacacaagctcatgggtgtgt

SEQ ID NO: 93390 - DNA, 2898 bp, Oryza sativa
  unsure (1)..(2898): unsure at all n locations
ctggccctgcatgccatccctctggtactgctgccacatcatctgttcctgagtcaagaactgctgcttcttctccatctctgccatctgaacataggacggtggtgggaagctaagggacgccgcaaacgggtctccaccaacattctgcattgaaccatctggtgctggcagagccagcacttgtgttttctgtccagccggaggtagagcaacgctgctggcactcccagttgtcacttgtgcattgacatgctggcgcacggcaccctgatcatacataccattcagtagcaatggatccataccacctgtcattgtggccttctgcttggacagattgctcgctgtctccacaagggcaagttcccagtcagccttcccaggctcagctgcaggattctgccatgcagaagtcacctcattgccaccatttgaggggaaggcctcccatgagccattgcttccaccagctgcaggtggcccttggaagagggccagagcaagccggttaccttgctcatctgcagtcacagtttcttctctaagatccactaaatcaccctggggttgcggtgggggctctggctttacttcctcctccaccttctcaggttcaggctccttgtagtcttctggtgctggcagtgccttgatttcattcatatctggctcaggctcttcctcctttacaggttcaggctcaggctcccgaggtgggctcttgggccgctttgctcggtccctcataaattcctccaatgtctccagcaacttatcggtaacacgctgcacctctgggtactctgatgacctagcgaccccagtttccttacaccagccatagaatgcacaaagctcgtcaatctgctttgcggcgctggcatatgcctcaaatgccttcacgcactcggcatactccatgtcaaagaacctatccagcagcactgcgagcacctcacatatatcagcatagagctggaagctctctctcacaatctgatacagcgcgaccagcaccatcctgctgtgcttggcaccacctgtggggcggcaagcaaggaacctgtcgagcagctgttgcaggtggtgcatacgggcaaggacccgttctggcttcatgtctctcactggggtcggcggcttcttgtcatcagtgttgttgttgccgttcctctcacggtaatcatcataaccaccatatccatacccatttccgtttccagggggtgaggagtatgagggtgaccggcgaccatatgggtcaggtgatccccagcggtcacgcggtgacgggccatttgcactggaactggcgttggagccggagccttgcttgcgctcatggaggaagaactcaaggcgctggtcgaggtacagcgcataggtacggacgaaggcagagtggtcccatgaaccggagtgagcctcgtcgcggaagtcggagaggttgaggaggcgagtgcccctgcgcgtggcgtgcaggagctcgcggtggaaggaagggtcgccgtcggcgagaaggcggtgcacgagcatgagcgacttgagcgcgacgacgtagtcgcgggtgcgggacagcctccgggagcatcccgcgacggcggcggcgacgtgggcgcgggagccggaggtgaggtggaggatctctcggatgtgtcgctcctcggccggctcgtcgtcgtggctggtagccttgacgatgagcacgtcgagctccggcgcgatgttgctggtgaccttggccagaccgatgctggtctggtccttcaccgcccccagcgccttccggatcgtgctcgacgacatntngccgtngccngngcntcctcctcctcctcctcctcctcctcctcctcaccaacaaaccaccaacaaccgcggccgcagcagcagcagccgccgcctcttgctcggtttagatctgaacagaacaaacacccacatgagaatcggagataacttcgccctgtttgttgtctgttctcgcgcaaacagggcaaaaccagcgcgggatttgctcaaaaccaaacgcggatccctgaaattccgcaaccttctatcctcaaaacccatcggagtacctaccgagcatgagatccgcggagtcgggaggcgagatctcacccgcggaatccacccaacaccgatgaaatgaatagctagatagagatattaattaatactactagtcgactcttagcttatcatcagcatctatagcagcagcaaaccgtagctaagccgaagctactctctcccagccaaagcggcagccggcgccctccggcttcatcgtgaaaaaggcacggatctagcgagcgagatcgatccaagcgaaagatttacctttgcggtagatccgggagctcgagatccgggcggtggcgcgcgagcacacgccctcccctcccctctctctctctctctctctctctctcagctctgtctccggcctcttggggtgggagaccgggagctctggggctcgtctgaaactgcggtccgcggaggaggcgagggagacgagggaggaagaagcgaggcaggcggcgtgtgtggtggtggcgcgtttttgtgttggggggcgtttggtgccttgctgttttcagatttttatattttgcgcgaggggaagggaaggaaagcgagcttcgcgtggcttccttccgcgcgcgcgcaccgacgcgccccctcggccgtccgggttttcccaaaaatattttccactgcgaaaggaaagtggggtggcatgccgtcgcgcggggggaagccaaggccaagccgcggttgaccgctgcgccgccggctgtgttgtgcgcacacgcaaagcggcgggcgggtgggcgggggcgttgcaccgtgcagctcccgggtgtttggggggggggggggggg

SEQ ID NO: 93391 - DNA, 771 bp, Oryza sativa
cttgcaggagacgccgcgctgcagcggcagcggcagccgcagcccagcctctcgccttttatctcacacgctttcgtctcgtctccaccatcccagcaaccgagccgagagccctccagattttttcttttttaccccgattaaattcgtattctaggcgttactactagtagctcgtacggctccggcgagccgccgcgaacgaatgccggtgatgctctagcggctccctcgccgacgcgcgcggggcggcggaagcaggacggacatgaggaagcagccgcagccgcaggggaaccgccggctgaggtggctccgggcgctgctgctggcgctcccgctcctatcggtgcccgtcctctacgccgcgctcggggcggcgcgccccgcggcgccgccgcggcgcggggcggcgccgcaccagctgccgccgaggctggcgtacctcgtatccggcggcgccggggacggcccgcggatccggcggatgctgcgggcgctgtaccacccctggaacttctacctcgtcggggtcgccggggaggaggagcgcgcggatctcgaggcgttcgtgcgcggcgaggaggcgccccggcggtacggcaacgtgcgggtcgccgcggcgggggagtggggaccggtctcgcggcgcgggcccaccgagctcgcgcgacgctccacgccgccgccgtgatgctccgggagttcgatgggtggagctggttcatcaatctcagcgcctccgattacccgctcatgcctcaggatggt

SEQ ID NO: 93392 - DNA, 1949 bp, Oryza sativa
  unsure (1)..(1949): unsure at all n locations
cacttcaatatagaacacagtgctgtaacgagtattgttgtcctattacaaaaaaacagtttgctgatcaacaaaatatcttaagcatttgatcaacaaattattccttttgttataccaagaaagccccttttaatggagaatctttcactgaaccagttttgctaatatatgattgaatacaggattccaaatgaataaaagagaacacagcagtgagatcgcaaggtagaagcataatgaagtcatgaagatttcaaacttaccctcctttcagatctattgatggtatgtcctcttttgaggctgccttcttttctgaagaacctgaaaaatctcaaattgatgaacatggcaataaaataaataatacatggcaacaaaataaataaataaaagaatgcagcaaaacacagaaaaagtggaacgtggcagaccttcagacaattctggtctgtatcgagctgttctgtatttctgcaaaataaattaactcaaaatgaaaagataagaataattttttttcacaaaaatatcatgcaatagggacaactaacagacctgaaggtgacttttaacatgataaatggtcaaattgtctgcttcattagctttaacacacccttgggagtagcttctgcaacaattcacaataaatgtcaatatgcataattagttcaatcataggagatgtaacatttcttaaagcaatacacactttcactgccaccaagtagattgacagatctacaaagcgctcatgaagttcangagtccatctcattcgtgtcttggagttggaggtattggaggcaccagagggcgagggtatagcaactgcagaaggttctcctgattgagatgaaactgattgttgggcagctgattggtgaactgcgacagatgattgcgcagctggtcccacctatatngaagataaatagagcaccactcaattacatgtggatgcgtctaaaagactaggaactaaagatttgcagtagtcatcaacaatgaatagcatagggcacttagggataactacatgtgacacatcccacagtcttaattcaagctcaactggaaactggcagcacccacccaaacaagcctaagcttatcctgatgatatcaaccagaaagaaatttagatatcatctcagggttaaaaaaaaaattcttggttaagctcaaaacttcacaagtatgtcaatattatacccttttctttgtttaaaaaagagagagagagagagagagagttccctggcaaccaagccgtcaagcaacttggtcgtataaattttagtttaaacaacactatgctattttagctgatctgaagtttggttatgatatgttattaaacctgttgagcttctcttgagcaaacatggagcctatttgagcttctgtcaagaaaatccctataattcatacttatacataataagagcagaaacctacatgcagttcaaaccaagtcaagcctgcccaagctcattcaagatgactctccacaattctacatacagtaaagtcatcatgttttttgcttggttatatggagccaggaaaactacaaggttgcagcaactgcatccttttatcttgagcataatcgcattttttaactatctaggtgtcaaatgcatcatggctaagcatgcccaattgaaaacatccaatctatagtaaacatttgttaaacaaagcaaagtgtagacgttttgcttgcatgtcacatataagaataattgcatttgtcaacgcaaacatgtaaatcttattggggtcgctagactgccataatgctaaagataatttattaagtggcagttttgagctggagatacgaagaacgaaatatactaatctgataaacacatcgtacataatatgcatcaaacacggtaatgtcacggacaattggatgttgcagaaacaaa

SEQ ID NO: 93393 - DNA, 574 bp, Oryza sativa
atcaccagctgcatagaactgtttcagtcaaattgttcccagcagggacatcatctgtatatccaagcaagccatcaactggatcaggacaccacgtcggcccagcatctcttggaaaatcagtcaaggaaggttcaaagcctccatattgtgatccataattgagcgttgaagaactcccactactcggcggttgagaattgtaaggattggcatttgtatattgctcattgcttgaaactgaagagaaccttatcgcctgggacgaacgcagaggcccaacagacccggtactggactgaaaatgcccatgaagaggagcaacagtactctgattctgatgaggtggcataggtgtgcttctcaattctctctcccgcggaacattctgcccatctggaatcctgggaatgttttcatccagggtagctggtatagcaggcagaggcgatggcacagtcaccggaattccagaattgtagagctgattggtgcttattctctccatttacaaacactcaagccagaattatccttcactgtgttaattggcaagaccttttgttgactcgat

SEQ ID NO: 93394 - DNA, 2960 bp, Oryza sativa
ttcctcggcgcctccccaaagctcgccggcgccggcaagagcaacccgccgacaccgttactcggccagcacgcgtcgaacacctccgacgatggctcggacccctactacacggtgcagctggaagggatcaaggccggtgacgtggccgtcgcggcggcatccagcggcggcggcgccatcaccgtcctgcagctcgagaccttcaggccgttgagctacctgcccgacgccgcgtaccaggcgctcgagaaggttgtcacggccgccctcggctcgccgtcgatggcgaacccgccggaacccttcgacctttgcttccagaatgcggcggtcagcggcgtgccggacctcgtgttcacgttccagggcggcgccacattgacggcgcagccgtcgaagtatcttctcggcgacgggaacgggaacggcacggtgtgcttgtccatcctgagctcgacgcggctggactcggctgatgatggcgtgagcatcctgggaagcttgctgcaggagaacgtccacttcctcttcgacctggagaaggagacgctctccttcgaacctgcagactgcagctcactcacctaatggctgcgagatttgctcctgtttcacgaaaagtacttcgaggtaccagtatctcactgtactaaatcgttttcaatcgttggatctagttggacaggatgtgcattgttaaatccaacgatcggaaacgatttggtatcgtgaagtatcagtatcttaaggttctttttattggaccagagcaaatatcaatggctgctgcttcttcctggaagcatatatatggtgattgatatatgtacacatgtatgcagtgaggtgtgtgtgtgtttgtgattattgccagaataaacgcagctatagacggcatgtgctgcggtatgttttactgtgctcttcagtgtgtgtcactcactcacctgcgtgtgcttgtcatcataggctgatatgatgtcagttatatgtgaatgtgagtgcagacaatatccagtccggatctggagttcatgtgtctaagggttcatcaaatggattcattttgtctagcatagtttcctgtggcagaaataatgctatgaatgctgttctgtaaaagtaaacataccataccagtggagtgcatacagagtatggcttcatacctcaatttcaagtggtgatacatattaacagcttcagaaacaaacaaaaaaatgattattaccgcagtcaaccctaacacacagaaatcagtaatcaaacctttaaaatcaagcaggtcaagtaccacatggtctaaaaaaattgaaacacaattgtaacttgtaagacatcttttcacggcattttcgcatattgtcaggagactttgtttaagatatataatcttgccttatgactactgcacggtaagaacaaatatgacaactggaaatcttaacagcaacataaggatatgtttgacaaagacaccttgcattctgaaacacccatgcactggtgcatggatgctcagacaaagaacttccacaaaagccgcatcacactgccctactcgaggtaaataatcacatatatgtagcatggagagtgatcacaaataaacataaaattatcatggcgacatcagacttaaaagtacaggagcagaggcattgtgaaacatggtactccctccgtccaggattataagagattattccctatttggcactcattaaggaagagaaaaaaatgcatctagtaatatgtggaagtacacattggcacattaaataagctgcagaatgtacttatttggagtaaactattgcttttggcaggaaaaagagcatctaaggacagtgacttgatctctgctgtactggataaccaaaatcccctgaatcatggacaaaccaaggcgccattatccactataattgtggccagagggagtacctttgttgctcggagaaattttcctttcaagaagactcgaaagaagaatatgtacgctttatagtgcccaggttttagcaaaatgccaagaaatttgatcaattttaatcatactgcagacatgtgaaaataccatatgggcaaaaggatagtggttcaacaattctaacacaaggatctaaaaagtaaatgaacagattcactcaaaaaagagtgctagtaaaagtatgtcaagcttgcttattactgtaccataaaaaaattgcacggatcaaagtgacaaataatcagccttcagggttcacgcagagatgggttacctttaccgcaaggttgagcaaagtgagttcaactaacagatatgctcaagagtgagcgattgccatagcgcatagaagttttatttgcaccagtttttagtttgaaaaacgactactgtaatagtgtaatttttttcaatatttttgtagtattttaaaaatatcctcataagtggagtactatatctgtccgaaaataactttattttcacccatccttaatacataccaataaaaaataaaaaaatactccctccatgccattttaagtacaaccataagtttccgtgttcaattttaatcatccgtattatttaattttaaaaaaaaataaaaaacataagtcatgtgtaaattactatttatattttatcatctaataacaataaaaatattaatcataaaaaaattcaaataaaacgatcgatcaaaattggacatataaactcatgagtataatgaagcgggatcctctaacataaggtcacccccgacgtggtcactgacaagtgggcccgagagcggggggggtctacatgtcagccactatattcctctgcctttatgtcagaggatcccaatccgcttaaaatgggatgggtgagtaccaatagatcctcaactttatcaaatcctttatctagtctaaacacacaccccaccaaaagtacagtgactgattggagaagc

SEQ ID NO: 93395 - DNA, 997 bp, Oryza sativa
cagatgtgtcatggtaagtgtgtagaatttctttggagtctttgaaagaatttagcttgctgaaacaggagagaaatactaagttgagccttgtcttgcagatgtgtctcaacacatttgataaagcagctgaccttgatgttctgaaccatccgattctgaatttcttttattacttggtatgtcttgattcatttatttcctacttggtatgcttttgttcgtttatattgtcaaaatgttaagcattcaacttatgcagtatgacttacgacaacttttagattttgttatgactaagcaaattatgaaggtatcgagatgagggcagaacttaacaaaggagcatggataatgtgatgttgataatatagtacagtttgcatatgaagaacaataccatatctgactcaatgcggcacgaatgccagctttgtattagagggattttgcgaatattctaaaagaaaaataaatcataccacgggatagctccagaagtatcatatatatttgtttactgttcttatatactaacaaaattctctaatttttttggcagctggttgagatcgtaccttcagctttggtgctattcatcctaaggaaactgccaccgaaacgggggatcacacaatatcatccaattcattagagcagccctggcagggacagaagaggttttcttatgagtagtctatacagcgtggtaaatacagaaaaggcaatgtgaaagataccacacttgctttcgagcttgccccagcttttgtaagaggaagcctttagaatctcagggtaccatcgtgtgtaaaaatgcaatctggtgttgttacagatttagaaagtgttaacttatatatatatatatacctttgttcttcttcacagtgttttccctctgtacacatcactgcaactgtgcctcgcatatttgtgcatttttacctggcgaaaagactgcattttcagtacttgtttcacccaagctcgagga

SEQ ID NO: 93396 - DNA, 1096 bp, Oryza sativa
tatggttgaacctaattttctagtagctccagtataaattactctgattaatgtaactggttaaaatcaaagcatcttcatgcagtgtccttctaggtttctagcgagtctctcattaaagctcttacttaccttactcgaaaaacatgtttagctgttacgtgtttttcttgcatatatattccatacaaggacaatgagctaaactgcacaataaatacacctttgatgattagaatacaaatgccatcaatgtttgtttagtttttacactagtaaagtcaaccttaacatcttgcagtattcattattaagaaaaccattgggactgggctatgtcacatgacctgattacgggtattctatctgaagcacagaaacaaatgtgcatgcattcttttattcctgaatttatttgctgaatatggttctagtttcgcagaataactttcagaaacttttcacagtggcataatcatgtatattcttcttttacttccctccactcttcctattttccccttgtatattttatatcagtctattcatgtttacctcactatagcatactgaatgttaatgtgctatcaacttttccattatgtgcagtttgctggcattaatggagttctgtactacactccacaaattcttgagcaagctggtgttggtgttcttcttgcaaacattggacttagctcctcatctgcatctattcttattagcggactgacaaccttgctgatgcttcccagcattggtattgctatgaggctcatggatatgtctggaagaaggttagacttcatattttacatttttttttgtgattacatgcatcacttctaagtgaaagtattatgctaaccattattctgcgttgtttctcattcaggtttcttctccttgcaacaatccctatcctgatagtagcactagctatcttgattctggtcaatattctggatgtggggaccatggttcatgcctcactgtccacagtcagtgtcatactctacttctgcttctgtgtcatggggttcgggcctaatccaaacattctatgtgcaccgattttcccaccaccgttcgtggc

SEQ ID NO: 93397 - DNA, 1145 bp, Oryza sativa
atatgtatttggcctaatttgagaagaattgcgccggcatggataaccagaagtcccatccctgaaatcctttattgccgtcacctcctaaaggttgccgttcaccaaggatactagtttgcctctgtgatttctccctctgaattgatccagaataaggaaacctcccattgcctgtttgaggagtactgcacatggtttcatgataacttctagtacgtgagtcctgaccagaatgatgatttggatgttctctaaacacttccagataaccataactgccacgggatggtctgttgccattgtgccaatattgattaggaggagcaacttgtgaatagtcaccactataggacttgcgttgctgaaagtgtgttctatgcatgtcctcttttgtgtgacacacatttagtcgtgaatcgtggccattgcttctccttgtgtttccagaacctggaaagtgactccatctcattggtcgactgttgccagcagcaattatgtcatgcctcgatgaccctgatgaccatcgatttgcattgtgggcactcctctgacaagtaaacaaataattgtaaggatttcaaaataagagaactttttgcaagaaatatgtcagcatgttaatcttattaacagctccaattgccaaaggtgtataaaggacattattcctaaataacatgaactgctcatgtgactgaataaaggactagaaacaacaaaataattagcttttaggaaattggggtcacaaagaacaggttctaacaagatcagaaagtatttgctactggcaccacacccagcacacttcaaggcctgcattgcttcaccaggagcagcaggacagtctctcctcacccatatgtgttggagggaaccatcgcaagcttttagtaaccatatgtccctaataaacatgataagtcctaccttccgacaaaagaaaatgttccactttattacctgttctctttggttcctctgctctccctccttggttgcatgcataattatttctgctaaattcttgtcgtcaagggcattaaagaaacatccacgtcgttttgagtcatggactaattctgcccatattgaattgcttgccagcaaagtggctccatttccaaggatccaaaggc

SEQ ID NO: 93398 - DNA, 2112 bp, Oryza sativa
ccgccttgcgcaccgtgacggcgaggcggaggccgtccatggaggccggaacgccgcggacgccggccacctcgacggacaggaggcacccgcaccggcgcttcccgatgcgagagagcacgcgcaccggcttccactcccatatcgccgccgccctcgtcttccccccaacctcggccgccgccgccgccgtaaaaccatacctcctcgactccaccgacgtctcgccgccggccggcctcctccacgacgacagcgagagccggcgcgacgaccgcgccctccgatcatccctccctccatccacaatcctcggcccatcgccaccaccggacctcacgatggcgaccgacgccgctcgccggtggatagcgtccggccgatcgaggtactcgcccaggtcaagcccagagctcgccatcgcctcgccaccggagcccgccatgtccgtccgtgtcacgacgcggagcgcgcgcactgtggcgttggcgcgaagggtgggggggttgaaaaaggaggcgcaactactccatcggacggctcagattcgcctcgttggtcggatcgacggccaggagcgctctgggcgttcctgtttcgtctccgatggccgcggctcgtccacgacggtggcgacgcacgcgaggtcgagcgagtgatcgaattgacgccacgggatttgggtcatggccgacctgtgacttggattagtagagaggaagctttacgacttgggcaaagttgatgtgatcaggtgttaatgcgagcaaagcaagcgagcgaggggaattaatgggcgttggtagaagaagaggaggaaaatgaaacgcggtggttttcgatcgccacggcgatgggagctactgggatgggagcggtgagcgtgtcgtgttgctgagcgagctcgcgtggtggtgatgactgctagctgccgaggtaaccagagacgacttacggtttcctttaccgtcggttaattaccacaatgatagtcccataatcctaccaagtttttctttaaaaatagtaatacgttgatcttggtagtcggttttattgtcgtgatacggtaaccccttcgatccgctatttctcttaataatagaataatatatggcctttgcttaaaaaaattaaatgaatcggcaagctgccactttcattgaatagagggggagtaaactttacaagtgtcagagaaaaaaatcaaggctcaggaacttcagtccgagcaacaaaaaagaaagccaactaccgacatctctcactcctgccaagaaccacgatttggcctcctatttaattttagccagaaggctaccatagctccttttgttgaaaggttttgcagtttctttcgttccagatttcccaagctaacaggggcgctagcatgcgcagggctttctttggagcgtcttttgtatttgcggtagcctcccaccccttcgacctttgcttcaaaataagttacaacgatatgttataaacattattcactcgatatagagttttatttcatatatgacaaggtaataagtttaagaacttcaacataaaacaaatgaaatacatcttatttataagtctccattcaaaattagcaaagatctacatgacagattcctagttagtttcgacattttttttttgaggggtaacgggcaagagctctgccaatttcatttaagaagaagagagaaagacaacaaaggttttgtacaaacccagattacaaaaagaatcttaaggatccttcgagagtagaaagtttggggagaaaaactaaaatttttagaaaatgtaaagaaactataatagtagctagtttcgacatgcagcatgtattacttcttaggccgagtttagttcccaacttttttttcaaacttccaactttttcaccacatcaaaacttttctatacacacaaactttaaactttttcatcacatcgtttcaatttcaatcaaacttttaagagtaaagtccatcaccggtcctaaacttgtaccgttgtgtcatctccgtccctaaactcgtaaatcgatcgttcacgtcctcaaaccttgttcgactgtgttatccccgtccctaaacttacagatcactc

SEQ ID NO: 93399 - DNA, 2189 bp, Oryza sativa
gggcgcccttcgagagcaacctcacgcggctgctccacgaggatctccgcctcgcgccgcgcacaccggacgtgctcgtcctcggatccggcctctggcacatgctccacgtcacggacgccgctcgctacggcgacgcattggcgtccgtcgtcgatgcggcgaagtcgctccggtcgccgctccccgtgccgccgccgcacatgttctggctcggcctgccgctgctggtgaaccacatgctcaacactgatgccaagaaagtacacatgaacgacaccattctgcaagcctacgaccttgaggtcgagcagagggggctcttgcagcgcgacggtggcccgttcctactgcttgatgtaggaaagctctcccgggggtgtgggcagcaatgcacggctgatggaatgcattatgacggcgatgtgtatgatgcggtcttgcacatcatgctcaatgcattggtgatcgagtcacaacagaggatttgattgattgggttcttgaagcaggtgtgttctcacaccctgttcttttggtccagtataatacaggggtaagtaggaattgttgtgaattaggggtgttcttttgatcgcttcaacattttggtcgcttgccagaatccatagttggattcctcaaccttagaatgtaatttaagggaatcttagaacaacactctttttctccttttctttttgggctaaatggcaagccgagctgttgtgttgtatactgtttctaggtaacaactgaaaatgatgattcgaaaatgtaggagaggaaacattctggaatgctaaaaactagtcatcctttttgtttgcagctggagatattctgtgttacaaacacacaaatgttttctgaatcatgtctattgctgctatgacatgttcagtgtttctttttggtccatgaaaccttcaaatttatggtttgtataagtctaggatgcatataaaatgcaaaattgaaccataactgtactgctatcctttgtcaacatagttctttccaatgggcacaattgcatcacttcatagcaataattatgctgcataaggatagtggttgagtaagttgtagtatctgcacgattctctagctatatataatacttgcatacgggtcatggatgcatcatgtataattgagcacacagttagaaatttacaaatacagcgacataatagtaaagaagattatgccaaaaatgcaaaagttgtttcaatgcattatatgcagtagctctatgctcagtcacattgacactttctgtgcaattggaaccacgactttgtgttagcttcatttagtatttcacactccattgcactccccatgaggtggttttctttacaaacttttaatcaactttagattaaaagttctgaaagatatcctacaaacagggcttatcgttgttcgtttataacactattacagtagtctgtgtttttatttttcacactacaaactagtgcaaataaaacttttatggcctaatggcaatctctccctctgagcatatctgctagctgaactcactttgctcaaccttgcagtaaaggtaatcgatgtttgcctgaacttctaaaggctgattgtttgtcactttgatctgtgtaactttatggtacagtaaatggccccattcatagaaaagaagaatgcaccgtacaccctaaacgaagcagaagggaaccactctttttttttttggtctaaatgacaagcccagctgagtatatcttttctagatcacaactaaaaatggtgattccaaaatgtagctaaggatatattgtggaatgttaagtactagtcatcgttttggcttgcaactggaggtattctctctgttacacacacataaatgttttctgaattatttgtatttctgccatgacatgtttagtgtttctttctggtccacgtaaccttcaagtttcttatttggataagttcgagatggatagaaaatgccagattgaagcttaactgtactactatcctttgtcaacatatttcttaccaatgggcatcttagaacaacactgccttttttatttttctttttgggctaaatggcaagccgagctggtgtgttgtatactgtttctaggcaacaactgaaaacagtgattccaaaatgtcggaaagggaagattatggaatgctaa

SEQ ID NO: 93400 - DNA, 3325 bp, Oryza sativa
tccctttccccctttttttcgctgcctagggtttgcggcggcggcgcccgctcacctcctcgccggccggacggcgcgaggaggaatctctccacccccacactcctcgcgccggtgcccctccctccccctccatcctcctcgcgtttcgcttcccctcttcgcactactccgactcccagcacggaagcgccggtgtcgatggcggacgatgccggtgccggtcgcactcgcagtcgcagggatccttccgatcgccctacgcgttcaggccaatttctaatcagggctttgctacgaggcgaattggaggagcggtaattttccattctttatttttcttttaaatctcctccatgctctgtcgttgttttttcccttacaatgttgttgtgtaggagtagtttttttttaattggattcataacattataaatttgcatgttttaaaaaataataacattataataattcatataatcgaaacaatgccactaaaactcctatgaaagccaaatgggagcggttgggtaactccgaggcgctcaacggatcttgccgtcgtgccatccaggccccaacaggtgccctcaggctgagatattgaactatatgctacttttagatgtggcaattctagggggagttcctgtgcccagcacctcaaaaatcatattttttagctattccattccttcaacaccccttctggtcctttccagtttccatccctctcatcgcattcctcctgtgtttctagggatctctgtctcagacctttctccaaaaatcaacggtattgtcattcaaaaccctcccaaccgcgtctggtatcctatatcgctctgggcatcttccgcacctaggttgcaagttagaatgtggcaaactatatgattttggtgggggcagatagtttgcatggagcagtgtttcagttccatagttcgttaattcaggcagcttggccagagcagcattcgacaacatcttctcaactctgtcaggaattacaatggatatcgcttagcaaaaggcctctacgcttgccctaaatgtgccaccaacaacccgctctccgccccccccccccaaaaaaaattttttttttcatggagctccctcattaggaacaagaaattatcgcgaggctttactctcctcaccaaccgtccctcctcaagcccatgctcctcctcggagaaaaccgatgcttctgctctgctgctgctcgctactgaccacaaggttaaacactgtagagatccagttgtgtgcaccgcctgtcgttgccctggccaccggcaggacaactgcccctcctttgttgcttcaaactttcctttcgggggatctgcagttgttgcttccacgacctcttcctccgccaacctcttgcctctgactccctcgcctctgcgccttcgccaccacctcgccaccaccgcaacctcgctacccctcttccacccgcttctcggctaagtgggtccgcaaagccaaacaagcacaacagcagtgacggatcccctctgctcccttcccaaaatccatccaatctactgccatgcaaccctccttggctccgtctctctccctaaattccttgctagcctttgcttttgaaaccctaacagatgaggagcttctcaagtttcttgcggtagaagttctggaggtcgctatccgctccaatgtggaccaccatgccgttaacagggaggcaagaaagggaaaggctattgttcatgcatgtgcgcctcctggtggcccctcatccccttcctgggatgtgtttatttcccaaggtacctcgactgctctgtgatcctcatcccttgacattcctctgatctccttttcccctccacaccctgctgctgctgctggaggtattgttcatgctggatctagaggtagcggatctggatctttgaaagaattagaatctggagattctgtttcggatgactccaatgcccccactcatcctagaggaccgggtactccggaaccggtctcgagctaagcggatgccttggggattactaactttgtggatgttttttccccgtactcggatatgagacttggtagtcactatgcttatgctttcatggtcccctcttctcatcccccggctggaaacatttgcagcgcgatgagggaatacctacctgacatgcatttctcccttcatgccttttgtcatggtgctatgatggttcatttcaatttgttgcaagacagagaggttactgctccacgcccaacttcacgtcccccacacatcccatccttaggccttagctatgccgggctgccagcaagggcgtcaacggagcaagcggcagtggacgacgggtccagcgttggcgacacagcatggagggaggagggcgatggacgtgccgttgggtggccagctctatgggcccatcctgctggagttcgggatgcttccggcacgttcctcgctcgattggagttcatctctgcagcgggtggagctcgccgctacagtgggtggctggctttgaccttgggtgttggtcatcgccggcaagctgtcgatcctccacaccggctttatttttctcttttttttcttttcttttgtttttcttttctttccctccgtgtaaattccttttccaggggtgctttcgttcgtatgaaaaaatagtaaacaaaaacacttgataacatggaacaaacgtatggcatggcatggaaccacttttgagagtattgcagtagcatcgatctaattatatgaattataatgttattttttgaaacggtaaaatttataatgacatgaatccaattaacccttttttgttacagttttgcttttgtttcaagctgtagcaactgacacattttctctttcctcgcattctgttgatgaatcacagcactgcagacgcaaggtttatcccacttacaccaataatggaggatctatttgtcaggtatgcttattatcatgtctttcctatatttttcttggctagcttaatgctcgtgtgttgcaacagattctaaaaaacattcattgacataaattaaaatcataaacaatatattacaattgggcataaataatgaaggaaatataaatatagaaataataacatgaaactacaaataactttggccggaataataattcaatatcagaaaaattatataactaaatccccattttttttttcatttagctataaataattcaatacagaggaaaattataagttacaataatttttagtggatcaaatagtgttaaaactaatagagtaaatttcagaaaactgcc

SEQ ID NO: 93401 - DNA, 920 bp, Oryza sativa
  unsure (1)..(920): unsure at all n locations
gctcaagctggggttccagctcatggacgacgccggcctctgcctctacacccaggcggcaacggagaaggtcgacgtcgtcgacgacgtgtcgccggctcttgccagagctcacaacaagaactcgttcagcgtcgcgaggacgtcggggcccaagctttcagcatccgacgcggccatctcgccctccatgagagcctacaagcagctcatcgataggctcagcgtcgacgagcatggagatcctgtgacgtcgctgatccctcggaagctcgccgacgacgaactttccggcgacgtcggcctcccggagtacgaggtggttgacaagggcgtccagaccgtcaaagaggtcgtccactaccatgctcaccgcgacgtgcttaaagagctcgactccattgccgagcanatcgaggccatcgacgcgctgatgaccaacggcggcaaaagtcgccgacgtcgccgaagatagtggatcagaagcagtgcctcgacgcggatgaggagatggtgaccgtggagtttctaccgaagctcgaggtagtcgacgataagggcaggaagctgaagcagcccatgacgccgagaagcgagtcggagaagaaggcggcggcggcggcgccgccggtggtgccggacttggggccgggccttgggacggcggtgcaaacgcgcgacggcggattcttggtgtccatgaacccgttcgacttgcctcttgagaaaggagatgcacccccgaagctcccatgcaggtgtcgaggccgttcgtgctgccgagctccatggccgcgactgggttcgacgtcctccagaagatggcggcggcgggcggcgccgactaggtccgggacaaggtggcgaggctaggcggcatggacaacctcacggggaagacgcccgagcaggtgggcttt

SEQ ID NO: 93402 - DNA, 753 bp, Oryza sativa
taataaaatatattgagcaagtcagcagcttatcaaacaacagcaagcaggttatctatgtggcaagccatatttaaacttatttctttcaacaactatgtgaaaactgaggccttagcccttagatgtaccttttgcaagtctttcaacaatattggtcgctacagcaacctcaaccatatttttggaactctggccaagttcatcaagcatttccatatcgttttcaatatgaatgaatgaataagcaccataaatagggccagggagataactcttcatatagtcttcctgttggacactgggaccatcagaaattcggttatcataaaagttggcatttggaaatttgttgatgccagggtgcatcctatattgtacttccagcaaatgctttctataacccattgtacacaatctctcatagagacttcggccaaagtcagcatctttagcaatctagagtagcagtaaggagacagtatgagcaaagctatagaagtcagaataattattggcaacaatatactcataataaaagagaacatgtccatgtatattatcccataccaatggcataccttactctttaccaatgatgataattggttttcatctccaatcagcagaatgtgctctatccctgggagcaagagaggaaccagtgcttcgcattcttttagttgtgctgcctcatcaataaccaagatgcttataggcatcacgttttgcaacctgaacaactcaaatgaa

SEQ ID NO: 93403 - DNA, 5314 bp, Oryza sativa
  unsure (1)..(5314): unsure at all n locations
gatggatgaaaagaagaaaggagagaggacctggagagtagatttcccgagaggaaaaaagggagaagagggtttttagagtaagagttctctggctctccagctctttgtagcttcttcatatatagatctatcaaaacacaggagtagggtattacgcttctcagtggcccgaacctgtatacatcgcccgtgttttgtgttttttccattctcgcgaactttccacagaccaggagcttagaacctcacccagggcccccggccgaaccggcaaaggggggtctgcgcggtctcccggtgaggagccccacgctccgtcagctttgatggtggatcgattcagatccaaaaaaaaaggaaaaaaataaagtgggggcaagagtggttggttgggtatgggaaacatagaatatataccggaaacagagaagttgtttttatcgagtaaatcatttactccgataatggtgggagcacgatgcgggacgtgtggtgcgatcgcaagaatgggagttgtttttattattgaagtaaatcgtttactcgaataaaggtgggtggtagaggcgcgcgataggagtaaatcgtttactccgacaacggcaggagtgggatgacgggacgtggggtggggtgggcctgaactgatgcatgcttggttgaaatattaggagcatgcgtagttctactaatttatatgaaatgtctacaaaatatcttcgctccaagaaatattatccggaaaacacaattctgtggaatattctgttttcgattgtttaattatccggcggtcaattgtgcttgcctccttgctggtggtcactgaaaaacagttctagactgctaatcaattaacacgtgcagactagaaggactaaaataactttaaaattatatatacgtcatttcacaaagatagtacccaagcaatatatggtcgatctagcttgtgcaggtgctcgatcggatcaattactatttagtctaataattgatcgaacaagaacacaatcagaaaagagattccaagctatatcatatctggaaaaaggtacagatgctaattgatttaatttgagttaattagctccagttattgcaaatatttggtctagttgtacttgtacgggcatatatggttgcttcctggcactaattaatctccatggcaggtgggcttaacatctgggaatctcgcttaccagacgactaagttgtggtgctaatgtattcagaatgacctttttcagatgatttattgaattatttttaaagtattaactagattattaatacagattagttactaatatgtttttaaaacttcttctattacataactgaacattcgttttagatctttgttaagtttattttcaaaatatttatattatatctaaaatcaagtagatatttcatggtaataatctgctcactaatctaaaataaacgagaccttagtcgataataagttagttattcttactcaaacatatctaccaagtgtgtagtcccatggattaatttattaaaaatcgtatgtcagactacatgactatggggaatggatttaatgtggaaaaacctttttgggaaagaaaagaaaatagtgtagtttcaatatataattgcggttttttcaaattaagatgtttttaaaacacaagtacaatgttttcctaaattagctagaaaggttaatactttagtatgatcaaatgccataaaccacaaaataaaaccatctagctttgtaaatgggattcaactttagtgtgcctagccaacataagctccggtgccagaccgatcggttgtaaagagaattcattcactatacgttgctttgaatatatagtaccggatgtcgtacttgttcatattacataatctccggtgccacaccgatcagttgtacaagagaattcattcactatacgttgctttgaatatagagtaccggatgtcttccttgttcatattacataatctgcggtgccacaccgatcggttgtacaagagaattcattcactatacgttgctatgaatatgtataagtaccggattgccaatcttacttgttcatattagaagacaattttccaaaaaaacaaaaaaaaaaccatcttgagcttcctgtttcttatactccctccttcccataatataagaagttttaaagttagacacggttattaaaaagtaggtataagtgaatggtggagggttgtgattggataagtacgtagtggaggtaggtgggaaaattgaatgatagagggttgtgattggttgcgaagagaattgtggtggagaagttgttatattttgggacaaattctgaaagctaaaagtttttatattttgggacagagagagtagtgattagtaaatatggaagcacttacaagttgaaattatggaaatatgctactaccaatgttggatataatcagacaaattcagttggcaacatcagtcacaagtcatagacttctttcaagatacctctttaattagttaattaatatcatagcaagatctggctaatcttcacatcttttagcaaaaggatcatttgtctttgtctttatatgtgccaagtgccatatcagtatcttgttactcaatggttgaaatttactagagctctcttaattattcttctttcttgtatacactggtcctaatccaaaagcctccaattaagcagggaacttcaaattaaagtctccaaactagatatatcctaaggtaggtcagatacgttctgcactataggctttaatttcagtatgtactgctacaaatgctactacccaatttagagcactttagcttatctgggtttaagttaggtcagatgcccctccactagcttttggctgctattaactagtttcaatcgtgtgtgcactctgccaattctcctaatttaagagtaagtaacaataattacctaggggattaggatgcttaatcaagtatgaatcatctgatgatgcatgtcatgataataaagtaggattgatctgactcttactacatgggatgagctgttcttgtgctagttatatactccctccgtcccgaaaaaagacaaaccctggtttccgtgcccaacgtttgaccgtccgtctcatttgaaaaaattatgaaaaaaattaaaaagacaagtcacgcataaaatattaataatgttttatcatctaacaataatgaaaatacgaattataaaaaaaattcatataagacggacagtcaaagttggacacgcaaactcagggtttgcctttttttgagacggagggagtatacttttagaccacttggaacaataatgcagagatgatgatgccacacattctgtatgtatcgagtgtgggagaagataagatatcatgcagatctaagttagcaaagaagtgatgaacaacctttttagaacacaaggaagaaaaagtgctccagttgagtattgtcatttgtgacagtgaaagacacagataatcctttaatttattcgcatcaatgtattattggatgtttgtccaacgaatgtaaaatcctctggattcggtcaagccgtccaccgtaagttgagtgcgttgagagttgggagtgtgtgtgatcaactaactagctttgagtgctccagaaattatctttcagttgtgagttgtgacccaaggttttgtgaattgccaaaaagaaagtagtcttaggttttggcaactaccaaagaaatcctcgtcctgggactcccccttagaggcagtttaattattgatgtctctctctatgaacaataggagattgttttaacggcaaacaagattatattgtttcaggactaggggaagcaccattggtggttatatatatagccgtacgcatggagtattacatcatttgcaagttttaaaacgtagaaacggttttttttttgaagggggaaggcgagcgaaatatcataaatttgaggataaataatttttggatcttaatcaaattagccaaatttcattttttttactaattttaaatgaatgaggtttttttttttgtgggnnagnngggttaggggagtggggggggagtattgtgatagatatccaagctgagaatggcaccataataggctcacattgattagtctaataattgtgtagagtttgatggagctccatcctacggagaaaacagagagaaaaggggacaagctagggaggactgtggtagcttggtccttgaggttgtgacccatgtagcgcgaatgcgcgagatcgaagaaggatggggcaatggctgaataagttgataggtggacctgtgcattagtgagagatatgtgaatagtgttggtttgtaaccgaaattttgataatttgatctttaaaaaaacttatttaaaaataaatagtgtcaaaaacttattttaaaaataaaccgtgaacttagggtcatcggaattggcgtagaggtccaatgactcagcaccagccatcatggtgctaaccactacccgctgatgaggctgtgtgcaaggtgcaaaagggtcagtgccatgttccaagtaaggtcttaagtagaggatatgtcctttgcaatcgtcatccccagtgtagcccaatggtaaagctcttcacttggcagggttgtgagttgtgatctaggttctgtctctcggtttgcatatttttatttcttttcccattggtaacagataaagcttaaaaaaagtagtgctcaaagggagaatcgaacctagtaaaccactagtccactgtgatgtattatgggggtcagtncnatnnngnanggnattcccccccttacactttgcacgtggacttgttagcatggtagcggccgattagccccatgctcgctggagctgagcgccattggaccttagcgtcaatcccgatgacgctgaggtcacggtttatatttacaataagtttctgctatggctcattttttatataaatttttaaaaggttaaattatcaaaatttcggggtttgccaagtgacatgaaccacatgaaccgtatgtgtgcatgtctagggttgaagatgattggattggctacaagctagggaacatggtgaggaggatgctggtggccacaacgaggagctcaaaggctttctatagaagggggttgaagatgctggatgctggtggagtggtggccacactagatccattaaaggaaggattgggtgattgggtctaccgtctacgtccactacacgcttaaggacacaaagttgctaccatacttagggcctgtttggt

SEQ ID NO: 93404 - DNA, 685 bp, Oryza sativa
tagtacttagtactaagtaaggctgcggcgctatgactagatgggctatgaactggcaaaattcccattctctgggtttgattccacccttgcgtctgtgtgtcacagccctttttcagcatacatttttcagaatgcaaaaaagttcaccaaaaatatttctgctatactaccattataatagaatgccaccagtaacagggagaacatgcacctcaaggtaattgtaaatcggttccccatcagttgaccaagagcaagaccttccttcacataactagaacaggttaaataaattactgaggcagtcaattgcttttagtcaatgacattacattgatgctgaaagagggatgcactttcttacctgaagtctccaactttaatgccaatgagcttactgttaagagcaaccaacctactagcttgcaccttgaaaaccgtgacctgatcagaagttagagaaccagaaaaatcatgactgcaagaaatgttgaaaacatagccctttctgtttattttcaaaccatagcacccattcttccttgagatgacaacagccaataccaacaacctctcttaatttctttccatataaatcattacctcatgttctttatataacaagtttgttattttaaatatcacccagattgcccatcaaacccatgaaaagaaagtcaga

SEQ ID NO: 93405 - DNA, 6410 bp, Oryza sativa
gtgtatgtgtgtgtatgcgtctgactgcagaaataatggctggaaaaggctcgatcaagggaatgaaaaggaaatgcaaaggtcaggaccgatgggaccgccactatccacacgagaattaagtttgcaaatattaatcttgcttgcgttgtttgagaaacacaatcatgcatgttcctcgcggaaataaaagtaaagttaagtagataagggttaatcagtgacgggggctcataattttgtataagaaaataagagcaaaataagagcaacaacttgctgcagaagaacattaaaggaaagtcgtaaccccgatggtttttacacctttcagctgtaagctcaaagccgacatggatcctaattgtggactgtatgtttttttttttgctttgtagaagcatcactataacgtaaattagtgaacaaacaccaaatatagaatataattatataaaataagataaccatgatcttctccactggtgagtggtgactgacagcaagcggtgtagtaagaaaaatactgcataaagaaagggatatgaaatatccataatatgcatcaaatggacgctaagtgatcgatcttatacctcccggtccaaaacgtttcaaagtttgagttaggggaagccatgggccacccatcttattgttagcgacagatcaactaaaatctttcccaagttttgaccgaggttaaaaactaaatggttctgatagttcagattaaatagtatttgattttgaaagttatttgtttttcattcttcacaacgattcgaggttgcacaatggtcctttacttttattaatttctagggaccagggttattcacgtcattccaatttatgtacttggtcataaaacaacatatatattctttcataaatgaaccttgcaaaaaaaaaattggagaaaatattgtgcttttattggttaaataaactatttacaccaactttttcatccacacctctcttgtttcaaggaccgaaaaatcaaacaaaaaaatgaataagttactcttaatttgcaccgggtaaaaacacactgtttcactttacactaggtttagaacatactttcgttttacaccaggttgttttaaaataagtttcacctagcagtaggatacatcaccaaaaacctatagaaatttcatcaaattttataaaatacgaatggaactttgtaaatcatggtctaaattcaaaacatttcataagtttcacctgtagtttataacattttcctttaactatatgactcaatctagtaaatgtcaaacttattttgatataacatggtagaaagtgaaaatttacagtaaagccagtttgaaacaagatacattctacccagtacaaacttcaatttacttaataaaaaattcagctacacaaaaatgtcggtttgatttcgctataacgttagtgtttgactatataattcagtgcgccattgtaagtaacaacgtcttatagtccgatacatttggttggctcagctcgctatccagttattagctacgagcaaaccttgggggactctagagctacacttctgagctttaaaagtctaccaactgaagcaacaaatcaaggtggcatatctacctgatgcgtgagtcgtggatcgattgttcatatattttaagttgtgctcccctacgttaaataatatccaatgtcgggactaactaaaccccaaaaggtggagatcacaaatatgattcacacgggcagaacttgaactttttggtcaatatcaagtacgtactatggcatctaataattgaagaacccaaaaggaagaaaaaaaaaactacctcaattattggcatttcagtacagcgctagtgatgcatgtacacccatccaaggacaagaaaatatgcttggaaagctaggaaatctagcttgacacggatggacatccacttggcaggtgcatgcatgtgtggtaaacgactcaacactcagaggtggcctgtggccacccattttgcgtttgccattgtcctcctctgcatataccacagtgggagaaaattccacggataagacccccaatttggatgcattgctacttcctaagcttgctatcataaacatgctttgctgccatgtgctccatacctcctatagtgcgtgtggatcagaggatggtgcaacttgtatgtgtatctagatgatgtctatgtatgtgtagtactatttggtcagaacatgtctagcctcacaaactgccactactagaaaaataaattttaccaacacgaggacttttatttttccagacgaattaaaaaaataccgtttgcaaaaatagctagaaaccccctagatctagtcccgcctacgacaatcgaatttttctagacagagccttaagcactctgcctgtaaaaataattttggaaaaattttattatcgcaggagggaccttaagtggtctagcggcaaaatatggagatacgtagtagctattaaatccgctaagtcccaagacctccacctctttcccccactccctcttcctcagcctctctcctctcctacagtagaagtcagcatcagagaggggaggacagtggtggaaaagggtgcggcggttcagccctcccctcacccccaacctctccctcccaaatcccaccggagggaggagtgcagtggcggtggcggaagagggtgtggtggagcggccctccctcctcgcccctccctctctccctcctagatcctgtcggctggggagtgcggcggcggtggcggaagagggtgcggcggtgcggcccttccactttctcccggccagatcccgccgggaagtgcagcggcggaagaggttgcggcggcgtggccctccctctccctctcggccagatcctagtgcagcgacgcagccctcccctccctatttcttccactccctcccatcctctccctcccagatctggccagaggggggaagtaggcggcggcgacaaaagagagtgcgaaggcacggccttctcctccccttcctcttcctctcagatccaaccggaggggggaggccggcggtggcaactgcaccagtagagggcagcagggagaaggtaggcagtggcggagctgtgacgacaactccttcattggcaccacactgcgatgacaatgattatgtttctgtttgttgtttccatgttgattgatgttaacctacaagtcggtgttgtgaatttgaatccggtgctcttgtgttgatgtatggatgtttgtgattggaatttgttggatggatgaaaattttgtgagaattgtgatttgttatggtagcaaggggtgtgaaagcgggggggtctggtagggattttttttttttttgctccgagattattttcgtgggcatgcggctatagcgactgggaagatggagaggccgcctgtggcacttggtccacctactaaaagttgatgattttcatagtcctttaggtataggcggaagatttggccacttacggaaacatgttttggtcccctggaaaaaccacttctcaagttttatatttatatataatatataggggtgtgctaaaacgcaccctaggtagtaaatgttttactacgagttatatgttagacttagtacagggatttgtgatggcttcacttagtaaaaaatgcacactgaaagtgcaatcatcacaaatccctatattaagtctaacggtaaaatatttactgtccagtattagagaacatataacgcgtagtaaatcatttactatgtgggaagtgcgttttagttattacgcacccagggttcgttatattttacaccttttagtttgttaatttctcgctttattagaggctggagacctttgaaattagagagagaaaatttccatgtggatctcttggatagcaacacatcaagggcaatgtgcagggtgtctggatgactatatcttgttggaattgctaaatggcatttgacaaaaaaatcaagtgggtttcttacagattttgaaccacctaatttgctcgaagatttttgtatgcccaactcctcctcgatctagttccggggactagcagtgacccaatgagttacgggtcagggttttggattggggtggccgtgggatgggggtaacagccaacattggcaagcagggcaaagcaaagcgtgtggttatgaggcagcggtcatgagcaatggggagccgctggagacggggaagatggtggtgcaagggcacctagctgccggcggatagaggagaacaagaggggggagggggaaagccagccaggatgggccttactggtgaggctagacagtggcgcattggggcggtggtagcggaggagacagggttgaggcgtcgaggtcgctggcgttggtgcggggcgggtagagggaagaagcggaggagggggttagggtttttgggatgtgctcaaatttcaaagggatctaacgatctaaaaatcacaatatattaggaggcttctatcaaattgataatagatggtctcatttcttattgctagcaaccccgctataaggttctgtaggaggacaaaggcattattgtggtcacatataccatgcacacaatgtgcacatcgcaatatgtaaaaaatggctgtgcattgataaaaaaaaagaagatattatattctcggatttagggatatttgtgagcatcaggatttgaagagaatcatacattgcaatatatccatgactctaccattccataagaaatgaatcctccttgcttaccatctgtattacttagaaacaatttataaacatagatgtattgaatattctagccgaagttacaaaataaaagggccctgacagatagctctagtcactagctaccagaaactcaactagccctgacagcccaaacagtcagcaaaatgcataatcacgtcaggaaaatacatcctgatatggcactgttaggaaaattccgtcagaactgacttgtcggaatttttttaattttcctgatgtcgttacttattataaaaaaatatctttttgtcacctaaagagcttaagaaatatattcatgatatatgatgtgatggtcgatttagcacatatataaaaaatatcaaatatatagggttttttagatacaaattagttatagtagtaattttgttacgcatctgaagacacttcttccttttcataaaagaagaaaataattcattaggtaatgtactagtgaaggtatatatgccaggatttagcttgcataggtacgtgtatgatattttactcaatctgtaaatctctattttacaatcaatatgcaacaaataaattaatcattagtataattttactgaactttatttgaatttataatttcattttaagtgatgaaaattttgcatgagttagtcactccagctgaatgttgggaagtacaaagcaagcagttaaacatatcaatgagtgtgtctacattttaggcgacttaaattttaaattatctctgccacttttctcattccttaataacaatccaacagttctcatcacttcctgtaaagttcctcatttcttagatataaggttggatgataaattattctaacttaaatatgtaaacatagaataaacttacaattagtaaaagtttacaacattgcatggaaattattcaaacttggatagacaataaagcaagtctttctttcgtttccatcccatcctcgtgtcagaaaaaaccgcttagtttccaccccatcccacatcaaataaaacgctcaataaaccgaaagaagaaatatgagagagaaaattgaaccatgtttcccatatttaattgcaacccacgggtatatgtgagtcacgtaataacaaaattgaacttaactgagctaaagttatgcattacatacaactgaaattttaagattgacagatacaattctatatgactcaaaactatacaaactttaatttttggcgtgtcaaatctagccaacagcaacaaatagtcacaatttaggtacataggctattgttggttgatatatacattgtatggccactaatatgtcacgatgtaatgataaacacgagacaataaaatattggtaaagatgggtgttagggatgggtctggatggttattaattggatgtgacaatatttctttcatatagttttaaatttagggcctgtttacatcacctggcaagttttttcacactgttacatcaaatgtttggacacatatatgaagtattaaatatagaaaaaaaaactaattctacatattgcgtgtaaattgcaagacgaatcttttaagcctgattgctacatgatttgataatgtggtgctatagtaaatatttactaatgacagat

SEQ ID NO: 93406 - DNA, 1644 bp, Oryza sativa
ccccccggttaaagttaaacaggatgtagtcacgtgcagcggacaacgcaaagcccagagaacaaaatggaacagaacagtcaggatcaatcagcctcgccaccgttttgtcttttacttttccttttcttgttttttgcatggcatgtggatggatgaagaatgacgcagcagtagcattagtaggagtactatccctgattctttcatcttggacaatgctggactttgcagctcacagagagataattcctgcagcggcgtcatgccaaagccaattgtatttaaccctaatgcctcatcagatcccctctcagaggcttccccaggtgcccccagcagccagcaccacaagaagatcatattgagcatctcaacactgattgccattgtgggtggagcgttgattattgttggcgtggtaactatcacagtgctcaaccgtcgtgtccgctctgcggcctcccactctgcagttcccactgcactatcagatgattatgatagccaatccccagagaatgaagccaaccctggcaagcttgtcatgtttggcaggggcagcccagatttcagtgcaggtgggcatgctttgctgaataaggattgcgaacttgggcgaggaggctttggcacagtctacaaggcagttttaagagatggccagcctgtggccatcaagaagctgacagtgtcaagcttggtcaagtcagaggacgagttcaaacggcaggttaagcttcttggaaaggtgcggcaccataatgttgttaccctcagaggcttctactggacttcatcactgcagctcctcatctatgactttgtgcctggcggtaacttatatcagcacctgcatgagtcctcagcagagagatcggtttcatggatggaaaggtttgacataataatcggcgtagcccgagcccttgcgcacttgcaccgccatgggataatccactataatctgaagtcaagcaatgtcttgctagatagcaacggcgagccaagggttggtgactatggccttgtgaagctgctgcctatgctggatcgctacgtgctgagcagcaagattcagagcgcgctagggtacatggcgccggagttcacatgcaggacagtcaatgtcacagagaagtgcgacgtctatggtttcggggtgatagttcttgagatcttgacaggcaggagaccagtcgagtacctagaagacgatgtcgtcgtgctctgcgatgtggtgagagctgcactcgacgatggcagggtggaggactgcatggatccacggctatcaggtgagttctccatggaagaggctatgctgatcatcaagctgggccttgtttgcacgtctcaggtgccctcccaccggccggacatgggtgaggtagtcagcatgcttgagatggtgaggagttctcagggtaccccagaggatgatctggtttgaaatctattttttggttccatttctctttccctttattagttcctttttttgtctttgatagatgggatgattgcaaagaccaaagaatgtgaggagatggctagtgatttagcctgcttgcaatttttcagggatgtgaagccgttgcttcggatcagttcttggtcccttttctagaagggctgcaggaa

SEQ ID NO: 93407 - DNA, 4646 bp, Oryza sativa
tcaactgccatcgccgactcaagaatgaactaggtttacacccggataatcgaaacacgataggatggggagatacccaagacacctccaaggagggaacgacaccgtaggcgtcatcgtccgggctttcgccttggtcaccaccaagctatcagtgctagagcagtcccagcgtcgacaattacatgcacgtctgctggtgtggaagcaatcgtcctagcccattgccgcacgccgaggtggcctactttccagcaccacagccgccaagtccctccacgaaaaaggagttgccatcaacaaccgagccagcgagcgcctggatacctctcgccgaccaaccgggcggaagacctgtggcagaggcccacatgtacccgttgccaacgccgcctgtaggctggcaaagagcttcgctgttagggactgacgcaaaggctgcttgccaccgggaggagccccatcgtcgccgccggaaggggccccgtagcctccactatccgcaactctggaagttgctcacctccgcctcacgggccggggaggagttctcatgccgccaccgccgtctgctggctggggaaggccccagtcgccgtgcggcacttctgcccgaccaccaagctggcaccgacaccaccactgccgcacccagccgccgtcccgccggttaggctaatctcatccacggttgaaccatcaacggctgaaactgctgctgccttctccttgggctctcttttcttcattggctgaccggggcagatttaacgtataatcaatgggggccttggaccgtagtcaaaaattacactcattagatatgtccctaattgtatgacctatgggcccccactctaattgggaagaagaaccccactccttttttctgctccttccatcacgcaaatgcgtgcatgtttaggcttcgaatgtccgttccccttctctcaatcccccaactggcaaatccataaactagggattaggaaatgggaagagacaagcgagcccatcatcatctcgccccatctattttgcttccgtagaccgcacttcaccttcgccgcttccttgatcactcaccgtcgacgttgttctgcacggcgcactccatccatgaagaagttgtggcacgttgggcctgctgatctctgtatcactcggtgcgtactgatatctccctctcatgcagtcaataattgatgaggatgactctctagggcagtaggtttcccttcaatgctctatctaatcatccttgtcatgatctgataagggagttaatggacaatttttataatgtaatatctcaaagtttttataagtttgtatgaggtgagctccacttagctttctaacttgttatatgagttatgtatgcccgtgagtttcacttagctttctacttaacttgtaatatgagttatgtatgtccccagtcaatttttttaatgcgtccgcccctgggctgacgcattaacatacacgtcttggactcctggttaggctaatctcatcaatagtttcattggagttttattcttaataaatgagatatcacataaataatttgatgacatggagaaataattatgaagagagagggaaagagtttcatctgagtgtatcatgtttcaaagactatgaaactggttgaaactagcattggaggctagagtgtttcatctcatccaaatgtaatcacatattcacatgtatcactattaaatgctatgacaaacccgtgaaaccgcaaaatgaaactgtacattggagatcttatttcatttgtatagacctttttagatgacatggcactcttggtaacggtgagttgaaactctccactggaaatgaccttagagaagcttcagataatgtgggaatctagaaaaaaaaagggtttgttctttaaattctacaactatatgttttccaaaaagtaaatttcacaaaactacaggttcttcaatcaaactattgtataactacatatttaaggtgttgtatcacaaaatagatttaacgtgaaatttattataaactacaaattcaagatagagtgccaaagaaataaagattaagtagtaaatttatcataaaactatggatttagtacctgtttaatcataaaactacaatgtttatagctctaacataatgatagtgctaagggatctaaacttagaatatgtagttttgtggtaacttcaatattaaatctgtagttttgtgatagttgaccttaaatatgtagttttatgataaatttagtgctaaatctactgttttgcgatacatcaccttagactcgtgttttgtgataggttgatcaaaatatatgtagttttatgaaatttaatcttgtcatgatttgagatcccctttgaaacaaaagaaaaatatatgaattataaaggacttatatatatcctatgagaaattggattgtttttttaccaattcctttaaaattcctatgaaataagccattctctaaagcaattttaaaggaaaataagcatgagttctcactccatattttcccatgtcttaaattcatgtgtccgaatcaaaccacggttctaaaactttcatgtgtttcgaaattccacaggacttcaatgagcatgacatttttttcatgtgtcgcaatcttgcgttttaaaggagtacaaaataaaactctaaattatttgaaaagcttaagattaaaagaagctgctagcttcctaattaggggtgaagacaaaccttcccatgcaatgctaggtcgctagccttgttttcttccttgtcctcttgctgcatgttgacacccaaggtatttatgaaccaagagcaactgatcaccaaccagacgtcttggccacgaaccacaaaggccccttatggtttatcacggttctaccaacacattttccatgagtgagctactacatatgaacggttctaaattaagctacaacaacttaacaacataatactaagggacaattgctcatttgaccctattttcaggtctaactaccaatttgactaaacttttctaagtttatttgaccatgttttttcaatttgaagttgccgtctgaccctactttcactacactgtgagtatttcacttagaaaaaatagaaaacaagaatttacaatcctaaatgacgaaaatgccccttaatacgtcaatctatcctctatcactcattcctatcctctctctctctatcatctatcattcttatcctctatcagcggcggctcggcggcagctgtagcggcagaggggcggctcggcggcgcgacgcggagggccgccgctggcggcgaatgaggaggagcggcgctcggcgacgaggaaggccgccgctggcggcggatgcggaggagaggcggcgactcggcgacgaggagggccggcggtagctgcggctgcggaggagcggcggcttggcggcgcgacgcggagggtcgccgctggcggtggatgcggaggagcggcggtggaggggcagctgctcgacgacgaggagggctgccgctggcgacgacgggcggcgttggctcggtgacgaggaggaccaccggtggcggcttggcggtagctgcggaggggcgacgttcgctcgtcgacgaggacgacggccggcggtggcggtggctcggctacgacgactgccggcgccagcacgcgtgaagcttgccccgtgacaaacgaattttgggagaataatgtcaaataagcaagggtagaagtggtattttgggctttttgttaacaccgtgaaatattctgttcttaacagaagagggtcaaagtgtagcttcggttttaaaaaagagagtcaaataagcaaagtgacaaaaacagagttaaattggtagttagacttcaaaataagatcaaatgtgcaattgtccctaatactaatggctagtacatcagtatcacacgtcaggctgacgcgatcagtacacgcgacctactccaaaccggcgattgcatcattagcatttcggtgatgacagtacagattttatctaatttcgttaacacgttttttgaactgctaaaaattgattaaaaaactgctgaaagatttatattacacgaaatttttctataaaaaatattttaaaatatcagataaatatattttttaagtttaaaataattaaaacttaattattgatacactaatagtctataaaatcgggcctaaatccaggaagccccaaaaaaaaagtgagatgtgatgtgatatgattgtgctgtgcttgggattcctcaaactaccgctttgaccttgagtccttgacaaagcaggcgtcagcggcatcagtacaactacatgcgtctcgtccatttcactgttgtcactgacagagccttttgatcagcgacgcagcattcagacaacgatcagagccttcaaccttttcccgcagccactcgtcggatccatcataagaattgctaatttggttgaaattggaacgatgtgacggaagtttacgtgtgtaggaaaattttgatgtgatgaaaaagttaaaattttaaagaaaaaattgggaactaaacaagggctaagtttaggtgacgttcttttcttcttaacatgattcggccgggggtgcagga

SEQ ID NO: 93408 - DNA, 1944 bp, Oryza sativa
ttcctgcacccctcttctttttgttagacacctcctggaaactcttttcatcctccttatcctctcctgctctgatcctttcgatgtcagagtcagtcgggatttgacacctctcatattcgtcttcaggtagcaactcctgtgttaactcacccccttcatcctgagattgcatctcagtcatgaactctgccttctgagggaacattcagttgttttatctttcatctcatcccataacaccatggcagtgcccatttcagccttcttcagtagggaacttttcttagataccagcttcttgatactacacccctgtgtcccatgtgatttccctttgtatgcaggggggcagaataggccccaaacctattcccctgattactgtcagcatctctgagttgtctccctctagggctattttgattcttaaattcatcatcaaggttcatgtcttcttgcaactcttcatcatttttatcatctttatcatcaccaccatcatcatcagggggcatctgtctgttttcatatggtgggtagccctctggttcccacttagtcatgtaacccaccttgttgatgtaaacatgaactgagaaatgtaactccctaggatccttgcacgccaccctgactctcacaggaccatctctccttaagctagctccatccatagtttcaaactcccccaccagttcaacaatggcagcaattgagtgactgttttagcaatttttggaatcccaaatattttcacccacacagcaaccaattgactgttttagcaatttttggaatcccaaatattttcacccacacagcaaccaattgactgttttagcaatttttggaatcccaaatattttcacccacacagcaaccaattcatccacggcttcctcagtcattccagtctctaccacacttgccttaatcaaagaggtctcaaagtcaaaacacttgcatgttgagattttgcttctaacctcatcaaaagggaaattgattaaaaactctttgtcatttagttgcttcactttccattcccagtttagtcccacaaacaaatgtttcaattcagtaactatttttaccactgaaccctcaccaaggattactgttagaatacctctcacaggagctctagcaacctctgcatcagatatctcaacttgaaggctatagaaaccatgccctgggattccaaatccacagagtttaacacctctcttcatcagattcataggacaatgagcagagatgtgcccagtgttgtgacaagagtaacagagaggagggttagggcatgttgcctggtgatggccttcgcggccacacttgaagcacttgatcttcggaggacctcctcctccccgctccgcctcaaaccccgggcgcccttgggattggggacgaagcgcttggttcctgggattctgagcgagcagttgacgccacatgacattctatccccttttcctccaccacccttcaccgcctgcgcccgccggcggttaccgacgacacgactccatccgccgccgcagcccaacgaccggcggcgtcgcctgcctccctgacccgccgcggccacgagttagtgcaagcgcacccgccgtcccgccgctcccgccagtaaggaggttcccctattgccatgttgtatcaaagagaaccagcaatgcttcctccctgctccccgtgccggccatggcgacggtctcctcttcttccctctcgctgcctcctctctcctggtccttattcttcacgatcttcgtgtccttcatggcattcgtgatctctgcagctggcgtctccacccgctgtacatcctccacgcggaccacgccgcattcttggccacctgatacgtcggcgcgtttcgccagagtcgctgcctctcctttgccgtcaacgggagccttgtcgccatgcaca

SEQ ID NO: 93409 - DNA, 2198 bp, Oryza sativa
tgcgttcgtggcaaaaactcacttcgtgattcgcgcgggtacttttgtcaattaataccaatattggcatatgttgagaccccacgggtgcggtgtttttgaccgcattgaataagttcaaaaagcatccaaacatgaattttggacatattggagtgtattgggtgcgttcgtggcaaaaactcacttcgtgaatcgcgcgggtacttttgtcaattagtgttggcaaaaaactcacttcgtgattcgcgcgacgaacttttgtcaattaatgccaatattggcatacgagggtgcaatgtttttaaccggaatgaaaaagttcaaatagcaccaaaataagatttttggacatattggagtgtattgggtgcgttcgtggcaaaaactcacttcgttattcgcgcggcaaatttttgtcaattaatgccaatattggcatatattgagcccccacgggtgcgatgtttttgaccggattaaaaaagttcaaaaagcaccaaaacatgatttttcgacatatttgagtgttttgggtgcgttcgtggcaaaaactcacttcgtgattcgcacggcgaacatttgtcaattaatgccaatattggcatatattgagcctccacgggtgcgatgtttttgaccggaatgaaaaagttcaaaaagcaccaaaacatgatttttcaacatattggactgtattgggtgcgttcgttgcaaaaactcacttggtgatacgcatggcgaacttttgtcaattaatgccattattggcatatattggtacacgtgggtgcgatgtttttgaccggaatgaataagttcaaaaaccacaaaaccatttgttttagacatattggagtgtattgggtacgtccgtgtcaaaaaatcacttcgtgactcatgcggctgatgaatcctgagttccacatgaaactcaaggctgttgttggcccgatctttcgatgagttgagataactacgatttgggagaaacgttgacgacccgactacaaccgtacaagacgttgtgttgcgccttagcgatcgatacacctctccgtaggttgttgatcttgccggtgcaaagcaaccctattcctgcaagcaaatcgaagaaacaagcacgaacaagataaaagcaatttgaattgcaaataggaataaatgcacacaataagttggggtttcggatacaagcagatggacggtctagccgacacgcgcgctgcaaggaagtagcaatggctaaactttcatctaaacaaaagccaactaaccctgaaggggttactagctatttaagggatgtaggaggtcagaagggcgtcctccctctgtttggagcgcaggccccccttgggccccacttgggccggggtcccagacgaaattacaggcccataggcccattacagacaatgcagccccttgtttcttcaattgccaatgactcagatagaatttgacaatgaggttggatccgttggaatgaggattccgagagctttctatcaagtactcgtgggcctaaaatgaaggccatatggagatttggcgaccgtttgaattcagcactatctcaagtggtcgaattggattctagaacgcggcggacttcatctccatctctgcatgcaccatggccgtcgtctttatcttccatatgcagccccaaataagtggattggtgtaacgccccgattttcgttcgggattaaaaatcattaaataatgcattttctagaaattaaataaaagttaaatcaatttaatcaagtgaaataatgggagaattaaaattttcccttaaaaatcattggccgggaatattttgcaatattctttgtgccctaaaatactctccggatttttccgtgaattttcggagttcaagaaataattttaaagtcacaaagttcattaaactaatttaaataaaaagaaaacaaaataaacttccccttcctccctttcgggctcggcccaaaatcctctctccttcccctcccgcggcccggcttgcctccccttttggcgcaagtctgtttttcctccctcccggcctcccctctcactcaggccgacaggtgggacccgtgggccccacctgtcatctccaacctccagcccgggccggcaactgccatggccgccgaaaaccgcccacgtcgccaccattcccggcctcctcgagccct

SEQ ID NO: 93410 - DNA, 5726 bp, Oryza sativa
aataattcagaacaggcccactcaacttttcactaaaatatgcaacaggttttccttcttgtagcaaaacaccacccaatccaatcccactagcatcacattcaagttcaaaagtcttattaaaatcgggaagttggaggagaggtgcgtgggtcaacttatctttcaacatgtggaaggcgttctcttgtgatgtgccccaagtgaaaggcactcccttctttgtaagcacattcaatggtgcagcaatggtgctgaaatcctgcacaaagcggcgatagaaccccgcgagtcctagaaagctccgcacttgtgagaccgttttaggagtcggccaactctgaattgcttcaaccttggcttgatcaacctcaatcccctgcggagttacaacatagccaagaaaagaaactcgatctgtgcaaaaggtgcacttctcaaggttaccaaataaacgtgcatcacgaagagcattaaaaacagcacgtaaatgattaaaatgttcacccatagacttgctgtaaatcaagatatcatcaaagtagaccaccacaaattttccaatgaaaggacgcaaaacctcattcatcaacctcatgaaagtgctgggtgcattagttaaaccaaaaggcatcactaaccactcatacaacccaaacttcgttttaaatgctgttttccattcatcacccaacttcatacgaatctggtggtaaccactacgcaaatcaactttggagaacacaatagagccactcaattcatcaagcatatcatctaacctaggaataggatgacgatatcgaatggtaatgttattaatagctctacaatcaacacacatacgccatgaaccatctttctttggtaccaaaattaccggaaccgcacatggactaagagactcgcgtacataccctttatcaagcaactcatgaactgacgctgaatctccttggtttcctcagggtttgttcggtatggcgcacggttcggtagggaagcacctgggatcaagtcgatttgatgctcaatgccgcgcaccggtggcagccccggtggcacttccttgggaaacacatcagagtactcctgcaaaatgttagcaacagcagggggcaaagaatgctgcatatcgtgaagtgaaatcaaagcatctttgcataccaaagcataggcaactgaaggtgatgcaatcaactcattaatatcagatttagtagcaagtaagcatttgggtttcaaattgattgtctcaggtttcttgccatcagattgggcttttttatcactctcacatttggatttggcagccttagcaacatcatcacgcaaaatatcttcaggagacatggaatgcaacacaattttcttatcatggtacagaaaagagtactggttggacctaccatgatgcatagaatccctatcaaattgccatggtctacctagcagaatattacatgcttgcatgggcacaacatcacattcaacaacatcatggtaatttccaattgcaaaattaatgtgcaccagttttgttaccttcgccttaccactgttgttcagccattggatgtagtatggatgtgggtgcggttttgtgctaagtgcaagcttctccaccatctcgctgctagccaagttgttgcagctacctccatccatgatcatgcggcaacaacgctctttgacgacacactttgtttggaacaacgtgtgtcgctgattttgctccgccttctccatttgtgcgctaaggacacgctgcacaatgaggctctcatagtgatccgcaaatgcagccccaatgtgctcttccggtggctcattatctgcatggtcagccgcaagcaaagcaagtgtatcatcatcgaaatcactagcagaggagtactcaccatcgtttttgactaccaaaactcgcttgctagggcagtcacgctgcacatgcccaaagcccttgcaacggtggcactgaacatctctcattcggcctgtggatgccattgaagaagcactcggtgcgggctgagcagcctttgtcgctgacttgtcactagatggaggaggtgctgctcgactggttgtgggtgtggaagatggagaagcagtacggccggccggaggagtggtgcgtgtctgccatgatgaagttttacctgcagaaaaattagccttggcactagcacgtcgtccctgcacttccctttcagccttacaagcaagatgaaacaatcgggtcatattagtgtaatctttatagtctacgatgtcataaatctcgcggtttaacccacccaaaaatctagccatggcagcgtcctcagtttcctctaaattacaacgaagcaagcccatttgtaactcctgataatattcctctacacttttcgcaccctgtctcaattgttgcaacctattcagcaagtcacgtgcatagtaagaaggaacaaatctagcccgcatgacccgtttcaaagcatcccaagtttgtggcatgttattaggatttttcttgccatgttctatccaccaaaccgaagcaaaatcggtgaactcactcgtagcagctctaactctagtgctctcaggaaactcatggcatgcaaatttttggtcaacagcaatctcccaagagaggtacgcatcaggatcatattttccatcaaaaggaggaatcttaaatttaattttagaaaaagcatcatcattgttgcgtacctcgcgtcggcggcgaccacccatacctcgtcgattgttgtgtagccgtcgacgatctcgagcatctcgatcatcttgttcagtgtcagcaatatattcatcctccaaattatcctcgacgtactctccgtcaatgtcatcatcattacccccaccattgcctccagcattgagagcatcaaaatgcctcacaagagcagcaaggctagtgtcaatgcgggcgaccgctgtctccagccctgtaagcttagtgttggtggagatctgcgtggactccaattgtccaatcttctcatttgtcacctgcaaatctgtatcaagtccttctgtgtgctgcttcacttgccttgtaaagtattggatgatgcctttggtgcgtggggaatgagatgcaccctcctcatctttatcctctggacctgccatggtttagaaatgaaggacaacaaaacaatggaggatgtaatgtaagccctacacaactattgggatgtagcttttgcaagacgctcactctcacttcactcgcagcttgtctcacaagctcttaccagttcttaccttgcccacaggagggggacagcaacaccacaagttagcaaccgtggaacgaggtgtatcggtgctgtagcaacaagacctgtcaagctgtagtcgggtttgtggtggagctgttggtgggctgaaagcaatgctcaagagaaaactagaaaccacgttagccaaagcaaattgaataatcgctcaagggtatagtgtacagtgctggtcctaggctagtcgaagtagagacgcgagcctaaccacaaaggacgccacaaaacacaaacccaaacagcaacgaaaacaagaaccggtggtggaaggtggtgacaaaagggggaatggtgtggtgtgctcgctgtatcctcttttttttttttttttttttttttttgctctctctagggctgagaagagaggcaccacctttttttttaatattttttttttgatatttttttcacaaccaggagcacactagaaccaaccacagaaaatcttatctcaaacggacaaagtatgaagcttgtagaattttttcaaagttctatgcgaataggtcccgaagcttctcgccacaaaaacagaattttgcaagaggaatttggcgattttaaatttgccgaacccggcgaagcaggggagaaacggatgtaactttttttttagatgtccgtggatatattataagcctaatttcgagtccgtatgaaaaagatatgactgttttaaggaaggtcactcgaatcagggctctatttcctttctagtggcggcaggatacaaggcaactcacaaaaactatcggcaacagatcaaacacaaatagaaagtgatttggtgggtgactgcgacggtggtgacggtggtgatgacggcaaaattgatgaaggtggcgatgtgcggtggtggcaagaactcgaaactctaatcgcctaacactaagaccagcaaattaacacaaccgatgcaatcgaaaactcaacaagccttaactaagcagtactagtgaaaaggcacaatggtctataggatcacggaaaaactaatctactatttttttttgttggtcttttctggactataggaaaaaaaaataataatgacgaagggaagggtaaattctctcaccgatgaaccacgctctgataccacctgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagcactgaaattgctagataaagatgaaagtttcactatcaaacacaatatggtggggttccgattacaggcagacgggcggtttagccaacacgcgcgctgcgagccggtagcaagaagctaactctatcatcaaaacccgcctgttcttggcggcgactagaggtataaaaagaggggaagaacgaccatagggtcgtgctccaaccctaggacgcgcccctaatgggcccaacatggatacacagcccattgggccaaaagaggtgacgcagcaccatggacagaaaatagtcgggagtaaaatgacaattgcggccgctccagaacagatatggacatgtggctggatccatttgaaagtagacttgataagctttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcatcctccccttcttgcatttgagtcgtcctcgactcaagctcatcttcttctcccaaatacggcttcaaatctgcaacgttaaatgtgggactaaccccaaaatctgcaggcaaatcaatcttatatgcattctcattaatctttgctaacactttaaatggtccatcagctctaggcatcaatttagactttctcaaatcaggaaatcgttcttttcgcaaatgcaaccaaaccaaatctccaggttcaaaagtcaattcccttctacctttgtcaccagcaaacttatacttagcattcatgcgctctatgttttctttagttgtctcatgcagttttaacatcaactcagcacgtcgcttagcatcaaaattcagtttctcagaagatggtaa

SEQ ID NO: 93411 - DNA, 2157 bp, Oryza sativa
gtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcaaagtacccgcgcgattcacgaagtgagttattgccacgaacgcacccaatacactccaatatgtccaaaattcatgtttggatgctttttgaacttattcaatccggtcaaaaacatcgcacccgtggggtctcaacatatgccaatattggtattaattgacaaaagtacccgcgcgaatcacgaagtgagtttttgccacgaacgcacccaatacactccaatatgtccaaaattcatgttttggtgctttttgagctttttctttccggtcaaaaacatcgcacccgtggtgatgttaccatggctactacggatacatccgttgctcacatcatggatgaacaacaagatatcaagttcgagtcctccaagtgccaaaatccaattcggccacctgctacactgctgacttcaaacggccgccgaagctccatacgacctccgttttcagcccgtgagtacttgatggaaagctctcggagtcctctttccaatgcatcaagcctcattgccaaattccatctcagtcggcagcaactgaagaaacaaggtgctgtgacacctgtaatgggcctatgggcttgtaacctcatttgggaccccggcccaggtggggcccatgtggggtgcgccccaagcttgtggagcacgaccctaggcacccctaggtcgtcctcccacccctatatatagctagttaccccttcagggtttcttgggttttgtttagatgaaagtttagccattgctacttcgcttgcagcgcgcgtgtcggctagaccgtccgtctgcttgtattcgaaaccccaacttatcatttgtattaaattcctatttgcaatatcagattgcttttatcttattcttgcttgtttcttcgatttgcttgcaggaatagggttgatctgcaccggcaagatcaacaacccacggagaggtgtatcgatcgctaaggcgccacacaacgtctcgtacggttgtagtcggatcgtcaacgtttctcccaaatcgtagttatcacaactcaccgaaagatcgggccaacaatagccttgagtgtcgagaggaactcaaggttcatcacgtgggctctcaacatatgccaatattggcattaattgacaaaagtacccgcgcgaatcacgaagtgagtttttaccacgaacgcacccaatacactccaatatgtccaaaattcatgtttggatgctttttgaacttattcaatccggtcaaaaacaacgcacccgtgggatctcaacatatgccaatattggtattaattgacaaaagtacccgcgcgaatgacgaagtgagtttttgccacgaacgcacccaatacactccaataagtccaaaattcatgttttggcgctttttgaactttttcattccggtcaaaaacatcgcacccgtggggctcaatatatgccaatattggcattaattgacaaaagtacccgcgcgaatcacaaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgaatcacgatgtgagtttttgccacgaacgcacccaatacactccaatatgtccaaaattcatgtttggatgctttttgaacttattcaatccggtcaaaaatatcgcacccgtggggtcttaacatatgccaatattggtactaattgacaagagtacccgcgcgattcacgaagtgagtttttgccacgaacgcacccaatacactccaatatgtccaaaattcatgtttggatgctttttgaacttattcaatccggtcaaaaata

SEQ ID NO: 93412 - DNA, 7054 bp, Oryza sativa
tgccaatattggtattaatgaacaaagcaatataagagtacccgcgcgaatcacgaagtgagtttttgccacgaacgcacccaatacactccaatatgtccaaaattcatgtttggatgctttttgaacttattcaatccggtcaaaaacatcgcacccgtggggtctcaacatatgccaatatcggtattaattgacaaaagtacccgcgcgattcacgaagtgagtttttgccacgaacgcacccaatacactccaatatgtccaaaattcaagttttggcgctttttgaactttttcattccggtcaaaaacatcgcacccgtggggctcaatatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgattcacgaagtgagtttttgccacgaacgcacccaatacactccaatatgtccaaaattcatgttttgatgctttttgagctttttcattccggtcaaaaacatcgcacccgtgggggctcaatatacgccaatattggcattaattgacaaaagtacctcgcgcgaatcacgaagtgaccctttgccacgaacgcacccaatacactccaatatgtccaaaattcatgggggccctgggtgagattctaagctcctagtctgtggaaagttcgcgagaatggaaaaagcacaagacacgggcaatgtatacaggttcgggccgctgagaagcgtaataccctactcctgtgttctggtggatctgtgtatgaagaagctacaaagagctggagagccagagagctcttactctagaaaccctcttctcccctcttttcctctcgtgggatctactctccagatcctcctccccttttcgccccctctctaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggggatcaccctgtcatctcttcataaatgggcggagatttgcaacggctgctgcccgagtgacccttctgatgggacggcccatacctacctccactccgccggaagcaggtgcaacgtgggaacacggttgtcttccggcgacataaccagtgtcagaccagtcacagaccggtcacctttgtccaccacgtgtcagtttagcaatctgcatgttcgcccttcttcatacaacgtcttgcttataatggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgccacctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcaccgacagtagcccccggcgttatgccagggcgatggccctcctcgagggaagcggttgggcgtgacgccacttcctaaggcctggtgacaggtggggccggtctccacagttggaaagaaaaccaatcggtcgcaaatcacgcatatcggcattggtaactcgactgtcaataatgatcggtctcttcaagactgccacattactcacaaaaatcgggacaagccggttcgtttttcctggagatatggtgatggcgcttcggtcggcgagcgtaattaacgcgcgcacgatatgttccatctcgactgccacagccgcatatccacctcatgcaccgcaaacgggcgaatgggattagtggaagcgtgggcgcgagaaacgagggggcgagttagtgggcgcgagaaacgaggagccgggaacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtcatggcacggggctccgctccgcttgacggtagcgtgctgccgccttcccgcatcgtgagcgagagacaggccgggctgccgcgccacttcatgccggaatctgccaccggccgggagataatctcgctgggcgagggacgcccggcgccacactacccggggcggtccgtcttcttcctccctttcgcaatggcagggctggttccgccattttcttctttcttcatggatgttctggagttttacgatctccagatggcgcacctcacccctaacgcggtagtgacattggccatcttcgcgcgcgcggatccgggatgccgccgatcatatcgtccacagcttcgagggttcggcccctcggctcgcgttcgccctcgactccgacgaggagggcgatgacggcggtgtgggcgacagtggcgacgaggctggcgacccgggcgcatcggagtgagcccccaggcccccgccaatcttcagtttttttcttcttttctttcttccaaggccttcgggcctcctttttgtatagattaacttaatctgcaatcaaaataaagaaatttctgtgtcaatttcattttgctatgtgtatgagatgaggatgatctgtgccgtggtccttttatgtcttaacttgattaagggctcgtgcccaggtcccagtcctcaaaaggcgcgggtcggggctagtgcctggggagatccacgtgtcaagactggccaggccgggagcgtggtgaccgagggttatgggtgacccgattgtgggtttttgccgattctcccccggagttcaccacgccccggggcacggctcggttctgggccccttttggcgattttagccgacccgagcccccgagggcaggattgagcacaagtgacctatttcaagtcaagattcttcaaaaggaaacaacagcacagatacagcctttaggaaatcgaaaatgcttttattgaaatacagatagaagaaaaaatatgcatatgtggtagcccccggccaaccctgcacgcctgaagggggtgcggggttggcccgagcccgaaacctgacacccgaactccattagggatagaagcgacgaaggtgttcgatgttccacgggttaggcagctctatgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgagcccggacgtggcgctgatggtagcgccgcaggctctgctggtagcgtgcggctcggagggccgcgcgccgccttcgctcttccaagtagtcgaggtcatctctgcgaagctgatcttgatcagcctcgcagtacatggtggcccgaggggacttcagggtgagctcggatgggagaaccgcctccgcgccgtagacgaggaagaaaggcgtttccccggttgctcggcttggtgtggttcggtttgcccagagcaccgctggcaactcctcgatccacgaatcgccgtgcttcttgaggatgttgaaggtcttggttttaaggcccttgaggatttccgcattggcgcgctccacttggccattgcttctcgggtgggcgggtgaggcgaagcagagtttgatgcccatgtcttcgcagtagtcaccgaaaagctcactagtgaattgggtgccgttatccgtaataatacggttaggcaccccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagccagcaaacggccatgaaagtggtatgatctacagggcctggccgggctaatgaatttgcttggcgtggaactgacacgctatgcatcgccggaccaggtagaccgcatcattgagagctgttggccaataaaaaccttgacgaaaggctttgccaaccaaggtgcgcgaggcggagtgggctccgcattagtcttcatggatatcagcaagaagctcgacgccttgttcccgaggaatgcacttcaggaggattccgttagccgcgcgccgatagagggtcccttctatcagcacgtagcgtttgaagatgcgctggacgcgttcacttccttcgcggtcctcgggtagagtcttatctgtgaggtatgcttggatctcaacgatccaagcaatcaatctaagggagctgggagcgctcccctcgggtcccgaggcctggactccgacgggcctcgggggccggtcaggcgcgtccgtctcccctaaggggtcaggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatgcgctccatacgccgtacttgccgtacgtaagcatccatctgcgggtcagagcaccggtattccttacagacctggttaacaaccagctgggagtcgcctaacaccaggaggcggcggatccccagtccagctgccaccctgagtcccgcaaggagtccctcgtactctgccatattattggtcgcccgaaagtcaaggcgaaccaggtatctgaggacgtctccgctcggcgaggtcaatgtgacccccgcaccggcgccctgaagagacagggagccgtcgaactgcatcacccagtgggcggtgtgaggcagctgcgaggggcccgagctggcctcggggactgagacgggctcgggagccggggtccactctgccacaaaattggcgagggcctggctcttgatagcgtgacgtggttcaaagtgcaaatcgaactcagaaagttcaattgcccatttcaccacccgtcctgtaccctctcgattatgcaagatttgggcgagggggtaagacgtaaccaccgtgacccgatgcgcctggaaataatggcgcagtttcctcgaagtcatcagaatagcgtaaagcatcttctgggcctgagggtatcgggtcttggcgtcccgaagggcctcactaacaaagtagacgggccgctgcacctttcggtggggccgattttcttcgccaggggccgcatccctggggcgctcttcgtccaagcggcctcgcggggcgcacttgtcttctgtgccgacgacctcggggtcggaggacgacaggtgcggccttcccacagtggcctcagggccgtcctgggggtcgggggctcctggcgtcgtcggacaagcgggcaaagggtcaaccccggtcgtcaggagccttaggccaccgttcggctcgggggcctcttctccctcctctctcccgggtcgagtcggcacagggttaacctcggggtcagagggcgataggtgcggccttcccgcagtggccctcgggccatcctgggggtcgggggcacctggcaccgtctgacaagcgggcagagggccagctccggtcgtcgggggccttgggccaccgttcggctcgggagcctctcctccctgctctctcccgggccaagccaacacagagtggggatgcgcggaatgagggttgtcctcatcgcgctccacaactaacgccgcactaactacctgcggggtcgccgctaagtagagtagcaagggttcacctggctccggggcgaccagaactgggggagagctaagatacgccttcaactgagtgagggcacgttcagcttccttcgtccaggtaaacggcccggagcgtttgaggagcttaaataagggtagcgccttctctcccagcctcgatatgaaccgacttagggcggccatgcaaccggtgacgcattgcacatccctaagcttgctgggggggcgcatccgttctatagctcgtatcttctcggggttggcctcaatgcctcgggcagagaccaagaacccgagaagcttgcccgcaggtacaccgaacacgcacttatcggggttcagctttatgcgggtggagcggagactctcgaaagtttccgccagatctgaaagtaaagtttctcggtcgcgcgtcttcacaaccaagtcatcgacataagcctcaacattacgtcctatttggctacccaaagaaattcgagtagtacgttgaaaagtaggacctgcattctttaacccgaatggcattgtcgtataacaataagttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggaagggggtaagggtccttaggacatgccttgttaaggtcggtgtagtcgatgcacatccg

SEQ ID NO: 93413 - DNA, 746 bp, Oryza sativa
aaacacaagaaagggaaggagaacatcattgctgatgctttgtctaggagatacactttgttgacacaacttgactacaagatttttggcctggaaacaatcaaagaccaatatgcgcatgatgctgattttaatgatgtgttgctgcattgtaaggatggaagaacatggaacaaattcgtcatcaatgatgggtttgttttcagagctaacaagctatgcattccagctagctccgttcgcttgttgttgttgcaggaagcgcatggaggcggtttgatgggacattttggtgccaagaagacacatgacatccttgctagtcatttcttttggccacagatgcgaagagatgttggcaggttcgttgctcgctgcgctacatgtcaaaaggctaagtcacgcttacatccacatggtttgtatatgcctcttcctgttcctactgttccttgggaagatatttcaatggattttgtgttaggattgcctaggaccaagagggggcgtgatagcatttttgtggttgtggatcgattttctaaaatggcacatttcataccatgtcataaaactgatgatgcttctcatatcgctgatttgttctttcgagaaattgttcgcttgcatggtgtgccaaacacaattgtttctgatcgtgacacaaaatttcttagccatttttggagaactttgtgggctaaattggggactaaacttttgttttctactacttgtcatcccca

SEQ ID NO: 93414 - DNA, 1820 bp, Oryza sativa
cttccaccttcgttggagaccgccgaatcaccgccgtcgtcttcgccccgtgggatgctgccgcctccctctgctcgagccccatcagctgcctccttcgccgccatgcccctcggtgagctccgccgcctccctcttcgcctcctccgctcgttttcgccgctccccggtcgccccctcgctcgtcgggccgacgccgccatcaccattgtcgtcgtcgtccttcccgcgtcggtgagcatctccctcctcctcccctccctttctttttctctctttgcccgccggccgccgcatgcgtgtcgccgtcgcgccgcgccgcgtcgccgcctgtgtcgccgccggtggtcatccggccgcgcgccgccgtctggtcgggttggtcggcgagccaaccctcccctccgccttgcacctctaccgtggactcggtccacggtgggctagatcccttgtgcccgctgacgcgtggggcccgctcttttggtggacccggtccaagccctcccctttgactcgctgacgtgtgggcccgcctgtcggcgccggcgccccttgctgacgtcagcgaataacatttcctttgagaaaataattaataattgcgcaataattcgataataattatagaaattcattaaaatggctcaaaaccttctaaaattcatatctaattcattcgaactccgaattgagccattcaacttgcaaaattcatctaaaattgagctctacatgtttgtttactttttatgtactgttttcttggtgtttattagagtttttcctcattttgcgtgccagcgtgtagtttccgtcgtttcggaagtccgcggtcgcgaggaaaagagttcggaagatcaaagtgaagaagcaaggcaagtcgcacattccccttgagcatgttgatcccaatttataaatgttttaccgtttacaaataaatatgcatgttttgctaattacatgggatctgggtattacctatctgctcgcttgtgccatgtttacttgatatctgttctttgtcaaccttgggtaatactttgactagctcgtgttacttatgtgacctagctagaactatatgcttagccatgcttaattaccactagctcagtcgatgggataattgcagtattagacattctagtatcttgttgagccgcgtgctcgagacatctgccaggtttcatggtcgtaattatccaactaaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcggagggtctcgtcacaatcactcgacatggtgacgtgtgcatcatgggcacatgatgacgcggtgacatgtcggtgggttgtgtcttgtgggtacagttgtgcacctctgatcagagtaaaactattcgaatagccgtgcccgtggttatgggcgatcgaccagattcaccgtgattagtctcacacttaataaatcgacccaatgcactgtagtacaggtgggttggttgggcctgttcaacgtggtgtagcgttgatcagtggagattttaatgttactttaat

SEQ ID NO: 93415 - DNA, 515 bp, Oryza sativa
tcctgcagccccgcgatgcagcgaagccgacggtggcagggcgcggcttggcagtggctggagcggcgaggagcagcggctggagctcgtcggtgagtggtggagagagggagcgcggtggggaggtggttccggcggtggaggagggagatggagtggatgccggggtgcggcgaggcgctgtgatgctataggtggcggcggtgcagcgcggcagcgacgggagcggcggtggcgggcggctggagatcgccggcgagcggcggtgcgtgggctcggcgcggggagagcgagggagggcgcggcggcttggggaaaatgggggaaacggaggaggggaggccggggattgtttttatagctcaagggggcgaggagagggccggggagcggcggatttcgagggggaagtggggcggcgtcgtgggggagagagagacgccggaggcggcgacgtggccggattttgcggggagagggggggaaaccgcgcggacgtgggcggcgaggtccca

SEQ ID NO: 93416 - DNA, 9951 bp, Oryza sativa
ttcctgcagccccttgaaagaaaaatgtgtttttttattgcaatttgctgtgtgtatgttttctatttccgttctgtagttccatactatacttgctgagtatattatactcacctgttttatttggttttaggtatccagtatgtatgggcaggaagtagcaccccttatctccacagctcacagaattaaactaaacatagttccttaatatttgaatagttcacatttggctttgtaattattgtttacttttatactgtgagagtttgtgtgctatcatgtctacgggttaagtgatgtttaattatttttataaactgtttgtcgtggatgtaattaaatacaggggagattctgccaaattttctaacagatttgtggatggcgtcagctttgttcaatacatttgagcaaatcctttctaccgaagttgtaatgcaaatcagttaatacatttttacttaataaacaatgttccaacaaatatcatgttccgttccttactgattatcttgaatgtaaccacagcctagcttaatcatttgaaatggctgtgttgtcaattacatccagaaggagcattactataagtttataactgaatgagcttaaggaaaatggcatataataattaagtcacatactaatacctgatgtaatgaataatcctgagaaatattgaaatggcctctcctgatcgggtgactcagacagtatgactcagaaggtgggattttcaaagcatcctctccaaatattatttctttatacatgttttcttcagaattaggctcagtatcgtcaggagttgatctttgcaggggatccacgtcagcatccttgtcaactggcctttctgaccaatttgagtagttcagcaaaacattgatatcataaaatagtataggtaaaacataggttacttcactattgatgcaaaactgctcttctaatctccctggaattaaacaaatccactaatacccatgctatgcccaatccaataatcttaagcagctagacgatacatgctatgtaaaaagaatgggatgcaaatttcgactaagcttccaccttttcagataacagttacaattgtttctgaagtacaatgtccacatcaatatagctactgcaaagttccaatccaaatatatccaatgggaaagaaataccataacaaaacataagagttaaatccaacaaaataacagaattagctcgctccaagctccagctaaactagccacaaatcataatgcaatggtcctacagggtacaaagttcactactgccataagctcaggcacaggccacagacattgatacgcgcatggcagcttgcataggattctgccctcttccctcctttccaacaaatgcgcgcacaaatggtttgaccccaagtttctacatttgaatttgactccaattgtgtaaacactgcccaaatccaagttaacttccaatctgaggattaccacccatttggctgggggtgttccacataaggcataacaaatgaattataatgtcaaataaaataagccatatcaaataacattcatgtacaacttccaaatggacaagcatatctacacaaacagtgccctaacttaaagtatacaatttagcttcagctaacggacaactatgaaaagagaaaacaaagaatgaagtgtccccataaaacaagcaaaatgatcagacagtaccaattggtgtagatgatttaatacttctgtccattacatctgtccatgtgaatttactatcatctttgttttgctgtgaagaaagggcatcaacacgtcccatctgaagaggtaaatgcaatgatatcagcatatagaaacaacactaggatctttattaaacaaaacaagtttggtctcaagaacattgatgtcaaacactcaaaccatctaacagagctatactgcaaaatcgaacagttgtagtcatttatagctacacccaaagatgaaaagataaaagtatctttcaaattagacaaaagaataattcaaaaataatctataaatccagaagagttggagaaagtgatgaactaatcagttcactttgcaatattttcaaagattcactgtacaatataaatgaatgtcactatcaattttctcttttcaacacaccttatgagtattttatatatttgatagcccctcaagtttttcatggatattggatatcaaggatctatttgcaaaaacatagacttaacattgaactagaattttgagcttatattaattagtgaaatacagtgttttattgtgtcaatcctgaaccatatctaggtgaagtcgacttacaagaataagcttcctgctattctttagtttctgccttcagcttagaggcaggagaggtatcattgcttacaaaggataacaagcaatatccactctatctccccattttctccctctaccaatgctatttttctttgttcactgaaaagtgctaactcacccaatcaaggcactgatgggcaagaagcaggatttctgtggcccacctgatcatggctatgcattaagaccaaagtgcccgagcatatctttactcatgaaaaggagttagttgttgtgatgtttagttccataacatgtgatcttttgtgaattgatctacatagatgtgtgcatgtcattttgttgggtcctttgtaaaggattagaagatcacatagtttacttaattgtacataatgtaacatacatttggctgctaagaaaaaaacatcaacaccaaagacataatataatgagcccatcttaaagcctttttgttccatacaagagcaaaaggacatctggatcttgcaatagggtggaactcgaatttttaaacccaataatactgtagttgatccagtagggtggagcatgtgctactatattctcagcagattcctctagttctgtagttcactctcattgcctataaccgtacaaccagataggtaagacttaaagatcgtgcgtcctaccttaggaggtaacgcctggttcgctgaaggcatgtcttcatccaaaaagggtattttgagcagcgatgcaatctgcaagtctatcacctcattagctcaagtagaaacataatccaaaaagaaacaacgccaagtgtttgctttttacaatatcatatgccctctcccgctctgcattctgcgatggagttgcatggcagttgagcatctgcaaataaacatgaatgtcgttcaattaggataaagataaattgcattgcatcacaaacctcccaatatttgcaccaccttgtctcgcacagaaagccttggtgtatcatccttctgctgagtgatatgtcgagcaatgcagtgcggtatattgaatggaacatcctgacttgcgaacccaatgcgcacatttgaagatcctagagaacacggataattgattggtcagctgaaagcaactacgaattgaactggcagcaaaactgcatctagataaggcaggcacctagctgctgcgaagataatttgtcagcacacaaccacaaaattatcacacaaaaattactttactaatacggttgcgctttatgcatttcgtccaactacttccaactctttcatccaaaagaacacatcaacccattcaaatcgtccaaatattctcgatattggagggtggaaggcatgaatctcaagaaggacttggccatacgaaatagcacccaaaagaggaggggatgaccagattgatatcaggggctagggtttccggaggggcgcacctgggttgatgacgacgaggttggcgccgcgctcggccatcagctgtgatggaaccaccgtcttgaggtaatcctgcgatggaaaatcacttgttagttagggtttctcggggatttatggctcaaaagtagcagaaaacccagtggaattttggccgcgattgagaggggagagaagccatggggagcctaccatattttctccccggagaaggcgtcgcgcgcgtcggaagggaagggaagggagcgccggagtcggaggcgacggcctcgtcggggacgcgctcgtggtcgccggcggccgagcggcgctgggagtatagctgctaaaatgggccggggcccggccacggcacgccagcccgtgggccgtgccgcgcttgggccgtcggctcgggctgtgggccggcacgcaatggcccaagcacgagccggcccaggcgggaatttttttatttatacatttttttattaaaatatttaaaaaatattttttttttagaaaatttacaaatctaatcgtccaccgccctttgggagagcgatagttgaggcaaccccccaaagggcggcggacgattagatttgtaaattttcgaaacaaaaaattatttttgtaaatattttaataaaaaatgtataaataaaaaaaattcgcccaggcggtccaacgaaatttccccagttttatcttcttttgtttttctaagttggaaaaactatactttgactccctcaactatcgcccgagtatgattcatgttctccaaccacaaaactgggtatatcgacttctccaactattaaaaccactcggtggttttggaggtggttttggttgacgtggtggtcttaaccaagtctttgtcctacgtggcgcttgcgtggcattagaataaaaactaagtcttctcaatctctccgccttatccctttctcaccacgctcgtgcgcgcttgagcgggaggcgatcggcgcgtgacggcgcggcgagttgaaagaggttggctagcgtggtggggaaggctgccgcatgcgatgctcagggcgggcggcgtcggaaaatggccgacaatgaggtcctaccggactgaggactggctgcgcaaggaggttgctgcggtgatgcagactgtggtggggagcaaggggaaaaccgacgacacaggaaggaggtcgcgttgggcgatgccgccggcggggaggagcagagaaggagtagcagcacatggaggaggttggtggcgtggcggtggggatgggaggcattgcggcattgaggaaggatgacgcgaggaggagttcttcgcgggggcatctgttggcggccgagaggaggcgccctcgtggcgctccccaccaccacagctgctgccgaccgccgccgctactgccgcctctctccgccgccgtcgtccgagaagagaaaggccggggggagagagagatataagagagagagggggaggaagaagggaatgagagggaggatgacatgtggtcccacttgttagtgggtcccataatacttttttttgtgaatgacatatgggtcccatatttgttttatttttgtttttattgataatgtcacgtaagcaccacgtaggacaaagacttggtccagaccgctatgtaggtgtcacgtcagccaaaacaatctccaaaaccacttaggaatattgtttgcaccggttttgatacttggaggagtcgatatacccgattttatcgttggatgacatgaatcatactcaggtgatagttaagggagttaaagtatactttttccttctaagttcccacatatttttcctattttctctctctttttttcccatttcccccaagtttttcatatgtgtattacctattttcatcatttttcctagttcccccctattttccttttatttctcctttgtttttccttttttttttgcattattccttttttctaatatttgtattcgtgctaatgggcctgcaccggcccacgtgccatatttgggctatgctggcacagcacgcgcccatggcctccttgggccgtgcctaggcctaaattttttttatttatacatttttttattaaaatatttaaaaaataatcttttttcgaaaatttacaaatctagtcgctacaggttagatattgttggtggaagaattctgtctatttccattggtggtaactatttttggaggatgttaaatgaaatgcaatcaatatataattaattatctatacgcagtagatggatgggccgacggttgtctccatctgtggagcgacaagtaactggtaagctcaaattgtgtttatttgttttagttgccagatagtttgtaggtttgtaacaaaggagatcaagatccaatttcaaggaacctaagtgcacaaatggtttctctgaatcatgaaattttcttcagttaaaactgcttatacatctctgatctctcccttatatggctcaatgattgatttgcttttaaaggcgcgtgctaataattgtgcatttagaccgtgatagattcataatccatacttatttcatctttgttgtgcccatttcaaaaagattacttgtattataaggaatagaggatatgtctgtaatttgaaactacaaaatgtgccacaccttgctaaaactggaatacttcttttggcagggctgaaagaaagtggtgaagcaaacttgcgagagctggatccagcatgtggaggtgctcatcccatgaagtcaatggtggcgatcgagtaggaaccaatgccccgggcctgagtgcttattcattgaggttagttgaggtcgtaagactatttctgtattttgttttttgtttttgtcaggattgaaaatcaataagaagaagaagagacgaagtgtaatcacaagcagaataacatcgatctcttccacctcccagattgtcttgccttttgtttgatctcttctcccttccctttcactgtttgattttgtcttgaaagattagcaccaagttcttatttgattgcatactctcttttttttttgcgcaggaggtgttcgattaaattctgcttaagccatgtgatactagaacgtggagttacattttttttggttgcagggtggtgttattagaacattttttctaaaaggataccatatgtactgtatatatagatggaaaattataattttggttgcattctcatgattagttgcgttgcagccaattaaggacatgtacaaaggtataaacaggtatgagctctatgctatctaaagactaacgtcctacaatagttggagacaatatggtctctaccattaatgtatcaaaatactttttcttactcttttttttcctttctttcactaccatgaaacaaaatttgctctaagaaatactaagagtcgactctaaaccgttgtcgtacataacaactatatttctctttcctcgtttctctttcttccatgtcatcaaacttacttgcatggtaacatagagagaccactaataaaaaaaaccgttgtacatgccctaatttggatcttgtagtttcaaaatcatattgttccacttgctctcctgcagattgctgatttggcgacaaattgtaatagatatatagatacgttacgcctaatgaaagttttggagaaggtgaacaggtgctactattatgctggtcctcacgcgaaccgccgacgccatggctgcccatggcccatccttcctccacacctcgcatccgtccttcgcaaccgccactccacattctttgtcactgcaaggcaagtttctgaacattatcacatcgaagcactttttggatgtttagtatagtgcatgctgccatgtacccacaggcatgtggacaagcatttgtcctgataacttgcaaatatgtgaaaaatatcaattgagggtactggagcatatctagaaatttgcttgctttgtctgaaggagaataggaactaatttagcaattagatatgctgtaaaatcatagcaggaaggctaggacagcaggatccaacaagtagatcggtgagatcaaatgtaaatcatgctgtcaaatgatcttctgtatgcctgattttttcttgtgttatatacttttgttcaaaagttcgaatgcacgactagctttttcttgtgctctctttattaccttgcattgaccatattaccttgatagtatcatgctgctcaaccaaataaccatgttttcaccttttctttttacctgatgttctgcttatttttctatttgggtacatggtatatacctagatgattcacttctgtgtatcatatattctgttgttatcatgtattcagcggttaatattgtggtaaaccgttaggccgaatcactacagtgagggcctgcttgaaagcttggtccatagatcagttggtttttttttttgacccacgaaaaatacaagtgtaatatactggtgtaaagaatttcgatgctgtcaatctacgaaaaataaatatataatctaagtaaccaatacagggtggagtccagggcagcgatcacctcagattcagagtagctgaggggacggcgtagaaggaagtggatggatcgagctgctacacctccgcactttgctgcctcgatctgccccgctgctggagccatccacttcaccatcgccgtggactgtgtggagtgacgagattctttaagtgtatagcaaatgctcaaagttaggattagttaattagcttcggtgtatattctatattacaccgattactgaatgttttatttttcatttgtgtatacgcacaacagattaatggaacaattctctaccatatttttcttttgtcctttttgtttggacatatattgcccacgtatattgtataccgggagctcggggcgctggcgaagtgggcgtgcttggcgaagaggactcgctgtccgtgaaagcggagggaatcaacacccctcccttcatcacgaccttcgcctgcctcttcacgccacttggaccacctttcttcggcgtagccttggcgatctccgctagagttttcgcccctcgaggtccgtttggcgaagcggagatgcgctggagccagcaatggtgttgccatgggaagcttcttcgcccctgctcccgtcggcagcttcgtcctcctcgtcgtcctcatcatccgcctccgactcgacgacaggcactttggaaaccttgcgggatcagatccaggcaccagggacagccttcggcaccgcacgcttgcacttcttcgacgcgctggccccctcgtctactttggcggggttcacccaggcaggcagttcaccatcatgcacctggtttgcccggccgtcaagctggcactgcagcagccagccatactccgcggttgttagaccgccgatgatcttgttggtgtcagcttctgcgtctccaagcaaaagtcgtacaaagtgaaaaagacaattaggctggtagtcagaaagaataagagatcagaaagagacgcgatcggtggcaaaaggcttacgattggtccattcgggaaaaacgagactgggaaggccgagcttttttttgtcctccttcacttcgatcccccaatcctgagcaaggggagcgatccggagcatgcaatgctttttgcaaaggtcgcgggtgctgaggcgacgtgcgaccttgcgaagaaggatgagtctttactccagcgttccaataacatccacattcggcttggagttgatggagatgtggaggtggcgaaaccggagcctacccgcgttgtcggagttggcggcgcaaggattgtcgatgtagagccatttctgcatccaatgccaatcctacttcggtatggacgtagggaccggccatgagtccgaccgctctggtcggaggttgaagttcacactgccgaagacagacttcttcggcccagcgggtgtgtgcacatctttcgtcgatgcactggcggtgaagaggagggcgaagagctccactataggagcgaacccggtcgttcggcacatctaagcgaagacggagagctttgcgatggccaaagggctgagttgcggaagcctcgcctcatacatctccaggacggagggcaagaaattgtcgcacggcagccagaagtccacgt

SEQ ID NO: 93417 - DNA, 4658 bp, Oryza sativa
  unsure (1)..(4658): unsure at all n locations
ttcatggggtgatgcctccttcttcatgatgggagacgggatcatgagcaccctcgcttgtgttgtagcgttgaagtcatggaacatccacaccgataaatgcgagagaggtatgtgtatatcactagatttccttttctccattgtctcttcttgtggacacaatccttgatgtttctttttgatggactgaactttttgattttgtttactggtttgttttgattttctttaaaaaataaatgtgtttattaaaataatttaaaaaaaatcaaagttttacaaattcacaccccctgacatcacttagtgtagcgttttttaaaaacaccctcctaaataatattttttataacatgacacatggtcattgggatatgttaacggtcgtcgtacgaaggagctgaccatttttcaggcaacacccttatgaagggggccacttgtaaaatggcagcctagcatattttgtaagcgaccttcttgtaaccctcccaaaatagagtttctctatataggaagtggattttttcccttgagaggatgtccccttgttttgtgcatggtatttaaaaaatcatgaaaaatttgaaaaaaaatatcaagatagatcaatatatgatacatctttacacaaacatacaagttgaaatattacttatacaatttgaaaaaaaataacaaatttaaccacgaattacatgtttcattcatagttaaatttattacttttgtttctagttgtataagttaaattagaatatgtatgtttgtggagtgacatatcacatattgttcaatcttactattttttttgaattttctaatgacttttaaagatgaaaaataagaagacatccccttaagcaattaatagagtttctctatgtgtgtgcgtgtgtatataatatatgtatacatatattgcgctatcaacatgtttgtttttggatttactatgccaataatttgagagatgacaaggatttattgtcgtaggtttgttgtttatccaagaaaatatgtggaggttggcccatgaggaagaagactggatgctagttggatttgagattgccttgccctcgctcctagacatggctaaggacctggatcttgacatcccttacgatgagccagccttgaaagcaatatatgccgagagagaaaggaagcttgccaagtatgtatgcctatatctacttattaattattttgtttagtaaaattttagtcatgccacacacgatagaatataaaggataaaatccatcgtgaaagcgcccgcttgcttctctcttctctggtctctctcacaaatagctactctctccggggtgataatacttatctttttagacaaggacacggtctctaaaaagtaactttgacaactattttctattataatatatatatagaaatattaacaaatatatgattttattaaagtactttttaaactaatctacacatatggtcttcatattttaagataaatattttagaaattatttttaatcaaagattttaatgtttgactttacccttgttcaaaacgactaatattatcagtccgaagtgagtagcagatatggacttattgcatatgcccgaaacatgtaatatgtggatctatcgtatattagggttgcattactgtaaaaccattcacaaattattctccttttttgcttttcttatacagttaaaattattgtgagatttagagttatttttgctctaacatatcgcattctaacatctttttacaatgaatgaatgttttgcattcaaattctaggattccaagagacgtgctacactctatgccaacaactttacttcatagccttgagggaatggttgacttggactgggaaaagctcctcaagctccggtgtctcgatgggtccttccattgctcccctgcttcgacggctactgctttccagcaaacaggagaccagaaatgctttgaatacctcgatggaatcgtcaaaaagttcaatggaggaggtaattattgaagccgatttaccaaaatattttttgttgatttacatgcacaaaatttcagaattccataaagtatattaattaatttctccttatattagctagtttcttcttccttcctctcccagtacactgactcaattcaacactgtatctgtatgcaatgaaacagaagcgcacttctgtatgaaacagaacccctccctccgcacggaaaacggaacgatagattaacacgtgattaaataagtattagttataaaaaacttgaaaaataaattaatatgattttttaaagcaactttaatatataaacttttttgtaaaacgtgtacgtttaacagtttgaaaaacgtgcatgcggaaaacgagaaagataggctggaacccatgagaaagaacgcaccaagaggctaggttcagtagttcgtttagcttttgcaatctccttgtttgttttcattagcactactccctaacttgtaaatggtacctttactaacaactttttatatacaaccttttccagaaaaattaaataaacttacaatattattatgtttaataattacagcttacttattcattatgttttccagttccctgtatctaccctttggatgtgtacgaacgcttatgggccgtcgataggctgacgaggctgggcatatcaaggcacttcacaagtgaaattgaggattgcttagactacattttcaggtactaattaacttttaacatatctgtactaattaactttatgcacgtaggtacccaaagtgaattaattaatgtttagttgaccatatatatatataatatggatattaattatactggaacaggaactggactccagatggattagctcacacaaagaactgcccggtaaaggatatcgatgacacggccatgggtttccgtctcctccgactttacggataccaagtcgacccatgtaaatactgtccctcggttttatgctataaaatatttttcttaattaaattgtttaaagtttcactaagtagaaaattattttgctagaattttggtacgtcatccgtattagagtcagtttttaagttcgttcgcttttggaaatacaacatcgtgtttgagttggattttattgtttccttttggaagtataaaaggagtcgtacaataaatcttttgaaaaaacacgcatgctaacttcaaatgaaatacagactcctaattgtagctcataattttctaaaaaaaatccaatcgaattcccacggtgaattttaccctaactaaaccatataacaataataaaattaaaatagtatttacccgttgcaacacacgggtattttttctagtacaataaaaaacattcaatgttacatttaattaaactaatttgatgttatagatgttgctaaattttatataaaattaaggtttaactaggaaaaaatcatagagacttactgtaatatcaaaatataaacacatgtcctcggaagaaaagataaacacatggagtagtttactaaccgttgctaattaatgtctaataattaagatatccaacaaattaacattactactccctctgtttcaaataaattacttaccaatctagcaattctcacacaaaccaacaatatgtagaagattgtattacatggtttaccttcattaaatacatgacaacgataagtattttgatataaaatttaaattctagaatgataagtaatataaaatggagagagtatttactttaataattgaacctagctaatgtgctcaaacaataatgccatgcaggtgtgttgaagaagttcgaaaaggatggcaagttcttctgcttgcacggggagtccaacccatcctctgtcaccccaatgtacaacacttaccgggcctcccagctcaaatttcctggcgatgacggtgtccttgggcgagctgaggtgttttgccgctcattcctccaagacaggagaggctcaaacagaatgaaggacaagtgggccatcgccaaggatatcccaggcgaggtatgttaagtcctactactccctatgccaaaaaaaaaaaaaaaagagcttttcaggatgaatctgaacatgcatttgttcagacaatcgaaaatcaatgcaattttattaaagtatatatgaatgggatgtgataatactccattcctattgaaaatgcaagtttttgatgctaagnctaccacactaattcagttgcgtcttctaacttcannatatactcctactccctccgtccaaaacaaaaancctttcaggatgaatgatatgcatttgtctagactggaacagagagagtgcctagctagcaatggaaaattaatgcaaatttattaaagtatatatggatggaatgtgataatacttcaattcctattgaaaatgcaagtttttgatgctaagctaccaactaattcattgcgtcttctacttcaatatactcctactccctccgtccaaaacaaaaacctttcaggatgaatgatatgcatttgtctagactggaacagagagagtgcctacctagcaatggaaaattaatgcaaatttattaaagtatatatggatggaatgtgataatacttcaattcatattgaaaa

SEQ ID NO: 93418 - DNA, 2764 bp, Oryza sativa
agcataccacatatatgattaatttcttactcaaaattatttacactttatatgcaggtggtacttgaggagtaatctggagaagtttggagggactgatccacagactacactgatgacatcctacttcttagcttcagccaacatcttcgaggcaacccgagcagcggaacgtcttggatgggctcgcgtagcgttgcttgccgatgccgtctcctctcacttcaggagaatcgggtatatatgtttaaccgctatattggacgcgtgacttcactcaccaaatcgatcactcggttttgctttagtgatcgatcgatcaatggatgcaacatgagcttacctgcatgctgctttgcaggggaccaaaaaattcgaccagcaatcttgaagagcttatcagccttgttccttttgacgacgcttattctggcagtcttcgtgaagctgtaaattaatttatcaaatcaaaaccgtgttaaaacttcaaatggaaacataaatatgtgccaaatctttataaatttcgttttgtaaactgcagtggaagcagtggttgatggcatggactgcaaaggagagcagccaggagtcaattgaaggggacacggcaatattgttggttcgtgccatcgagatttttggaggacggcatgttttgaccgggcaaagaccggacctttgggagtattcccagctcgagcagctcacctcctccatctgctgcaaactttccaggagggttcttgcccaggtaaatatttatatgttaacctgaatttttatatacacacaaaacactgtccttttaatcaagttgtacatacaaatacacacaaatacagtaaaacatgcatagtgtttgttataactaaaatacatcccttatgtagtaaaatttttaccgcaagttatatcgttgtaaaatatcttatagtaaaaaacttttactaatcgatactttatagtacaatttttactagctcaatatgccatttgatgattatagtccccgctgtaaaaatttcactaccttggcttttgttagctatggcacatcctggctatggtatagtacttctacaatacacaaacatatataattgttaatttgcaacgatgaaaatatttaactttgattcaggagaatggggaaagtacggagaaagttgaggagatagaccagcaagtggatttggagatgcaggaattgactcggcgcgttctacagggctgcagcgctattaacagactaacccgggagacgtttctccatgtggtgaagagcttctgctatgtcgcctactgctcacctgagacaattgatagccacatcgacaaggtcatattccaagatgtgatttaggaacaaattaccccgactcatctacactccttataaaagagagtagtggtggtgttggttctgccacccccacctccactaccaattcccgacctttatagaataaagatgtgtcttttgtattaagtttgttgtggtgtacctcgtgtttttcctgagacggggtttaatttcgtggcgtttctgaaaggtaatttctgtgtatgatactgaacgccaacgataagcctctggggtctactctattcctgactcaattcatcctactcctcttgagctagagtcggctattcctgacgctctagcgactaatgatggaaatggaacggtgtgtggctaggaatctacacaaattaatggatttaaatttcgggattttcaacactttttggaccgatgtttcttgaattttagcataatttaactgaatttgactaaattttgaccaaatttgcaaaattttgagaaaaaaaaaaggaaaattgtggcggagataatcacgtccttggaggtgggggttggtccaaaattacccaaatttcaaaaatttcaaaccgaaattgcattatctgcacaaattaacaattcaatatatagatccaacatctcaatagacattaaatactcagaaaaagagacacttagtcctcacaaataagaaaatagcaacagaaagagtacctggcttggcttcatctccgctcccataggtatctcaactaataagtgtaagaaaggtcttctaactctatcttctcgagtgaaaagctttacttcaacgatgatgttatgttaatagcaaggtgagtatatgtaacgccccgattttcgttcgggattaaaaatcattaaataatgcattttctagaaattaaataaaagttaaatcaatttaatcaagtgaaataatgggagaattaaaattttcccttaaaaatcattggccgggaatattttgtaatattctttgtgtcctaaaatactctccggaattttccgtaaattttcggagctcaagaagtaattttaatggcacaaagttcatcgaatcaattaaataaaaaaagaaaacaaaaactccccttcctccttgggccattttcggcccaagaatccttcccctcccgcggcccgcgccctctctctccctctctcggccggcctccctccccatctcttgggccgtcggcccgtttcccctctccctcgtgaagtctgttttacgtcccccatccagctctccctccctctctccccgacaggtgggacccgtggaccccacctgtcatccccttcctccagctccaactgccgccatggccgcccgagccgccccacgacgccgccgtttccgcccaccttctccaccccgcgcgcgcgcgctcgttccggggacct

SEQ ID NO: 93419 - DNA, 6673 bp, Oryza sativa
agaagcatgagaagttcatgtcaggtcttgatgatgaattgaccaattagatgatctccagagactctgaggactttgagaagcttgcggacaaggctatccgtcaggaggagcagcacaacaaaatggaccgaataaggaagactagtcagttcagggtttccccggggaacaatcagaagcctcgcttcatgactggacagcaggttcgatcttccaccatgattatctgtcagcaccatccctacatcagcgtcaaccacaacagtagtgggcagcaccaccaccaccaaactcctcacccactaatggctccaattcagtcaggtctgccagctatgtcagctaagttagaacagcctgttgacggtcgttaccgataaatttcgacagtcactataactaaaataatggagaactagctatgcatacaatgtatgtttatttgccaaataatatatttccacttgtacttggagaataacatgtagcaggaatttatgcaaataaaataaagagaaaatggagaaaacctcactcctaagcgagcaaatggataagatgggcccacatgtaatacgagtaactgggaagatggcaagacagaatctgtctcgcaacttttcccaactaccgtttacacatccaacggtagaggtgtaccattgcttcgctctctcttgaagggtgaacggaaataatttccaccatacaatttcttgtctcatgccacgaatcttaaggcatgagtagacttgttcaaagtcccgtagatgatggtggagattttctagatctaagccagaaaaagggtttttccttaaccatgctgatgagttcggcgcgaatttcatagctagttgtataaatcggctccgatgaaggaggtggctcatagaattcgcccctaggagcagacacctcgaagagaggttgctccatagttgagaagagtttaaaaggaatgcttctctgggtagcaggggtggaggaagaataaaaaacaaaaaagagatacgaggatgaactgggttcggaaatgattagcaaccgttccccagcaacgacgcaagatatgcttgttggtaattcttatggtcatggataaaatccgcaagcgcacggatataccgatgtctaagggaacgtgtacggtcagatcttcttccggttcatccaaggacacctagcaaaggataggctaggatagagaggatttactagtgagaaacagtgtcaagggaaagcttatgtttaatcctaacacaatacttcaggcgctggcaacctgctgttcctagatgtcgctctactacgtacccggatagggaggacttaagtgctattgagggctctcaccacctctacacccacctcaaacgtactgtgggatacgcagcaaccactggagattaattacccagacaccacgtctacgcaattaataactactctagtgccgatcaaacactaaagcaatcactataaataaatggactacagtgaacaatgatcccgtatgctaattaggaactaaccaaaatgtaattctcactaagtaaatcttaaatactcataatgatatttctattaaagcagagtaattaagaagatacaaaagtagaaagagattaccgacaactccgggattcctccgattccttctaccttactctctcgctattctaatatgcaataaagtacactagagcctcttgtaatttagctcatgctttggtgtgtgtgaatgagggagaggagaggggtatttattggtggagagttgccttgggagagtggagatgctctaagcatcctatgagcatattccctctagctttatctcctcttgacaagtgtcctctctatgacggtttccactggtagaaatggccacaaccatcattgggatgagtagtacaaccgtcatactgaatatgggctggactgggccagctaggggttcggccgaaccaccctggttggctcccctggcccacatctttcttcaggatgctgacatgtgggccccacttcttgatgctccattttttggctcaaaatgattgcacattttatatattgtagctcaaaaccatgtgagtttatcagagcaaaatatatttccattctttatgctcattctttcccaacttaggtggttgatcacctgcatataaatatacaccaacactcatggaaattgttagaaataaatcctacaactatgttagaagtttcacatttatggttttatgcaggttttgacggctttattttggcacttaactgccgtcaacaaaaccccccacactttgctctttactcgtcccgagtgaaggttaaggattaatgtggaataaaatttcccaagatataatacaagtacacaaattattctaagccatacctgtacctgtgaactattgaagtgtctaacttaccatcttgggcaattgatgaatggaacgatcgtgactcaagtcctccttaatcctcctatcaatctcttgggatttttatatattttcgcaaagtagctatactcttcgaataaatctctcaaatcactcacgtggtttgatttgcggatcctcaccaaggcatggttgccgatttgtccctattctaaaaggctatataggtggagctcggtagggatcaatcggggcatacctgcatcaggtatattgcaaagccaaaataccagacccaaggagatagcaagtcatactttctgatcaagaatgtgcatgtgtgtgatatgtgtatgtgtataaaaaaaatgtgtggatggaaaaggaaaataaaagataacaactcctttggtatacctcctcctccaattctttctcttggaaatttaagagagtgcatggctatttcttttcctctttttatttcatcatgccccatacttcgtatgagcaagattctctttattattattattatttttttcatcaatgctccattcttgtatgagaaagactttatttttttccttctttttcatagccacgcctttctctctgtttctttttttctttgaaagaattttgaaagaagaggcataaatgacatggagtatttattttgtggataatggataaaataaatgatggatgagggatgctagcttccagtgtagaagtttagcatagtgtgtgtatgtggagtgtggtgtgatcttgatcatgaaagtatgaaagcatctcacatgggtgacaataatttgacaaagctgaatgtaatgccaagcagcctaaacatatatcagaattttgcaatgagaattatatatggccttagtaggtaataatatagttactaaggagtattgctcgaaaaagtttttattttcgcaaaataaaatcccaagtatcatgacagttgtataggaatttcttttgtcataaccatatcacataacttagattagcaaggttccctatgatagatgttagttcacaagtgacaagtgttagcaaagaataaaaagtatacatgattaatcataggagaactttatttgttgagagttaaggttttcaattttcatttggagtcaaactaaatttgtattcaatttttccgcaaaagtttaactcacaaactagggaggataaggaaggagacatgcaaacctgaccacacggtagaagggtgacagagctggtccaagcaagggtcgggcgaacacttggttcggccgacctaccaggacatggttctgattgccgaattttgtgcgcggccgtcagctggtgttcatcaggttgtcatgttgagttgatgctattgcgcgtacgggagttccgaaaagactcccccacacttgttttgtaccttgtctttattcaacaaaaaccataaaaagcaaaatgggcttccaccgggttgaaataccggtgagccaaattttattcaaataactctaggcgcatgaagtgcctattttattatttcattttcatttttttatttttttatggcaacaatgagaatggtggttatcctagcagggcggatatatgacgtcatgattcacagggtgtttgagattcttaccagattgtacttaccaagctttgaaccaaatcgatggtaacaaagtgttgcatttgctttgcttggttaccctgtgcatctctctcataagccaaggatcttggtatggatgttggagttattgtacactgctccttagttgtcttttttatttcctgcaaaatgttagtggacaacaaatacccgagggactacaaagatttgaaaagattttatcatagcctcaagattagttgttcacatccatactaaaaaggaattggattctaaacttaaagcgcgtggatcccaccaatttgccataattttattttgtcatttttatttctttttactcgagagtcatttcttttattattaaaaacatttttttcaaaaaaaaatttttgttcaccaaacttttattcaagcaaaactcatacagggctgagataaacttatataacatagaaaaggagcatttggaaatatacgtaccgtgtaccttgagaggtgatatgtttctcctttgtatgttttggcaattgatttgttcctggcccttgacttacctccagtgtgactcgtgcttgagaactcacccatcagattgaataatttcctgtaggggttagtccacgaagggtatacatccaaagtccatgaaagtactggctctacggttcatttaaacaaacttgacaccatgtcaactttgattaaagcaagctatttatcctaagcatcatgcttaatttgagaagcctatgaatgtcgacgaccacccaaaccataacatatgaaaatagaccgaggacgcataaccatgcatgatcaagccagactcaactagagataagtatgagtaatagtaatggtgaatcttttgttgtatacctgagtatatttacagccagcatgatgtatatgttgaaatctttggagcggtggcacggtcaaatgtgattgttgttctttcctccatctggatgcaggttgtggcggaggaaggcactttgaccatgccaactcaggcgagtggttcggttatgcacacatcttgggtgcaagaaccttatgccttgaaggcatgttccgtcggcataatgctaaagagacataggatgcatctcttttcgggcaagtatgcaagtgctaactagagtggagcagcaaacagctcgaaaagaagagggcatttcctcttggttgtatgtatgtaggtgttgcgggagcgagaagttgtgcacagctaggattggatgaaggctaagccaagtcgacacatgagctcaagagaggggctgggtatagcctggcagcatggttactactagcaaggtgtatagccatattttaaagactcgcacataatgcggtctttgatctaaatgtagtccgtttgctctcttgctgtcctcttctcccatctcttttttttatatcttccgtctctcttttcttttcattttttttcttgttcttttttttcagcaaggtaaaactaacaccaactgcaaaccaagatggccttggttgatggaactcatcatacaagctcgtcaacctcccccacacttggactttgatgtcataagacatcaaaaaccatgtgtgttatgttggagtcttcataaagtgtgtttcaacaccaaggatcaccaaaatgtacatttgatgtagctcccgagttcttaggcatcgtacatccctcgttcttaatctcaacctgaaatggttagtgaccaagaatacccgaaggtgcataatatcctaaaaattggttttttcttttattggaaagacaacttaccaagataatccggggtatctcccggcagtgctttctttatggtcacaagctcgaccatggagacatctcgttacaagattagtgccacaaacacatacgagatttgcaatatttatgataaacaaaagcatccacaaccaaccttctaaacatgttagagataaggcccgaaaggtggttatggttctcacacaaggaagtgatactaatcggatagaactctaaggattctttatgtaagcatgaatcctagggtattttgaaagagaagttttcatgctcatttgtggagttctcatcctccagagttgatgtctctaacttgtccatggcttgcagtttctccttctcaagagatgcatcgtgcaagaacaaggttgtttcttgacaaatgtcgagaacaacattttgatggccagagggacaaggttcaggctcgataggaggttgtgatggtggttctttggactgcaattcaacggtcttgccagaatctttttgaatgaaatgaagatcatcctgttctataatagactcaggggactcatgaagcagaactgccattgcttcctctatcggtgcatcatcagggggtatgtctgtcaacgagttctcatgatcgttatggagatcacccctgaagtctagagcgcatcccgaagtttgaaattcttcgttcttcggtgctgatggctcgagagaggataccttagctgaaactgatggtgtggaaggatttgattcagatttggctattgaaggttcctcttgttttgacaccgataccttctggaggggttcagaatgttg

SEQ ID NO: 93420 - DNA, 504 bp, Oryza sativa
gcgactatttcaaagtacaccggagcgtcggaggaaccggaatctagcgacatacaaagcaaacaatgcaaacaggctataagactactgaaacagggaacaaaagtatttttaatggattctactcatttttcttgatttactgagacttgaatgggcttaaacggagctcggatgaattagttatgaattttagaagattcactgtgtttattactataaagaaaaaccttaaatcatttattgcgcaataaatcccagggctgacgtcatcaaggcggggcgtggcgccagcaagcggggcccaccggtcagcggcttgggagagggaggaaggggcggttcaccgtggaccgggaccacgcgggtggtccaccgccggtccacgggaccgacggtcccagatcgccctcggggccgatcggacgggcggtggcgacccggttcggctcaagaccggccaagcagctcacggccatggcgacggcgcgcgcacacgcgttg

SEQ ID NO: 93421 - DNA, 2514 bp, Oryza sativa
ctcaaaactgagcctccaacctttgccattgccatcgatcctatggaagccagtgattggttgcgcacagtcgagaagaagctagggttgattcagtgcaccgaccaggagcgggttggcttcgcaactcatcagttggttggaccggcttcagagtggtggaatagctacgaagcatcacggccagaaggacataccatcacctggaacgagcttttcagtcctgctactttcatggtagtatccatcatggtgtcccgtcaggtaatgtattacactaagaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagccgcagtgcaactccttctagaggattatgaagattttgagaaacttgtggacaaagccatgcaactcgaaagtgagcataatcggatgacgaactgcaagaggaggattgtcaacatcccagtatttccatgtggtaaccaaagacagcgcactgagccacttcagatcaccggatcttctgttgtgcatcaagagtttccgcgccaagaagatggacacaatgcagacaacaacattagcaatactaatgatgatgatgttaccaccaacaaccatgcttcttgccccaatagtgaccactcgaatcaagcgtgcaatgtcaacatcattcaccaagatgtcgacgatagtatcaatgatggcacccaaaatgacaaccctagcaattgggactctgagaaagactccgatggtgatagcaactatggtaccactgatgccaatgttagcaaggatttccagccaccaattccaactccaagtcagaatgaccgtccccagacggatagctcagcaaagaagacgttgatttgctacaattgcaaagaaccagggcattactcgagggactgcctgcaaccaaggcaaagtcgacctccacattaccgccaatttacacgaagcagacatcccaatcgtattgtggtcactggagcaaacgctgtacccgtgaggcctcgtgttaatcagaacccatagcagaaacaatgtaccgatgctaagcacctttccttttaggcagtgcttagtattcatgtaataagggagaaatgtgtaatacagacaagttctactaggattcttttggaagatgcggatatgtgattatgtgtataattgcttactgataaaggagacctagggtctcatttcagaggaatcatatactaatctcgagttaataaccaacctgttgatggaaaagaaaaccaattaaactgtgttggattaaaaagccaaagagacttttgtttggactgagagtttcagatgtgtcctctttggaacaaaggcaacaaccgccagtctagcttttgacaaaccacttgaaggtttctctgaaaggcagcaggctcaagtaccacatcgtcaccagaagcatccacaactctcggagtgaagagtacttagttgacaaaggtcaaaagatgattgatagaagatatcgaaaaagatgttttttaccaggcaaagaagtaggtcgaaaggtgattgataagagaaatcgggaaagaacacatcaaggtcaaaggtgtaaaggaatacgttgaatgctaactgaggacaacatgaagagaatagtgggaagtgaaccaaatgtaaagaaagtgaatccgagttgcttgttcgtgagagctattcccagttatgaaccaagtgatatgttcgaagatagtctacagaggtcagacaacgaagcttcagatttggcaggatacgattaaacaataagaagtccagcagtaaagccatttgggaagacgtcaaagcatgtcaaatgggagaagttggttcagttgagaaacataattcaaaggcaaagttatcgacccttgcatcgaatagcagaagtagctagcacccggagagcaggaaagttaatatgaggcagttggtggcaagttagaagtaagtgacaagcatggtattctcatgacgacaagcatggtattctcatgatgacaagcatagtatcttagtaatgacaagctagtgttgacgcatgacatgaagtggtaacttctatgaggttgacgccaaagatatgaactatgcgaagttctggaactgaagccccatcttcaggtgccgcaacccagtcgaagtcagctaaaggttcaaccagggacaagtcgggtgaagagaagatcccatctgcaacaggagatcgagccaagcagtccagagtggagaagttttgctaggcaagtttgttatagaagacgcgacgaaagaagtccaccaagaagagaagaccgcccaacctatcttcttgctagcctcctcgaatctcggggacgagattcttgtaaggggggtggatttgtcacgtcctgataaattcatcccaaaattaaaaat

SEQ ID NO: 93422 - DNA, 3040 bp, Oryza sativa
cccgtttaggtatttcatggtactgattgatgcttctaccaggtggagccatgtggacctattatccacaaggaaccatgcttttccaaagctaattgcccaaatcatcaggctaaaagctagcctccctgatagctgcgtacaattcattcgaatggataatgctggtgagttcaggtcgaaggcttttgataattattatttagccatgggcattaaggtagaatattcagtaccacatgtccgtactcaaaatggcctagctgagtccttgatcaagaggatcaagttgattgcacggccactgttgtaggattgtaggctaccaaccagttgttggggccatgctgtgttgcatgcagcaacactaatctcaactcaggccaactgcatatcatagtatatcccctcttcagctagtgcgtggaaaaaaaccaagtatttcccatctgcgcaatcccaccaccacagcgtacttctatgggacccaccggaagttggggatatacgttggttatgagactttgtccataatcaagtatcttgagcctatgactagggatcttcatacggctcggtacgctgattgtatctttgatgaggactatttcccagcattagggggagaaaagcatccagaaaaatgccaagatataatatggaatgcaactgggatgcagtccttagatccacgcactagtgaagctgaactggaagttcagagaatcataaatttgcaaaatattacaaataagttgccagatgccttcactgattacaagggagtgacaaggtcgcatatacctgcagtaaatgtgccggaaagagtagaggtaacccagaaggatactgactctgctcttacccccccatcctaggaagagggggagacctccgggtgctcgggacaaggttccgcggagacgtcatgtatcggcaagtatcagccgatcatgcattaacccaaacacttgggtaatatttcttcaagtacttgtcatttagtgctcgtccataaacttctccatcgagtccttgcaacatgtaagctcccttggacacaactcgatagatttggaacggtccttcccaattcggcgaccacttgctgaatttgctatcccgaatttacttaacaaactcatcggacacgaaaattgaaccctgatcagttgtaatggtttgaggaataccaaatcgataaattatatgctcttgaacaaattgtatagcatccccagaatcaaccttcttcaaaggaattgcctctacccacttggtaaaataatcggtcgccaccaatacctttactcgatggtggattaatcatgccgatcatatcaatttcccaacctctaaatggcgatggcttaatgataggattcatagccgacgccggtgctctctgaattgctccaaacttcggacaatcctgacatcctttgtaatacttgaaacaatcctctagcattgttggccaaaaataccatgcacgtcgaagtaaccacttcatcttatgagccgattgatgagtaccacaaattccttcatgaacttcgccgccgatagcaccttagcctgatcggcactcaaacacttaagcaacaccccatcaatcgtccgataataaagttcatcatctaataaggtatacttcaacgctttatatcttaatttccgagaagtcgattgggatggattctgtaaatatcgatgcagatcatatctctaatcatcggctgttactgcagctacttcaaccttaacatctttgatcatcggcttataccccgatgccccttgggccaaatcattagcttcaatgttttgttctcgagatagatgcttcaaagtaaccagccgaaatttcttcattagttcttggcacttctcattataaaccattaatgtatcattcttgcattcatattctcctaccaattgactggttaccagcaaagaatcctccatgatttcaatcgcatcggcttcaacttccttaagtaattgtaatcctttaagcactgcctcatactcagcttgattgttagttggataaggtttgatagtataagcaaactggaaacatgcccccctaggggaaattataactaagccgataccacaaccattagtacatactgatccatcaaagaacaaagtccacggcactatctcaactgagccgatcgaatcatcacgatgttctataataaaatcggctatagcttgccctttgactgccttcggtgactcataacgaagatcaaactcagttaaggaaaatatccactttccaacctttcctttcaaaattggagccgataacatgtacgtgaccacatcggccttgcatatgacactgtactcattggacaatagataatgccttaaccttgtatatgaaaaatataagcacaagcacaacttctccacaggagaatatctagtttctgcatccaagagccgacgacttaaatagaatacaactctctctttccattcaagctcctgaatcaagactgagccgattgacttctcactggccgacagatataatataaaaggtattcctttctgtggaggaatcaaaactggaggagaactaagatattccttaatactatccaaagccttatgttgctctgccccccaagtaaactgttgatcggctttcaatcttaacaatggtgtaaaaggctctaacctgccagacaaattagaaataaaccttctatcaaaatttatcttgccgatcatttcttgcaattctgtcttgttcttcggaggctgaatcttctttattgcattaacactcctttgagtcacctcaatccccctctcatgaacaagaaatcccaaaaactggcaaaccgatacaccaaaagcacactttgttgggttcatattcaggccatatttcctggttctctcaaaaaccttcctcaaatcggctatgtggtcttctatctctttagacttaacaaccacatcatcaatgtaaacctcaccaaccagccgattagatcatgatatatat

SEQ ID NO: 93423 - DNA, 3263 bp, Oryza sativa
catgttggcaacagcatttcaactattacaaaattggaacaacccagcaggggcaaccaacgttcaagtacctacagtctagcaacagtacaagttattagaatttctcaaaactgagcctccaacctttgccattgccgtcgatcctatgaaagccagtgattggttgcgcacagtcgagaagaagctggggttgattcagtgcacagaccaggagcgggttggcttcgcaactcatcagttggttggaccgacttcagaatggtgggatagctacgaagcatcacggccagaaggacataccatcacttgggatgagttttcatctgtattcaagagatcacatgttcccgcaggaatgatcacactaagaaaacgagagtttcgctacctgaagcaagaagatttgaccgtgacagagtacctgcacgagttccatcgtttggctcactatgcaccagaagatgtggaaacggatgaagacaaacaagagaagtttctccaggggttaaaagatgaggttgcagtgcaactactcctagaggattatgaagattttgagaaacttgtggacacaagccatacaactcgaaagtgatcataatcggatgaagaactgcaagagaaggattgtcaacatcccagtatttccacgtggtaaccaaagatagcgcattgagccacttcagatcaccggatcctctgttgcgcatcaagagttcctaccccaagaagatggacacaatgcagacaacaacattagcaatactaatgctgatgataccaccaacaaccatggttcttgccccattagggaccactcggatcaagcgtgcgatgtcaatagcattcaccaagatatcgacgatagtatcaatgaaggcacccagaatgacaaccctagcaattttgactctgagaaagactccaatggtgatagcaactatggtaccactgatgccaatgttagcaaggatttccaaccaccaattccaactccaagtcagaatgatcgttcccagacgaacagctcagtaaagaagacattgatttgttacaattgcaaagaaccaggtcatttctccacagattgtccacaaccgaagcgtaacctgcgtcatcactccggccattatgcaagaagaagacaagtcactcgccttgtggtcactggagcaaacgccatacctgtgaggcctcgtgctaatcataacccatagcagaaacaatgtaccgatgctaagcacctttccttttttttaggcagtgcttagtattcatgtaataagggagaaatgtataatacagacaagatctatgtggattcttttggaagatgcggatatgtgattatgtgcgtaattgtttactgacaaaggagacctagggtctcatatccgtaagctcataatctatgataaatcaagtaacctagttgttgatagaaaagaaaatgaagcgatctgtgttagattaaaaagccaaagagacttttgtttggactaagagtttcagatgtgtcttctttggatcaaaggcaacaaccgccagtctagcttttgatgaaccacttgaaggtttctctgaaaggcagcaggctcaagtaccacatcgtcaccagaagcatccacaactctcggagtgaagagtacttagttgacaaaggtcaaaagatgattgatagaagatatcgaaaaagatgtttattaccgggcaaagaagtaggtcgaaacgtgattgataagagaaatcgggaaagaacacatcaaggttaaaggtgtaaaggaatacgttgaatgctaactgaggacaacatgaagagaatagtgggaagtgaaccaaatgtaaagaaagtgaatccgagttgcttgttcgtgagagctattcccagttatgaaccaagtgatatgttcaaagataatctacagagtcaagattaaaatcacatccaacaaagaagtttcagatttggcaggtcaataatcagaaaaatacaagtccaacagtaaagacatttgggaagacgtcaaagcatgtcgagtgggataagttggttctcttaagaaacataattcaaagttagaatggtcgaccctcgcagcgaatagcagaagtatctagcactcggagaccaggaaagctaaaatgaggcagttagtggcaagttgtcaatcttggtacccttggtaagtgggatatcatagtcgaatgcatttggtggtaagctagaaggaaacgccaagcatggtattctcatgatgacaagcatggtatcctagtaatgacaagcaggtgtcgacacatgacatgaagttgataacttgtgtgaggttgacgccgaagatatgaatcatgagaagttctggaacggaagcatcattaaactaccgcaacctagtctaagtaacctaaaaggtgcaccctggttcgagtcaggtgaagagaagattccatccgcaataggaggtcaagccaagcagttccgagtggtgaagttttgctggaagtttgtgaagacgcaacagaagaagtcagacaagaagagaagaccgcccaacctatcttcttgctagcctcctcgaatctcggggacgagattcctgtaaggggggtggatttgtcacgtcctgataaattcatcccaaaataaaaatcattctccaaaaggaataatagaattaattaaaattcgaaaagaaattagttaacactaaaatacatacaagaaaaattcgaatgtggcccggagaatttttgttaaattctccttggtctaaaatgagccctcaaattttacttgaattttcagagcaccgtaaatatttattaagcaacaaaaacaattatcaaattttattaaaaagaaaaacctaaaagtaatcccccttcctcctttgggccaagtctggcccaaagtcccctctctctctctctctcggcccgcagccaaagtcctctcttcctccctctctttctctccctctccttctctccctccttctcttgggcctccccttccccctcggcccagctcccttttcctcccctcccgcctgggccgcgtctcggcccaagccgccccacccagccgccccagcctcccgagccgccccccctcacgcgcgccgcacgcgcgctgaccgcgcgcccgcgtggggcccacgcgccgggtcgtcgtcctcctcccgcccgcctcctctctctctcccggaaacctagcgccattcctccccaatatccacgcgattcaaaaattgattagg

SEQ ID NO: 93424 - DNA, 1749 bp, Oryza sativa
ctcagtcggaggagttgccgttgatcctagtaatgtggaatccgtaaccaactagaaacaaccgaagacagtttcagagatctgcagtttcttaggcctcgcaggatattatcggaggtttatagagaatttttccaagattgctaagcccatgacacgactgcttcagaaagatgtgaagtacaagtggtcggaagaatgtgagcagagttttcaagagttgaagaatcgcttgatatcagctcctattttgattttacctgatccaaagaagggtttccaggtgtattgcgatgcatctaaacttgggttaggttgtgttctgatgcaggacgggaaggtggttgcctatgcatctcgtcagttacgtccgcatgaaaagaactaccctactcatgatcttgaattggccgcagtagttcatgcgttgaaaatttggcgtcattatcttttcggtactcgtacagaggtatataccgatcacaagagtttaaagtatatctttactcagccggatctgaacatgagacaaaggagatggttggaattaattaaggactatgacatgggaatctgtgtccccgataacaaagatttaaaagatgcaattctgaaagaagcccatgataccttatactccattcaccctggtagtacaaaaatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcagcctttgaagattcctgaatggaaatgggaagaaatcggtatggattttatcactggtttacccagaacgtcatcaggccacgactctatttgggtgatagtcgatagacttaccaaagtggctcatttcatcccggtaaagacaacctattccggaagtcggttggcggaattgtatatggcaaggatcgtgtgtttgcatggcgtccctaagaaaatagtgtctgatcgaggcagtcagtttacttcaaatttttggaagaagcttcaggaagagatgggttctaaattgaactttagtactgcttatcatccgcagacagacggacaaaccgaaagggtgaatcagattttggaagatatgttgagagcttgtgctttagatttcggtggaagttgggataagaatctaccttatgcagaattttcgtacaacaacagttatcaagctagtcttcagatggctccttacgaagcactgtatggtcggaagtgccgcactccgcttttgtgggatcgaacgggagaacgtcaggttttcgggacggatatcctaagggaagcagaagaaaaggtgaaaatcattcaagaaagattgcgtgtggcccagtcgcattataagagttatgccgacaatcgccgcagagatttgagttttgaagaaggggattatgtgtatcttcgtgtcacgcctcttcgaggagttcatcgttttcacaccaaaggaaaattggcaccgcgttttgtgggaccttatatgattgtcagtagaagaggagaggttgcttatcagttggagttacctcaatctttggcaggagtccataatgtgttccatgtgtcgcaattgaagaagtgtttaagggtacctaccgaagaagctaatcttgaacagatagaagtccaagaggatctgacctatgttgagaaaccatccgtatcttggaaacaaatgagaga

SEQ ID NO: 93425 - DNA, 2812 bp, Oryza sativa
tgatcggctttcaatctcagcaaagatgtaaaaggctctaatcttccagataagttagatataaaccttctaacaaaatttatcttgctgatcaactcctgcaactttgtgcttgtcctccagaggttgaatgttctgaattgcattaatactcctttgaggcacctcaatccccctgtcatgaataagaaatcccaaaaactgactagccgacacaccaaaagcacattttgttgggttcatcttcaaaccaaactttcgagttctctcaaaaactttcctcaaatcggctatgtggttttcgatttcctttgatttaacaaccacatcatcaatataaacctcaactaaaccagctgatcagatcatgaaatatatataattcatggctctttgatatgtggcctccgcactcttcaagccaaaagtcattacaacctactcaaacaagccgatcgcaacaggacatctaaaagctatctgatgaatgtcttcttcggccataaaaatttgattgtaacctgcattgccatccataaaacttaaaatcttatgtcctgaagcagcatcaaccaactgatcggctattggccttgggtactcgtccttgggatctcgaaaatcaatgcacaccctaactttgccattcttcttgataactggaactatatttgaaacccattcagcatatcggcatagacgaataaaaccaacatcatacaaacgcttcacttcagccttgacagcctcaagcatatcggctttgcacctccttggtggctactggtacggccgaattccaggcttaataggaagccgatgtacaacaatcgatcggctgagtcctggcatctcataatacccccaagcaaagcaatctctgtattcttttaaaagctctatcaacttggttctaaattctgaagataaattcttactaataaatgtcggccgtggtctgcctcccggacctatgtcaatttcttccaaatcgtcagccgacatgaaaccctgtccttgcttggcatcgagatcgtctaccgtgtccttgttgtagacgtttgaaccctccacaatgccctcaaagtaataatttgggctctccatcttcaattggttgtatatcacaatcggacacctttagaaaatctccatcccaaacttttccagacaagcaatcaataccgtccatctcccaaagagctaaatcagcattagcaacattaactgacctgtcggctggtacaatttcaatcttgtcaccttgccattgaatcaagcactgatgcatggttgaaggaatacaacgattagcatgaatccaatcccttccaagcaacaggctgtaagaaccctttccatcgatgacaagaaacgttgtaggaacagttttactgccaactgtcaactccacatttaaaactcttttggtttctgatggattgccaccaaaatctttgagaaccatattggtcttaatgagatcatctggatttctgcccaacttcctgaatgtagcatatggcattaaattcacagcagctcctccatcaaccatcattttggacatcggcttcccattgacaaacccattaatatacaaaggcttgagatgccgattttctgtcactcctggcttctcaaaaattgcttgctctggtgacaaaactaacttagccaaagcctcttcaacaccatcaacctcagcttgcttagcttcaaattcggctggtagcgtaaaaaccatgttcaccgatgcagatgcaacggccttacccttgagcaaccttcttgctttatcggtttcgacttcatcggctgttgtaactgtgctcttaacgtgccactcttgcctagtctttgttttcttcagccgatgattaatctcctgtcgtacttcctgaaattgttctctgtcacgcccggaatttctatccaaaattccaaacgcttacatgtgcgtgaaccctcgtccaggaatcagccgaggcacacaataacaaattaataatagagtacaattattactctaattaataagcgaataaaatgtcattacagaggtagatagttcctctcaaccaataaggatctaagcagcggaaaataaaataaacggcgcagacggctccactccacaggcagcttgaccaaggctactcctaatcctccactccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttcagaatttaacaaaacagttaagtattaattaagcaatattaatccaacgctatacaacataccctgttgtataggcccaaccattctgaacaaccatcccggctgcacagttctatctccaaaccaggaatataccattccaaaccaggagctaatcaaattattaccaattatagcatcatttactatggtgagaagggtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgcataacacaatccactgcagcgcactttcctggatcataatcacccccttataaacaaggcatggactcccagcgacccccgtgggcttatctcgccac

SEQ ID NO: 93426 - DNA, 4261 bp, Oryza sativa
tgaacaacaggtttcaaaagaaataaaagaaagttataaaatcaacatgctaaatttattttattgcagcaagattaaataaaacaacattgtaaaacttttgctgataaatgagccattagtacagtaatggatgtacagtactaataacactggaataaattttgaatgagaaccattaaaagagattatgaagtgcatgtgccattagtttggtttaattaaaagagaaagggaggagaacagttctacttttccaatatttttagagggcttctatgagtaaccatttggcataacctagggtcaagggggctctgataccaacttgtcacgcccggaatttctatccaaaattccaaacgcttacttgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccaaagctacacctaatcctccacaccatcagcaacactgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttaataaaatagttaactaattaaacaatattaatccaacgctatacaacataccctgttgtataggcccaaccattctgaacaaccatcccggctgcacagttatatctccaaaccaggaatataccattccaaaccaggagctaatcaaattattaccaattatagcatcatttactatggtgagaagtgtgggactaatcacgaaagacattgttagacccgcccataactgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcacctttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgattaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcactaaataatagtgagtcataagttatcccattagtgagctaatgtttctaagcagggctaatgtcacgcccagaaattcccgaatagaatttcaagcagaatgtgcattaaaatccccgtccaggaccagccggggtacacaaacgacaatgttgacatacagatccacgtcttacaaacatcataaagtcttacataaatgtagcggaagaaaagaaagacaacaggagctaagccttgactaaactgcagcgggaacaccactccacaggcatcctcgacggcacggacgaagcctactcctctgagaaaccttcatctgacccgaactcgaactctgaggttgggaaaagtagagcaagactgagtactacccactgtactcagcaagtcataccggaataggggtatgatgcagggaatcatcaaagaagagctgaagtggttcatttgcataaagcgagcatttataaacagaaattgaaagatttaaacagttgtaaaaattaattaatactaatcatccgctgtccaacgctaacccacgttgcaacaggcccaaccatccacctaaactatccaaattaaaggattacactaaggtgagactaatcacggtgaatctggttgaccgcccataaccgcgggcacggctattcgaatagttttactctgatcagaggtgtacaactgtacccacaagacacagccccacgacacgtttccgtgcgccgacatgccaccatgacgtaccggaaagaggccgtgacaggacccttcgcataaccccctctagccaagcacaccacacctcaggtttcacccccgtccccagcgggcaacgggcagtcccctcttgtgcctaggtgaatccggaagtgacagaggccgtcgcagggcccgccccgctccatcacgcccacccttgcctggatgcgtcgactagaggaacgctacactacaagcccagccgttgcccacgctggcttgtggtaagtacgataagttcttccagggcatcccgcgaaccggtccttaactgccatgggtgcgaccagcaaaaccatgcacccacagcccaccatgtggtttattttaattaaccaacaccaaagcggtggtactaatccaacaaaccattagaaccaacagtctaaacattaatatgattttccccattgtgaactagttgaactaagcatggctaagcaattcctagtccaaactctaatcatgttataaccccaagctaacaaaggagcatggtatccaaaaagcatggctataacaataggtaaccatcccatagtaatattataaaacaatgcaatatttgaaagaaaacaatagagcatttgcaatataggatcaacatgttcaagtgacaagcatgacttgccttgctctgctgctggaggaacctcggcgactatctcgaagtacaccggagcatcggaggaatcggaatctagcgacatacaaagaaaacattgcaaacaagctataagactactgaaacagagaacaaaaccatttttaatggattctacacatttttcttgatttactgagacttgaatgggcttaaacggagctcggatgaattagttatgaattttagaagattcactgggtttattactataaaagaaaaaccctaaatcatttattgcgcaatatattccagggctgacgtcagcacggaggggggtgcggcgccgacatgcggggcccaccggtcagcggctcgggagagggaggaaggggcgccggcaagcgggacccgcatggcagtgactcgggagagggcggtccacggcggatcgggtccacggaccggggaggagcggcgcaccacgtggcggccgaaccgatggcctcgatctacccaagggtagatcggacggcggcgggagctcgcggccggggcgcgcgggcacggcgcaaaccggcccggcggccatggcgcgcgacggcgcggcgcgcttgcggcagcggcgcaagacggcggccggcggcgaaggcgacggcgcagaaggcaacgcgaaggcggctgcgctaagcggcggctaggaaggggagggaacgggcggcgataaaggcggccgccggctcggctcggcatcaaagccgaccggccggccaggtctagcggcgacggcatgcggccgacgacggcggcgaccggcggcactggaggcggcggcggcggccgaaggcgacggcgcgcgactcgaagcggcggcgcggcactaagaggagaggaaggggaaaagaggggagggggtgcctcaccgagggtggccggcgcggagaagacgatggcgaacggcgacggcaagccacgggaggacgacgtcggcgggcggacgagcttcggggtgccctaaggaaggagaagagagggattagagagagggagatggaccacggcgatcggaaaccatggccgaaggcggcggtggagttggtgctcacccgagtgcgagggaacgagggctccggcgacgaacctcgacggaggaggggtggacggggtggatctcggccacgcgaacccgacggcggcgacggcgcggcctggcggcgaccctaacggcggctagcggtggccggagtagcggaaaaggcggcggcaaggggttgcacggcgcgggagcgatgggaggctcgagagagtgcggcgaaatggggaaaaagtgagaggggacgacggcgatgcttaaatagggggagaggagaccggacgtggccgggagaggcggggaatcgccggccgacgtgggggagtgggg

SEQ ID NO: 93427 - DNA, 1867 bp, Oryza sativa
aggaaggtgtccccgtgtgggacgagaataaacaggaggagtttaacctacgagcgctgctgttcgtaaccatcaacgattggcctgcacttagcaacctatccgggcagtccaacaaggggtacaaggcttgcactcattgtatagatgaaacataaagtacgtatcttaagcactgtaggaaggttgtgtatatgggttatcgtcgattccttgcagtaaaccacccaacacggaagaaatgcaagcactttgaacatacggcggaccaccgtacgaagcctaaacatcgctgcgggaaaatagtgtttgctatggttaaagatcttaaagtagtgtttggaaaggggcctggcagccagcctatagagagcgaagatggtcacgcggcgatgtggaaaaaaaactccatattttgggagttaccctattgggaattcttggacgtccgccacgcaatcgacgtgatgcacctcactaagaacctttgcgtaaaccttcttggcttcctaggtatatatggaaagtcgaaagttacactggaagcacgtaatgatctgaagcatatggaacaacgcggcgaccttcacccggaaccacaggagaaaggcagccattacttgagtccagccagctacactcttagcaaggcagagaaggaaagtatgtttgaatgcttggagagcatcaaggtaccgtctggatactccacgaatataaagcgaataataagcacgaaggagaagaagttcacaaacctaaagtctcatgactgtcacatgttgatgacacagcttctaccagttataataaggggtatcctcccagacaatgtccgggcaacaataacaaagctatgttcttttatgaacgcaatttcgcagaaggtcatcaatcctgataggttagaagcccttcagaatgatgtggtgcaatgtcttgtaagctctgagttgatattttcaccttcatttttcaatataatgacgcatctgctttgtcacctagtgaaagagatcggtattctcgggcctgtgttcctacacaacatgtttcctttcgagaggtacatgggcgttctgaagaagtatgttcgtaaccgtgctcgtccagaggcaagcatcgccaaggggtatggaacagaggaggtcattgaattctgcgtagaatttattgaagaccttcgcccaatcggggtacctgaatcacgccatgaagggagactacggggaaaggggactctcggaaggaaagcaataatgacggtagataacaatttattccgtaaagcccatttcacggttttacaacaatcttcattggtggctccttacatcgaagagcacttggctctagttcgcgccagaaacatcggtaagtccgatgcatggattacacggcatcacattgatactttccctgcatggctgcgacaacatctcatgggtaacgagacgattaatcagcaactggccttcctggcgaggggtccatctggctcgatcacgacattccagggatatgagatcaatgggtacacattctacacaagagcccaagtcatgaagaccacgaaccagaacagtgttgttcgtatcgatgccatgggacacaatggtacaactggcacgtattacggtgccatcgaggagatatgggaacttgactatggacctctcaaggtcccattgttccggtgccaatgggttaggttgactggtggaggcgtaacgattgatgatagtgggatgacaacggttgaccttaacaaggttggatactcggacgaaccttttgtccttgccaatgatgtaacgcaagttttttacgtgaaggacatgtctagcaaaggaaagaagggcaaagg

SEQ ID NO: 93428 - DNA, 722 bp, Oryza sativa
aaccaattggctagaaacaagatataataatcactgatccgaaggttaaaacacacatggctggaggtccgatgtcatgaaatccacaagattagattaagacagtgaaacctttgttgtcatcggctaaatccaatttatatgtatatgcaatccttatgagccgatgcaatgtccagataactcaccggctgaaaccccgatgaaacccttattggcagtcaaaaagcaggctagagattatggttctatacacgacttagtagatcaaactcaactgatgcagcactaagtatgaaaagaaacataatatctagacgatcaaaccgttgactgagtttttagggtggtagatatctaagttaatctaatctagcaacgcgatttagccgataccggcagaaaccctaaaacgagaagcagccgatagagctaaattgatgtgctaagactagattaatagagacatatgataaataggtaggcaaatatatcatccaaaccagagcaatccaagaggtcgaatgtactgatgcagccttgaacgacgccgacgtaaacgatgcaattgaatggaccgacggaacattggacttaccgcttcgccggagattgaagacgatgcagccccgcgtcgggtgccaagttccaccggaacgtagaaacaaaagtagaagtaaaaatggtggtgatgcgccgaattgtattgatcgagtgataat

SEQ ID NO: 93429 - DNA, 554 bp, Oryza sativa
tcagttcttcaacaacaatgctggcaataacaaccgcaatcaagctccacgtcctgttgcagctccaacacagcaacagcctgccaagagggagcaaggcagcaagcccgtggtgtgtttcaactgtggagacccggggcattatgctgacaagtgtccgaagccccgacgcgtgaaggttgtccctgcccagagcaactctaccgtaccagcatcaaaggcccgtgtcaatcatgttgctgctgcggaagctcaagatgctccagatgtgattttgggtacgtttcttgttaacttagttcctgcagcagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattaaaggagtattatttctggccaatcttatcctgttagaatccaaagaccttgatgtcatcctagggatggactggtttgccagac

SEQ ID NO: 93430 - DNA, 2940 bp, Oryza sativa
atcccatcccgacgagtgtgtgcccacgcgttggaagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaccaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgattattatcttgttattttggattaaaatatgccgaattatgaccaaatttccaacaatccaaaaacctgataggtcattttcggtagttggctttgctgctgcactgaaaccacatgcctttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgttatggagcagttctatgactacaagatggtcgatgaccgttctgtagttgaacaagctcatgagattcagatgctggctaaggaacttgagaacaacaactgtgagttgccggacaagtttgtggcaggtggcattattgccaaactaccatcttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaaaaaaagcaagggaaaggcaaagggagactgctttgtgtgtggcaagtctgggcattgggccaaggactatcctgagcgcaaagacaggaagtctgccaacatgatcattagcgagggcggaggaacatcggggtacggtaaaatattacctacagttctctctgtttttcattcacctgattggtgggtggacactggtgctaatattcatgtatgtgctgacatttctctattttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgctgtgaaccatattagcgagaatgatgagtttaatgtgtgggcatttcgcgactctgtcatatgaatttcggttgtatgacgcgcttagctaacatgagtttaattccaaaattcactttggtaaaaggttccaagtgccatacttgtgttcaatcgaaacaaccttgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcatttctttaaaatctataaagctgaggtagaaaaccaacttgaaaggaaaatcaaacggttgaggtctgatagaggtggggagtattttcccaataagtttgcatccttttgcgaagagtttagaattattcatgagatgacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcggaaacttggaccaaaaactgttgattgtgtgtttcttgggtatgctatccccagtgtgggttatagatttttaatagtaaactctggagtacccgacatgcatgttggtacaattcttgagtccagagatgctacattctttgagaatgaatttcctatgaaatatacccctagcacttttagtaaagaaactgtcatgccccatgagcactttgcaccgatagaacccaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtacgcagtgaaatggactcga

SEQ ID NO: 93431 - DNA, 549 bp, Oryza sativa
cggaggcaggccggcggtaaattcttaaacgcccaacagcggcggcttattaggccagccgtgtaggcggaggcaccagtcggcggcgacggaggcaggccggcggtgaagtcgtaaacgcccaacagcggcggcataataggccagccgtgtaggcggaggcaccagtcggcggcgacggaggcaggccggcggtgaagacgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccagtcggcggcgacggaggcaggccggcggtgaagacgtagacacccaacagcggcggcataataggccagccgtgtaggcggaggcaccagtcggcggcgacggaggcaggccggcggtgaagtcgtagacgcccaacagcggcggcataataggccagccgtgtaggcggaggcaccagtcggcggccaccgaagcaagccggc

SEQ ID NO: 93432 - DNA, 898 bp, Oryza sativa
ctgcagccctggccgtcgtcatggaccgcggccacgatctcctgtagtagcggcgaggccggcgggatgtgaagccgcccgtcgtaggtgaccatgtccgtgatcacggcccacggcgccgcgcgcgtgcctgcacggacctcgtcgtggatggcgaccaggctcagatccgtggcctggcgtggagcagccgctcgatgaaattgaaacggggcgcggagatggccaggagctcgccctcctcgacgtcgcggcgggagagggcgtcggcgacggtgttcatggcacctgatctgtactccaccgagaaatcgaagcccaagagcttcccgacccagtggtgttgcggaatcgtcgctaggcgctggtcgaggaggtacttgaggctgtagtggtccgtcttgacggcgaaacggcgtccccataagtacggccgccagtgccgcacagcctggacgaggccgatgagctcgcgctcgtacgcggcgagggcgcggtgacgaggggcgacgggtcggttgaagaaggcgaccggatggccctcctgagtgagcaccgcgccgaaaccatgggacgacgcgtcgcactcgacgatgaagagcttggcgaagtccggcattgcgagtactagggctgtagtgaccgcggtcttgagggccgcaaacgccgccgccgccgcatcatcccaagagaagccgtctttcttgaggagggcagtgagcagcgcggcgaccgtgccgtagttgtggacgaacctgcggtagtagcctgccaagccgaggaagccgcgcactgcccgaggcgaacggggagccggccagtcccggatggcctgcactttggacgggtccatggcgacgcccgccgccgatatcacgtggctgaggtacgcgacccg

SEQ ID NO: 93433 - DNA, 677 bp, Oryza sativa
tcagttacaaccaaggcatttggcattcttgtactagtatagtgttgttagtgtccatatggactctgaaatgtcttatgtgctcgttatgaggcttgtggtagcctttagttactatgaggatatcatcaaaattgttgtaaagagagctttaaaatagatagttatttctgttaattcacaaaatcctagcttatcgtttttttacatccatttttgagtgaaggatttgtcaattcatgctaagcttatatgaccttggttccagatagttgtttgaaccattctttgatgaatttcactattagttggaaaatttgtattgatagtgtgtgttcacttcaataggatgtggtctttgatgcaacaaggaggattgtgaggcctctcaataagggttcagctgttcatcatcctcgtacaagaactttgattactgttcatgatggaatcttggaggatgtagtctcccagctgagattgttgggaagtatatcagatatcgcctagatggtgcaaggtcatcaatgtagatgctacaactttctataatgtctcttttaatcatcattttaatactttattgtgctgatctgtcactgcatctgcagtagtctactagctaaattattgtctctgatatacaaccactgaaatgatgtaccacaatttcatta

SEQ ID NO: 93434 - DNA, 716 bp, Oryza sativa
aagaacgaagtgcatggtattttaaaaatgatgtaacattttattatacacaaactataatatgttcgcacttattagaatatatgccattaacgatgattataatcctaaatttgtcatgcagtttttacaactgaagccttaaatttgttgtgtaacttttatgactaaactacatttctacgagtgtttccctgttttttaggtgtgtttatttataagtagacattcacttaagttacatatctattttttagcattcgatttttaccgattaacattttgtggttagctagactattcattcatttgtgcagacacaaggcagtcccactataggtctttacctccagttaactaaacgaataagcttgtaccaaatgaaatacagccaactaatcatataattagcatctgaaatcaaggctgagatggtcatatgcttgaataccctacctactttgggcatgacataggtatggccggcgccatcccttgccacaagagaaggtccgccactgaaactaacaaggatagctacagcacaatactcccaaaacaaagctgcaaagtaattcgacttcagacgaactttagtccaatccaggacataccttggtagagtaataattcccaacttgtttcttctcagcgttaaacctcactccctttgctatcatggagttgcacccaccacaccaaatattgaatggcat

SEQ ID NO: 93435 - DNA, 2277 bp, Oryza sativa
ccccgggcgtgccgggcacttcacccggatgtcccgcttctccaagacgtccgggcggagcttcctgtcgcggcggtgcaggagcgacctgctgtacgtgtccgacccgtgcgagcacgcggtggccggcgcgggcgacgacctgggcgcctaccggggcgtcttccgcgggttcatgcggtcccggacgcgggcctgcctggtggggcgccaggccgcgctggacccgcgcgtgcgctgcccctactgcggcgcgcgcgtctggagcatggtcgccgcggggatggtgccgcgcaccgcgtggcggaggctgggctgcctcgagggccgcctcgagtactacgtctgcgtcagcggtcacctccacggcaactgctggctcgcccgcctcacctccagcgaaggcgagcacgacgccggctccggctccgactccgacgcgtcgacgcaaggcggcggcagcgacgacgatggccatgtagcgctgtgactccggtcagcgcatgggccacctcaccaccgtccaccgccatgtgcgccatggattattttgttctcaatgagtcagtgactcactcagcgttgtgtactagagtagacgagagaggatgggtccgatagttgatcacttgctctgcttgaggcagtagaggctagagccaccattccttccggccattctgcggcacgtggtgttcaggtggctcggttcaggttgctcaatgtcgttgtgaattgtgagttttgatgtggtttgacttcgtttgattcattgaggggcaaaatgttttgtcggcgggcaggcatcctctgttccatctcgaatccgccgtcgcgtgctcatttcaacgagacctcctcgctgtcgaccacgtatcgccgtgcgccgacttgtctgccgcgcggcggaaacgtgcgatcgcgggcgatccacgcgccgtcctcactcctcctgacaggacgacgatggaccgcacggcccggtgatcccgctgtgaccgagacgcccggggtaatagtaatttagtggtacagcaacgtctcacgcattggccgtattcgatacgagtatacgatagggctgtcgctgtgtcccctgctgtggtctgtggaagctgcagcagcgggtgatgcctccctcttgtctccgtgtctctgatagtctgatgggcagctacggccccggttgccttcgcaatgaaacaggggaggttgactagtgcattttcttgaagggcttgtgttcaggaattgggtgctgcacgaacgaattaaagtcgtcgatgaccggccggtaatgtccttttcaaatgcccttttcaaaccgagtgcgacatcctagagttctttcgtcatctgttcaaaaggacctcgctaggtgaaattattggccaagcattcttatcctggtgaccgacctgtattttggaccgtgtggccagaataatatcttcaaatttgaatttgaaattctaaatagacattcatggctggtcctggatccaaactggttactagccggtataattgccagtttttcgatccatggaatggacacaatattgagatttcagacacaatactccatacatgatttacatggacccttggctttatacatcatcgttcccttggggcttcgccacgatatttccaacactgtaacaacacatcttaaactctcaaagttacatattagagattgatgaaataaaaacagcagtgttatatatttaaatatgaaggtagtgcaatagtataatattgcccgtctgattattttattatattagacggtgacgtaaaaggagatgtagatggaaaagaggatatgatctcatagctatagatagattataaaattaatcatcaatagtatttttgtgtgtactgtatatttagatatagcgttcgcgaaatatattgagatataaacttttatataaaaaagaagtaggaaacttgttatagagttgtctataaaattctttccatgtttttacatactgcaattgtttgtatatgcccttagccaatggaactatagctatctataccattgtaattctaatcaccgtgtatgttgggctttgctctaaaaaaaatctattaggactttattgaagggtggaaacaacttttaaaataagaaaaatagtaaaatagaatgtcatgacttggtacgatatttctcaatattttctccatattttgctgcatttcaccccgttttccctccatttgccctatgttttttattcaaaatttccctttttt

SEQ ID NO: 93436 - DNA, 717 bp, Oryza sativa
attaaccaaatcctacacaagtttatgaaattaagcagtgccacgcatgtactgacctttgttggttatgcgctgattttcaccccagaaggtatagccgacagcattagggtgctgttttctgaaagtatccacaaggcctttgctagaaaagtttgtctcaaatgactctctctcttcaattgtgaaacctgcagacttggtttttgcctgaaaaagggttcagaatgaggatctgtgtactgatatatgaaattctgaaacaacctaagcactctgctctcgaatgatgtaatgatagtacagaacaaattggagggagacattgttcaaaaagaaaagagagttactcactggaggattgtgaatgtcaatgctttgacgagcacagttaaggtctcctgcaacaatcactggtttcgacttttccagtatctgcagatcaaaaggtataaatcagcttagattacatagtactatttcagggatcaaatctgttcaataagatattgtggagttgcggatatgaaccatgacacaactccacatggtctattaatgtcaaacagtaaattagattgaaaagttaggcaagtgaacacacttttacatagttgctgaaacacggatcccagttattgaccctgtaattctgaaaatcaaaaatgcaagaaaacaaaattagatcaaagcaattgacataaaatactataaagc

SEQ ID NO: 93437 - DNA, 1069 bp, Oryza sativa
agcgaacgtggaggcttcgttttctattcctttaataagttaatagattagttaaacttttgactaagaaaaaaaatcaaataatttataatatgaaacgaagggagtagttgcgatccagccaaaattttaacggggccgggcgtgcaggcccagtacctgacaagcgacccgggctacctgggctgcaaggcctcggcgtgccagaagcgccgcgcgtccggcacctgcaaggtccggacctgcgccgccacgctggcgttccacgtcatcaacttccgcaccgacgtcgagttcgtcctcttctccggcggcttcgcgacgccgtgcgtcctcaagcgctccggtgcgctcccgttcgccaaccccgccaagccgctccacggccacctctccagcgtcgactccaaggccacctcggtgagcacatctactatcatccaaagcttttccaccttgcttttctgcagctgcaaatggagtaatttgttgcatttctgtatgatgaatcagatgaggcttacgtgggtgagcggagacgcgaggccgcagcaggttcagtacgggacgggcaagactgctacctctgtcgccacgacattcactcataaggacatgtgcagtgagtagtaattaatcatgtgttcatcactgggaaaatgcaatgtaaaagaggataattcaatatcatgtttattatctcaaatggaatgaaaattccaatgtgcaggcatcgccgtgctgccgagtcctgcgaaggacttcgggtggcatgatccgggttacatccattcggcactcatgaccggtctccagccatctcagtcctacaattaccgttacggaaggtacaggttccccccttcttttttcacttttttgctgtaaaaattagcagttgtcacttgtcagtaacatcctcaatacgggcttgccgctgatgtgcagtgattccgtgggttggagtaacacaaccgaattcagaaccccaccagctgcaggttcaggcgagctgtccttcgtgatctttggtgatatggggaaggctccactggacccatcagtggaa

SEQ ID NO: 93438 - DNA, 615 bp, Oryza sativa
caactacgagagaacgtgtgcggtataccagggcaattgcaaaggcatgccaaagaatgtcgcaaaaggagttgatacctacgataacagcaactacgccgcacctgttcatgccgttgttggagcaggggggttcaacttggatggcttccctaagattggtgtaagagtcatatctacacctttgtgtatgttgttctcctaggcaattatagacatcgtttcaaactacatagtatggtggtaacaaattgatatactcctaattgataagaacgcattaacgcctgaaaactcacatactgttaaagtgacaagcttgtctttctgttaaattgttcagctgcatagctggagcttatcaaggatttcagagtttggatatgccagggtacatgcgacgaaaactgatatgttggttcaggtcagtccacatatatatattctacctcggtttctgttaacacgctttttaaattactgaacggtgggttttgtgtaaaaactttatatatataagttcctttaaaatataaaataaatttattttttaagtttgcaacaattaaacttaattaattatgtactgatggttttcttgtttttcttacttta

SEQ ID NO: 93439 - DNA, 5825 bp, Oryza sativa
tgtgttctgaccatctagaggttgtgcgaatttcgcagttgccactactcattgcagcatatgatttattgattctgcctatctagcaagtgcgtgctgctttaatctccacgaaaaagtttattccgaaacttctccgttaaagagagctcctcgaataaactaatcttggagcactcggttattaactgacgaatcgtttcatacctactgatcgtgcaatgctagatgcattggatgtacacacattgttaaacttacgaggaaacctaattatgtgttggaatcgacgtgttccccacacaagatttccccgtatttccattttttgcaagttgtttcgtacggcattgttaccagccgcctgccgccgttttgctagaataaaagaagctgtgtcggccactcgtgcgccactatatatggctgctagcgagctgaatgatgcgtgtagttcggcgtcgccactagcctctactcgcacattaatcaatcgctgcatgcattagctgaaaactatgatcttggccatccatacttggatccaatggcctagattcactgtcacaaggcaccttatacattgatttgccacagtaaaatatatgctaaggtgcttagtggatcgagcccctgatttctcgttgtgatagatgatgctagtgcaactgctgaggtagcaaatgcatcaggtcctgtacgaccagtggacgccgagatgacctggattgtccagcaatgttaatgtctgccatttttattttaatttgaagctagacttgcttaattactctgtttggaggaacatgaagtctacataagatcacatggttcacaccgtgaatgatcttaagtttccttctttgtgtatgcggtacataattcggtcccaaacaacatgagcgaacaaattttctggttggttgtttcattgttcttgccaacaatgttgaaaacaccgacacgtacaatagcctacaaacagcactgtttgactgctaaagagagagactagcatatatgcaatgaaaaaaatatgagagactatacaacacctctctgctatagcttgctggtcaacataggacgtattttgactttgccgtgtaaggttgaggggaaagacctgaccaatattttgatttgacgacgcaggaaaaaaattgactgcaattcacaattttttgggttcaatgatatttaggcacgctctggtttatttcagatgagaattatgcccccaaaagggtatcttgcccactgaacgaattcacctcgagttgtagtcatctgctggatccatacctagatttggaacctccggtcgtacgtgttagacttggaatagcatctagtcgacaatttaaagagtcgcctcgcacgtgtgtggtcttgttgaactaattaacccattgaatatatatgaaaccatgaaaatcctgaacttgcttgtgtccagtttctcattgccaaaagaatgcccagacggcaattagagatcaggcccaacaagggcaggaaggttttctctagcaggccaagtccaacagataattagacttgaactagtacatttctatgggccttttcagttttgaggctccaaggaaacgaacaagctagggatttttaaattttttttaaacattttatttttttctttaaaaataaacattttcaaaacttatttataattctgaaacttttgactacgccagccggttggtgtgataaaacaacactatcacgccgatgacgtggcatgttatttggccacgtcaaaatagctatggtaattgttctgccttgccacatcatcttgaatagcgtgtgatgtgacagtgttgttttgccatgttaggcggacgaacaaccaaaaagttcagattttaaaaataagttttgaaataatcatttttaaaaataaaaaggttaaaaaataataaaatttccaagctagcaggctactgaaaagttgattcaacctttagaaatgtcagtatgtcactgattcaacctttagtcaattacagtacttcctgtgcctgatcacattggagagaagtgtcactgttgtagctcggcttcacttctcttcctatggaccaagattgcaaacctgctcgagacggcagcctggaaaagggccttcccagatgcacacgcaagggtcacacacgcaaaagcactgaaagtctctccgtctttcgcccaactgtcagctcctcttaatttcgccgcccggtaccgtttaccggcgagcacagcggccaagtccacgaaagcaatgcaagcagcaccagctttcggttattgcggccgaacggggcagaggaattcgccgtgagctcgccaaactggcacgtactactacggtacatggttagaacccaacctggaggataagaccagatctcaatcggacagagcaaatgagcaatggagaaaacgtttctctttccctcaaaaaaaaaaaagcttctcacagttcctggctgcacggagatgtgaaacatcctcttgcagtgtcggtgccaacacgaaccaatccgttcaactgctggaggctgcaactgtcaggtagatcaacggaaacagggacaaacataacgcacagtacagtaaccatggtgccgagtgatttgatgagtgaacgtgtcgcacgttcgacgtagtcttgatctgctgcccagtttatagaggtcttgatccggactttcggagcacatgataggcaaaagaatcagattcagcttcatgttctagtaacatgcggagcacatcatagaaaggtactgtattgatatgcctttgttgtgctctggtaaagatccttacattgaaccactctgaaaaaactaaaaatttcaggttccctcaaggaatgagaaaaaaaatagaaaaacaatttctactgctttagtaatgatagtagcagtgtgagagaagtggttccttcagtactgatgtggcagtgtttagttccttcaaacttccaaaaattccatcacatcaaatatttggatgcatgcatgaacattaactgtggatgaaaaaaaaccaattgcacaatttgcattaaagttgcgaggcgaatcttttaagcctaattacgccatgatttgacaatgtggtgcttcagtaaacatttgctaattacagactaattaggcttaataaattggaaaaagtacgaattacacccacgaactatcgcggtcgtctgaattaccccccttaaccacaaaaccgaacatttttcacccctaactatgcaaaccggacgaattacccccctcggcccaattacacgtggcagtccagtcagcgcttttttaattaaaaaattgtgggacccgcacgtcatacacttcttaccctctctctctactctctctctcttctctctcgcacagcgcgcacggcgagagcgcggggactggcggtcggcgacagcggctcgcggcggcggtggcgcggagatgaggcgagcgcgacggcggccgagcaggtcgaggagtaccaccacaccgagcaggaggaccaccaccatgccgcgtaggatgacatgagcagtgatggcgacgagctccagggcaaacgcggcggcgtgctcttcatcccgcccttgggcccggtcgatgtggcggtccgtgaggtgaggcgagcgcggcggcgcggacgtcggcgcggaggcagaggcggcggaggagcggacggcgcggacgtcggcgcggaggcggaggcggcagaggcagcggaggagcgtggcggcggaggagcgtggcggcggaggcgcatggcggcggaggagcggatggcgcgggcgtcggcgcggaggcggaggcggcggaggagcgtgatggcggatgagcggacggcacgaacgtcggcgcggaggcggtggcggtggaggagtggacggcatggaagcggagtgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaaatccttccaatcaaattcctccgcaaaagtctattttgcctcccccgaggtcgatgggccgaatctcgctcggtccatcttcccctcttccccggccccctctctccccgggcgcgctctctctctctctctctctctcgcgctctcccatctctccccccgctcggcctcgcccgtacgctgctcgcgcgggcgagagccgccccgagcgcctctctccccgctcccccgctcagcctcgcccgcacgccgcgtgcgcgtgcgcgtaagccgccgcgccgagcgccccctccctttcccctcgctctgccgcgcctgcagccgcgcagccgctcgtcctcgcgagccagcgtgtgcgcgcccgcgcggacgccgcccgttgcttcccgcgcgcgcgtgccgtggtggccgaccgcccggtcgccgccgccgtcagcctctgcacgcgcctgtcgccagtgtcgccgctccgctccaaaccgccccgccgtcatcgccgtcgtcatcgcccggcccccgcccctccgcgcgcaagccgccaagggacggagccgcgcccctcctccctctgccgcgatgctcccgttcccctccccctctttttctcgaatcggcaaaggggcaagcccctttctccccctccttttcccctttttcctcctcgccggcgtcatcctcctgccgccgctttggctgcaagcgccgagcgccagctcgcgccttaaccgtccaatgtcggttcccctctcccaaaccgatattgccgtccatttaagcccaagccctccccctccaaactccctcattttcgcctccgcgccattgccgccctctgtttcgccgtcgccgatcgtcgttgcgcgtgtcggaggagccggcacgagcaaggacgcggaagaggactccggccgcgccctctccttcctcttccccggcccgaggccggagagattactcccgcgccgtcggcctctcgtcacagcgccccgacccgcacggtagtgcctctctccgttcttcctcctcgctccatctcccccccttagttttcggtggtagcacgagtagcctccccgtagctagccggcgccgccccgaccgttgccgtcgctcgccgtgtgctcgccgccgtcgccgcccgagctcagtagcacccgctcgtcgccggcctcgctcggcgtagttccgtccaatccgacgctagcgtcgagttctcgacgccgcgtagatgctctcaccgccgggaatcgacctctcgtgacctcgtcgccgtttccctcttctcccgccgccggttgccgctgccgcaatccgccgccgtcgagcaacctccggcgaatccgagccgttggctcgtctccccttgtcacgtgcaaccgcccggtgtgcacgcttttgcccgtatcaccgtggttcgctccgccgctcgccgccgccgcccgccgtccattcgtggccgggtcgtcgtctacctcccgccggcccgcgtggcagccacgtaggcgccacgtcggcgccagctcagcctagaccggattgagccgaccccggtcagtccctccccgtgcgcgcgttccaccgcgagccgcgaggctgcgcgtgggcccgccgcacctgcgtccaccgggaccgcgcgcatgcaccgcgtcccttccccgcccgcgcgcgtgcgtcgcgtgctccctccgcacggtgagccgagccgctgacaagcgggtcccacccgggaccgcgcgt

SEQ ID NO: 93440 - DNA, 1699 bp, Oryza sativa
tcgcctcacttccgcgccaccgccgccgcgagccgctgtcgccgaccgccgtccccgcgctctccccgtgcgcgctgcgcaagagaggagagagagagagagagtagagagagagagtaagaagtgtatgacatgcgggtcgctgactggactgccacgtgtacgccacgtagatcgaaaccaccgtggattgggtcgagggggataattcgtccggtttgcatagttgggggtgaagaatgtccggtttcgtggttcaggggggtaattcagacgaccgtgatagttcaggggtgtaattcgtactttttcctaataaattcgcctcgcggtttacaggcggaatctgtaatttgttttgttattagtctatgtttaatacttcaaatgtgtgtccgtatacttaggccgagcttagttccaaatttttttttcaaacttccaacttttccatcacatcaaaactttcctacttcatccgttccacgatgcaagtcattctagcatttcccacatttatattgatgttaatgaatctagatagatattcattaacatcaatataaatgtgggaaatgctagaataacttacattgtgaaacgaagggagtacacacaaactaccagcttttccatcacatcgttccaatttcaatcaaaagcctggtttagttcctaaccttttcttcaaacttccaacttttccatcacatcaaaactttcctacacacacaaacttctaatttttccgtcacatcgttccaatttcaatcaaactttcaattttagcgtgaactaacacacccaaactttcaatcttctcgtgaactaaacacacccttcagaaaaaaaaaattggacaagcaactaaacacagcctatatttaggtgcagatgcttcttatacaacctgattcttgttgacttgtgtgtgaatccaatgaatgggacaaggtgtgggagcaccaaaccggggtccagctccacggaaagcaaccttataccaacttatagatgtaatccaatggacggagatgtacttcagtagtgagtgcttggcacaagtgcaacggatatcccgtccaatatcccaagacaattaagagccacaatagattaaggtcatagcaactgaaatgcaattgatccattggccaatcttataaaactgattaactccatgttccgtactagataaaatgtaaagtattccatgatacatactcagctaacagtactccacaatgtagacaattttcatatactgtcaaagtaactacaagtggcaaaaattgactcatattttcatatgcccgacacaaagatcgtacttttcctgtatttatttgccttcctaccacaaattaagacaagaaatgaacagattttgcatcaaactagtagaggatcacacattgatgaattcattagaaccaaccaaattgcgtgtgctgttggaccagatcccacgctttaggcctggttgtcgctcttgcgttcgccgtgcgagtcacgctcctgcagcagcgagccggcctcctcgtcggcctgtgcggccttcttctgcgcctccttcgccttgagcgcctgaagcttgacgtggttgtagtagcctacaccgaggaatgcgatcccgtagccgaacaggttgatcggcgtgaccgtgtcccggatcacagaccaggagaaggcgatgagc

SEQ ID NO: 93441 - DNA, 980 bp, Oryza sativa
aaaaaaatggcatgtacatacatctctgtctcattataacagctacctgaaaagatatattagtattagtatctggcgaaaatagttctagcaagagaaaccaacatcaggaataaagttcagctcgtcttgacgcttgcagtattctgcagaacgtaaaccacattttggcatactgactattggcctcttctaatactatcatacagtacagcacatatcacacttcataataaatcataagtacccaacacttacagtcagtaacatctgcattggtagactaattttagacttttactcgtatcatagccaccattttattcgagcaggctataacaacggaaagctattacccacaaggtcgcaacatcaagcaaccggagctagcatggagaacttatgaggaacttgatagtttcattcagtcaatgaggcagaattcacaaagcttggaatgacatccactgaattcaccattttgggaatatcaagctcgtgcgaaataatgccagttccatcaatcccgcaatccacaattgttggtctagagctctcttcccggactgctacctcagtgctagtgttaaagcacggagaatggtctgtacaagtaacagaaccaaaactgcactgcttctgaaaggggaaagtaccaatctctgcatcaatcttgcctcggatatcaaacaaaagggctcttaacctcaccacctcagcctcgagtgatatatgcccctgcaatctcctcaagagctgctgatttgtggtgcgaagtttcttgacttcctcctccaagaaagctgcatgcgctttcttcttctctcggtacttgcgcactgcttctctatttcccagaggcttacgggtctttctcagctcctcttcaacattgttttcaccagaagccatgacttgaatgtgtgtgtggaggcatgtgtgagtatgcatagcaactgatggacccggtggattgcaag

SEQ ID NO: 93442 - DNA, 719 bp, Oryza sativa
tgaagaaccttggactgtacttgtacacaagaaacgcacaacctgcctggattccttataatcctaaggtcatgaggtctccatctcttagcaaggatacgaaggctctaaagattctgtcatggaatgtgaatggattaaaagctttacttaaatcgaggggcttctctattcatcagttagctcagagggaggacttcgatatactatgcctacaagagacaaaaatgcaggcaagatatgattttagtttttcttatgcaaaattaccatctaaaattggacaaaaggttctttcttggggaaatggtatcttttcttctctctgaattgttttcatccttcactgctatagtttattaaccaggaattacgttattttgagcaggagaaggatgtagaagtcattaaggaaggtctacttgaaggctatacccatagtttctggacatgcagtgtatcaaagcttggctattcggggactgcaataatttcaagggtgtgcactgctattctcacatcctaccacaatgatcattgcaaaatggctacaacctctaatgcatcatatctcatgtttgttggtttgcttcgttttgtgccttatatcttgtttttatctataatgtgttgtgttctgcaaattcctttaggtgaaaccactctctatcaagtacgggcttggtgtgccagaccatgatactgaagggagggtcgtc

SEQ ID NO: 93443 - DNA, 869 bp, Oryza sativa
tcgatcagttttattttaaaagaataaaaatctgggattaaatctcgagttcaacaaaacctaggggtataaattgcgggacatattggcacatttaactttttgtcactttatgtggcaattaattatttaccacatgctgtctatgacatgtggacccttatgtgtctatgacacgtgggtttagtggcaaatcttttatcaccactcgtaaacagtggtggacccaggatttgaacccagggtaagcctagcaaaaaaaatcctaatgcaatacaatacgattcgacataaaatgtggtaaacgatacgatatataactctaaatggttcaatacaagtaaaaaataataaataagtttgaatcttatacctaaataaaaatgtaaattgttcaaatataacataaggtctttaaataaataggatattacagtactagtcaagactcaagagcttttgctttacgcttcttcatggtcatgaaagagtgaattatgtcttcctcacttgcattggagaagatatcacgctaaataaaggtgaccaaacaattattcaataacttatcactcatattatttctcactttagtctttactaaatttattgcagaaaataccctttccacacttaccgtcgccaccggtaagatcaacaccaatttaagaagcaaatacaccaaatcataaagatcatgcctcttcgtatcaacaagtttaattgagagctcaccaatgttgtttaggcatttgaatctatcatcctctctcatataatcaatatatgtatcaagttggagctcaagtttcatcaaatcggagccttcaatgtccttaaggataaaaagcttgcaagtctaagtcttt

SEQ ID NO: 93444 - DNA, 723 bp, Oryza sativa
acacagagagagattaccgagtggtttgcatacaatccaaagaccatgaggcctccaccacttagccatgataccaagtgcatgaagattttatcctggaatattaacgggcttcatgatgttgtaacgacaaaggggttttctgcacgtgacttggctcagagagagaattttgatgtgttatgtcttcaagagacacatttggaggcaagtcttggtgtttctgccataagactcttaatttatactgtacctctttggtgttatgtcatggggcagtgttattccgaacaactgtcacctattatgatgtgtttatggtcttacataatgaatttatgattaatatacatcgtgtactgtgttttcattatgttttcaggaaaaggatgttgaaaagtttaagaatctgatagcagactatgacagctattggtcatgcagcgtctcgaggcttggctattcagggactgcagtaatttcacgggtatggtatttatgtggttatgttcaagataagttactgtgcatactaattctagatagataaaatattttgatgaaaattagatcatagcatgacttatgttgtgcttccattgcctttacaggttaaaccaatttctgtccaatacgggattggcatacgtgaacatgatcatgagggcagggttattactctggagtttgatggtttttacttggtaaatgcctatgttccaa

SEQ ID NO: 93445 - DNA, 724 bp, Oryza sativa
ttcttgcaattccttcatatacatgaaagtatgattgggtctgctctataatagagtccactttactttcaacattagaaccatggggagacaccttctcataaaagaaatccaaatagtctcttttccttcttggatctaacacagtggtaatgacaagtgccaaattgaagttgtttgccaatttttcatcccaatattttgcaaacttggtgtgcataggagcagccaatcgttttaaaagatcgctggtttgccaatcaggatcactcaaagcatgacggatacaaagaacatggggcaagaatgtgtgtgcagttggtgtcctatgagctgatacacctctagtagcctcttcaaaagccttaagaaattcacaaattgattcagcatgcaaccattcttcatcagttggtagaagttcacaattttcagaggcatagctattgaggatagccttgtaaggcaatatttctctaatcatcttgaaggtcgagttccaacgggttggtacatcaagagtgaaaccagattttggaggaagacttttactagaagcaattgaataaacgcttgaatgcgtgagggtgaatgctcaatgtactttaggatctcacggatcttatctattgctgcacgaatcaccctcatcccatcttgaaccacaaattgaggatgtgtgcacaacaccttacatgaaaatgttgccttccaaaacaactca

SEQ ID NO: 93446 - DNA, 729 bp, Oryza sativa
tatgctataatgcgggtggttcttcctaagggaaatgctatcaataaggattaaaagaagttctgagttccgtctgaaatgaaagaagggtgctcgatgggccagctgacgacacaacgatgatgaactccatttaggaagccagaggactaggcagcctaatatgccagggatagtatgttcaattacactgcaaacatgtataaattggaaataacatccaaggataaaatttggggtcatggcccacatgccaatgagacatcaacacaggtgttatttaccaactcttgtgatctttatggtgttattaggaaattattattgaagttcggctggctccttcgccagcccaggaaaaaaatattaggtaaataaataatcatatgaaaaatatttcagttattttttatggtatgataaagctcttgacattgagtaagtacatacctttgttggtcttccgggcattatgcctataaccccagtaactatatccaacaacattgggatgctgttttcgaaatgtatcaacaaaacctttggacaaaaaattagtctcgaatgattccctttcttcaattgtaaagcctgcacttctacgatttccctggataagagcattaactataagctaacaagtataaaaggaacgtttggggaagcaactggataccccaaaactagacatttatgttctcggatgttagtatagctacttttacctct

SEQ ID NO: 93447 - DNA, 718 bp, Oryza sativa
tcactagtgttacaacaacagcagcagcagcaagcataatagcacacagagcttacaggatatctagcaccaaaaaaaaaaggaagaactgcctaagctttggcatctcctttaggttgaccaagaagagatggccggtaaagtgaatggccctgcgccatctcaattctttcacgtggatcatacattgtttcatctcttatggcctgaaggatcgaatcaggaggaagttccctgtaaatacaaatgaacaaattgagtaggctgtggcacaaatacgctacgactgcactgtcagctagtagtatgagggtggagaaaaggagccccccaaaagcttgaaaaaaaatatggaatttattcaaatttgagcaaatctcaaaatattggcactgctggcctcctctatttgcacaacggagttgctagaaatatggcgccatatgctacagtcgatttttttcagccacttacacagtagttacacctcatttacaccccacctacatatgtaattagtatgtaattttcgaatttacatatgtaattttagtacttacatatgtaattttgagacttacattgtaaatatactaaaattacatatgtactttaggaacttacaatgtaaatacatgtcgactatttttttatgaaaaatatggcgccataatatagctacacccttgcacaatcctacattttagctgccactgat

SEQ ID NO: 93448 - DNA, 2266 bp, Oryza sativa
tttcctcagttattgatatttcagaaaccaagacggaagggcaaacctgaatggttcctttgccttttatgctgtcacccatctctagtgtcagttcacctttagctagtttctgcccataccatgcattacgacccttcagcaatgtgacataagtgtcagccaataatggcccagcaagtttttcaggctcttcttccaaaaggtgggttatgtaaatcatttcagatgtgcaaagagcaaagtaaacggatttgctggttgcactctcatttgttagagctgccaccatacctgcaggataacaaaatttcagaaaattaacagaagcataaaccaagaaaaaaaaaggcagatgaccacgacaagattaaaacgcgacgtaaagcatagcaacatagatgaagccacaatataccgcacatatttctatagttgtatttatggtatatttcttcctggagaaaacattgtatatatcttgatggtaacagtgcattctgaaaaatataaaacaaggcagagtacgcaaaacatcaactaaagctgaccagtgcattccaacataccccatgctaaatatcacaacagtatatgctctaccgtgattacagaagatagcaaaaacaatcaagagaggaaatagaaattaccggcaccaatggcatacacatttttcaaacctcccatgacttcatgtgtaatgagatcactattatcccatacaataaaatgaggctgcctcaaaaatttagcaagaggttttctccatttgtcagctccacatatacgagcatttgcatattctttattgtaaatttctgaagcaatgttagggcctccaagataaagaatgttttccaatggaacccccgctgcagaaaacaaaacaaatataaattgcagaaataaattggaaggatataattcaaaacagttaagaagtaaaaccaagcatgaacactcggccgttaacagtaacacacaccacaaatgatcaggtttaaacatattaacctgaattgagtttaaaataaaagggagaatctaaataattcattttatttatgtggaaagacagaaactggagttataccaattcatgtaacatatctagcagctaaacagctaaaggactattgaacaacagaggacatgaataaaggcaatgtttgtcccatccagttctttttttgccagcgttgtcattttcagacttgtgcctttgtatgttcaacatagacttacttttgtgtaaattatgttagggcatagagctgaagtaaacaaactattcatcctcaaatcatacaaagttacaaatttctaatgtagtctaaagcaaagataaactgcatttgtcaataccagattaaagaatatcctagttacggataagcacaaacaaagaacaaagaacaagttaattcaagcaaagagtgcacatgatggtaagattgtgtaaagaaaaggaaaggaatctcacttgcattgctaatcatctgtgtgggagttatgatccgtggcaggggatccagggaggcctctatccctttggccagagagaggatgatgggggcagtaatcctctccttccagtacctcccaatctccccgaagacttccctggtgtccgtggacggcagcccgttgatgacaatgtcggcgtcccagacggcctcctggaggttggtgacgaccttgagcgggcagagcggcgtgtcgatcatgttgaggcagaagccgtccctgagtatctcgtcggcgtagagggtgcggtcgccgaggcggccctcgacgtacttgaggtaggcgcagcggcggatcaggcggcggaggacgtcctcccgggcgttgatgacctcgaagaggtgctcggcggtggcgcggtcgacggcgcggcccgggcggcgccagatgcggacctgcaccttgtcgcggaggtgtccgtacgcgtcctgcatcagcgcgcagaagacgctcccccaggccccggcgccgacgccgacgatccggagcgggtcgccgtcggccttgcccagcaggcgccgcagctcgtccagcttctcctccacggtggccccattcccgtgcccgttcgccgccgccgcgcgcggcgcgtcctccgccccgcccattgctccctcctccacctctccgccttcccttgtcgtcgctgcaagcaaaatcgagcaggcaccggagagcccaacggcacacgctacataaccgactacttaattacggggatcggcgagcgaacgaa

SEQ ID NO: 93449 - DNA, 1776 bp, Oryza sativa
gagcgcgtccacccgaaataatagtgctagtagcaactgtagcacaattcggatgtgtactgtgtaccaagaagcattaggccatgaaaattggaggacactttagtagaaagacaaccgggagacaatcgccacgtacgagtactgttcatggccttagagtagtgctaaccagcacaaactgggatacgctgtaccaagaagcattggcgtcaccatgccacggggaaaaaagaactcctttccgtcacgttactgatagtgacgacagggagcaacaaaatttagtgacgcgtacatgcctaccttccccttgcgtgccaaacatgttccacgcacaggtaagaagctggggatttgttcaacacaaaaatcatataaaagaacttgaatgtctcatctcacttaccacggtagcagctactcattgatatataattcacacttgtgagtcgtgatgagatttaagcggaaaaaacgcactacgattttattaagacaatcagaaaagcatatctccccggatcacaaatgtatcttaggaagatcaccaatgtattttaggccttccatccacagctacaagcaaccttaattatggactacttccttacttgcattaaacataactgtgcatcacattgcaaaaggtgattttatgaaatgttgactacaagttgcctggcaacccaaggttatcgagtgtgctgcctggcaatgaggtgatggtgatacgccaacagttcaaatatagaagggggcaacggaacttgctacaaatgacatgaatacaataaccacctccctatgctgcaaaaggacaggaccaacactggtggttaaaacttgagacggtttcagtatttctgctttcctgaataatgccaaaagagtgttaagaaaacctgcaaaacggtaagtagagtgtattcttgttacttgaagggtgccattatcctcctccgccgttttggagtctccctcttcacatacatcttctccatatcgtttagtgggcggcttgatccatcaggtaaactggcgaacttccagccacctccagagccccgctttgactgcgctccaagtttctcaaccatgtaggtccatccatcgtcgggccgtcgtcggctgtacttatgacacttcacctcgcctgccacctgcaattcaaaaaaaaaaaaagaaggaaggaaggtcagaatcctatcactcatcacttaagggaaaacacagaagatccattaagatggtcagtaaccaatggaccttaagtctttaaacatcatgtattttctggctcatatgcatatagcttggcatgaagttatcttacacagaagatactccatagcttcgagtgttttatcttccaatacaaaaggaaacaaattccaacaaattattatcatgggtctcccatgtttgcctttccatatcaaaagagaacatcaaattcactaatcactacatataaacagcaggagctttaactgagacttaacaaaaacaaagacaacactaccaaattatttaattaaagatgatgaaagggagaaatagaaatgtaagatcctcaccttcttcttgttgaactgtaaccgttgaacaaattcctcatacagcatctgatcttccttcattgaaatctcatacagaacctcatcaggatctctggttgtgccatcccagccctcaggcataactttgaagtcaggtttataaggaagtgatgcaacatgaaattccctatcatgggaattgaaaaacctgcat

SEQ ID NO: 93450 - DNA, 716 bp, Oryza sativa
ccctatggtggttcttgttgaagttacccgggtggtagggacggtgctgccggataatcatggtggaaggtccaccgtgatgtcccatcgtgaaacgaggcttctgacacttcccctggggagtcctgaactgggctgccttcctcttacggttcattttgttacactgctcctcttgacggatagccttgtccacaagcttctcaaagtcctcataatctctagagaccaactggttggtcaattcatcatcaagaccagacagaaacttctcctgcctctcggcatcggtacgcacgtcctcaggggcgtagtgcgcgaggcggttgaactcatgcaaatactctataactgttctggttccttgttgcagggaacggaactctctcttcttttgtgccacaattccctcgggaacctgtgctttattgaaactatgacaaaactctgtccaagtaacttctgccccagttggacgggtcaccatgtagttgtcccaccaaatagaagcgggaccttgtagctggtgtgtagcaaaagcaaccttctcctgctcgttgtattgcaaaagattcagcttcttctcaatggcatgaagccagtcgtgggcctcgattgggttggtggtgcttgagaaggtgggcggcttgacacgaagaaattctaacagtttggactgaggaggtggaggaccaaactgcaggttctgctgctgc

SEQ ID NO: 93451 - DNA, 1124 bp, Oryza sativa
cttcatagtgcaccagagtatacgtactactttactagagtcttgaacaatctcttccttttgagtactgtgaacttgagattggaagtacacgttttcatttttatcgatatgtactgttacaggtgactgaagctttggcacaagcaggtcttgaatcatcaaatcttattgtaggcattgattttacaaagagcaatgaatggacaggttaacagaccacttcttgttttgaattctgtttctttatatttgctttgtgctgtgctggtagcctattacttgcgaattagtagtgttattatatacatcttgatttacctattattaggacaaacatccttttctaccttagttgcgtatgatgcaaatgagaaatggcatgtcaacttctcttaattctttgttataaatgagctctcactagggctgctgtctggaaggaggttggactttcttgaaaaaagtttattgagggagttagctactcctaataagctggttatttttctgtatctgaagtgcctgtgatgcaaatggcatgtcaacttctcttaattctttgttataaacccctaataagctggttatttttctgtatctgaagtttatgtgaactacctgttatcttttgacataaggagtgaacctgattccgtaacttcacaacaaatgcaatgtgcaatcttttgccaaacaaaaccatttaaagtaaagaaatgtgaaatggggcaattatgcatgtagcaaggatgcctctcatgttgcttgcatatcctacagtcatgctatgtcacaaatcatagcactctcatttaacctgctgagcttttctccattaggtaaactttccttcaatcgccgatgtctgcatgatattggaaacactccaaatccatatgagcaagcaatatctattattggaaggacactttcagcttttgatgaagataatttgattccttgctttggatttggtgacggtaagttcattgttcccattttccattttgatcacttggtgtgtctcagtagcatatttaaagaacaatgctgatctaatgcctcctttgtggctttgtctactggcagcatcaactcatgatcaggaggtattcagcttt

SEQ ID NO: 93452 - DNA, 649 bp, Oryza sativa
atttccaggaattagtgaacaagcagatatgcagtgtgttaaagctgttagcactgttgagctgatctcataaatatttaactttttctgctctcattttccatgaaactagcttgaaaaaaaaaacacatactactctggaatcactcacttatcagaagtattcatattagtttgcattgcaaataaactgcaaagagatgaacatttagacgcagcttttgttaaaatataagagctagaggggaaggaagcagagatcgagagtatacagcagaaaggaacacatgtatatccgcacgaatcttgatgcaatccgcaccgcacgtgggccacgcggattggaccgagaccctactactgtcataggcacggccgcataggcgccacccagtgattgggacgaattctagtaggtgtagcccttgacgtacaagctctcggacgtggcggcgtcgccggcggcgccgccgtacttgccgagcgtggcctcggaagttggccttgcaccgggcgaggaaggcagcctgagcggcggcgacgttctccttcttgccgccccacttcttgatggtgctctgctgcagggcacggccgaaggagaaggtgagcgtccatggcttgagcacctccagcttgttcatggcgt

SEQ ID NO: 93453 - DNA, 995 bp, Oryza sativa
tatgggatggcgttacctcactcttgaagctgtaagagttagaagcattgccaatatcttttctagagtccatggcctgtaaagagctcttgttagaaactatcctcaggcttggcttcagaaattcttgcaactcatactttgacctgagatattacaaaactaactttgttcaatgtttactccgctatggaagtcatcaacttaagctatttaaatttaattgtatgagacagccttatacagataaaattacttattttaaagggaaacactactggcttgccccagtaattaaattttataaaccatcaaaaaaaagtatgagtgataaaattacttcaagtgattaggaaaaaaaaaagcttcgcacatttcaaattgaatgactagctagatatatgttgttgaaaactaaacctagcaactcatgggtacaatcaacaaaaatggctgatgtgtatttcataaatgcacctgatgaaatctgctctctcttcctggctagaatcgggatgtggcttgtgatagcctcctggaagaaatgcctcatagattgcattggcgtaagagtttccaccgacttctagcatggagttaatctcatcatcagtccactcatctagagtgactgatagaacctgtgtcaagtggatattgatttcaaccagaaaattcatttaagcttgtattgcctctagcaatattgaaaaatgttacacatttcctcgtatcattttgcagtttaaactaaccagcccatggttgttctaaatcttactaaaatatggatatcattgttatcatatcatggattcatcaagaaggtcaaataactttttttttctagttgcagcgagtgaaacctttgaaatatgcgtccccagacttctgtgaattccagaacattttaggcatatgaaaactcctatattagctgatctgtataggaaaaaacacatagttaatttaaaaggagtaaacaaaccatgttg

SEQ ID NO: 93454 - DNA, 1607 bp, Oryza sativa
ccatttttgttttctcagtacagcctgatccttgtggttatatgctgctggcacatagggcagcgcaccaaattcttcccgcattcataacaggtctgcgaatcattttatcaggcatgctgccatttataacaagaaattatgtagaaatagagaacaataaggggaaattttctgcacctgatgtccacatccaaatgcaagatcctttgatttatccatacagatagcgcacacctgaacccacacacaaaaaaaaaagctgcatttagtttgtaatccagtaagattctcagggtttagcacgaaattggatggtacataaaaacttaacactagaggtgtaggaactttccatgatctgcggattaacagtatgcccaaatgacataagaatgtgaaatgcaatagcaatattcagcataatgtagttatcagatcaagatcaaatgggccatttgaaggcacgatattttttttttcataaagggcatccgtgaaataagtaataagccaaatgaacgcaggcagggtggtcagaacagatagagcaatgcaatgcaacttcccctgtttcaattagcctcccgaaatgccacagtacgaacaaaataaaagggagactatttgttggtggtgtacgataatgacaccaatgtagtcttgcagtatatagcttaaactttattttaccaatgctacagtgttgcagtatatatcttaaactttatctattcaacatggtgtgaatataaacaaaaatacttacaagtcttccttctaaagaactttccgaggtataagtgtcaggtgcagtggtagccacaggctgtctctgtttgaagctttcagattgctgaaagccacttgtttgtgggccgaagctactagatcgtgaataaacaccagaatgttggtcaaagctagtagacctcgaataagcattcctcataggtggcggcagaggaattcttggctgtattctttggcgacggctgaaacgaaagaaaacgtgaagaaaatgttcaaatggatacaattgctgcaagcacaaactctagtacatttgacccagtgcagtcctgggaaaacatggattaccctagaagttggagatcaagtgttgccttgtattgtgttgggatttccatcaaggcggatagtgcaaattctgcctccttcctgtcagctgctatgctctttgacatgatgtccgtgaaattcacaaactgcatgaaagcaaacatttttacatgtctctattattgtgaaaaccacacaaaaataagccaatgactggaaattaaatgtagaacagtcacctggaaattgtcaaatgagcgagcaggtatattgtcatcaaactgatgcatcatgtcccatggtccatcacccaccccaacaagaacaatagacaaggggaactggctggaaatttatttcgaaaaaaatgttaacacgtgtgattcgggacatttgatttgggcagaatataccgatattaaattagggactcgatcaagtacctagcttttactatagcatcaatcgtatcacgctctgcgggcttaactgcccagactgtgtatcaacacttcgggctgcag

SEQ ID NO: 93455 - DNA, 4611 bp, Oryza sativa
cctctaaccctaatcccgccttcctcttgccattgccgctcaacaccgaatcttctcgccttctccattaccaccgcctctctacccctgatgagcgacccctaaccccgtcggcgtcctgtcgtcaatggcaccagtgaggcccaacagactggcctcctcccttcctgtcctctccctacccctcctctctccaagtgacagcaatggcctattctcgtcttcttccttgtctttggctcccacagcgccccacctcctatgtactctaacgagaagagtttcacccgccaacaccaatacaccttttctcattttcttccatggctgagacggcgccgttgcgtcgccatcaccttcgtcctagccatccctctaagctcgagaacacctcccacttccccactccaaaatctccttcctctccctacctcaaccctaaaaacctaatccataggtcctctgccggattcatcaaagatgaagccgaaacatagctattgaagcagatttgaaggttagaaattcacacagtttcctctaaaatcacgtgcttgatgtatagtaaaatctttctttttttttcatcagaggtttcatatcatacaagtcaaggagccaatgaggtagtgttgtttattttactcccccccccccccccccggcgcaaaatttgctattggacaacttttctaagggtactgtgccaactttgggacttgtgtcgctgcgggtggggccggcagcatttctagagggcccacagacagcgactcgtgccgaccttgtgcaagttttgcttctaaagtggctttcgatgttatctatgactaacacaaaacgacggtcaactagatgtttgttttcagttggaaggagcactcggttggcatctacagagttcagacaccggagaaagtcaagcacaagctgcccatgttcaggcaagctacgccagtaaacgtcaggtacaaaacttgagcgaaattcgccattttgaacttgaatttctgaaaaagatggcaaagaacaagaacaaaggcttctccaaaataaattcagaacaaattgtttagctgcaatgaataacatggcttctgtgaaactgtaaccaaagctcaacatgtttctgtatgatttttggaaaaacaaaccgtattttgtgaaagcacaacgaccaactcagcaatctgcaaatgcaagttagtaaatgcactgtatagtgcacaatgagaacagcaataaagcttaggaacataaatgcaaccaattctgatcataatatagaggcacaagggtcacaatctgcaggttaagatcaccaagatccattcaacataccaattgttgccagtaaaactgtgcccaggctttgcaattaacagttagaaccccagggatgaaacaaatgtattggtacaaactaaaagaatgggttgctggttgcaaaatcatgtcgacaaaatttgcggatggctgtacctgtgctaccgcaatttcagctaggtttctttcagtcttctaccgaaacagaaacggaaaaacccgcatttactttgctcctcaccacaagccgagcatcttccaccagaagcctccagcaccaagccagatgatgatgttaacgatggaaatgacaaatccatacccccaccactgagccagtggaacatagccagcaccgtagaagacaggagcagacccaattccatagtgcgtgagtccacccatgatgtttgagaggaatgaaagaaccatggcagcaattagaggaggagtgcccaaggcgctggacactgacaaaaatgcagtgaacattgctccaatgtgcgctgcgccactggcaaagaaatagtgggagtagaagtacagcagcaccaagacaccaaacgatagttgccatgagagaccaaggccaccaacaaactgagcataaaacacaacaatggtcagtataggaaatcagcaaagacattgagagaacacttctattttaatatatttgcagagctcgagttagaagaaacaaaaatagcagaatatcaggtgagaataatattaaacatttaaactgctcatctccagctagtgccatttgtttcaagcttaacaatgataaccacgaggaccattcattttaagatatcttcaaatttaacaattttaaacacctccctaacatagcataattgccagcctatccatactattgacagtgttattgtttcagtatgaacaaacagcagtataagttgcttctcatttctatagaaggataagctagaaagattattcaagaaatttaatatctgatgtaatgaaaaataaattgctttgatttcaaactgctaggaactaacatattgtggaaaattaagtcaccatgctcaatgtttataatatgcttaccagttagttatagtcacaaagcttactgatcataaaatccttacaagcataaagcagatcatgtgatacgatttgacctgataagtcaagagatattgttacaggaggggggagggacataccttcacaacagtctcactgaaccaagagatcaacccgtatttgttgaggtatccagccattgcaataagagcagcaaaccatgtaagggtatcccacgctacagcctcccccaaacactctttccatgtaacaactccagaaatcaggaggacggataggccaagaattgcagcagacactgcatccacattcagcattccaccaaagatccaaagacctacctgttggcaagatgacaatgtatagtgaggaaaaggctcagtttttattcaagttggaggcaatcaagatgatgcaagaatgtagaggtatataaacaggtcgttattgggtttaccacttcttatcttttacaaaataacatgtttcacagtaataaggtgacccaatcacaaaccactgtagggttctcctaaaagatggcttgaagcttcgcaaaagaaaccacaaaacggtacctttgctattcattcactgataatgtaaattagtgaaagtcttttaagtgaaatcacatagtaattctacataggctagtcagagcacaataatgatccaaatctcacggatacctaaataacaattaccggtccctacctctatgtactaatcccagacaagacccctgctaaaatgagggcacaaacaccagattcatggaaatctccatttccgaacagcccactcctttaatatcaatcacttataagaatcctagtaccccacaggcaacatctttgtactgaaaatcataaacacctactacacatatagtacacttcgctagagtactgatattgagggcctatttggtagagctccagctccacctcttctggaactagagcgcagccaaacagtttcagctctacccagaaagagagtggagtaggctggatcactctcacaaaatgaactaaagatgtggagctgggtttaggttgctctacaattcaacttcagatccaactagtggagttaaatttaggagttggagcccaccctaataccccaaaagcagcataacaataatataatactagcaattgttaattcctcaacaaaaatggtagaacgaaaggaaattgctaataatcccatcaaataccgtgaggaacagcgttccagccatgatcttctcctccttgctcataggccccatcttctccaaccgctccttcgccagccgcggcgcgtcggggctggtcttcacctccggcgggtagatcaggtacagaatcaacggcacaaacaccagcgacagcaagcccggcacaatggcggccttcgcccacagcgtccacccgatcccctgcccgatcgtccccgccgtcaggttcgccgccagcgggttcgctgccatggcggtgaggaacatcgccgacgagatcaccgacgtctggaagcacgtgagcatcagccacgacccgagcctcctctccgtgccgtcgccggcgcgcgagccgcacgcctcgcacagcgacttgacgagcggcaggaagatgccccccgcgcgcgccgacaccgacgggatggccggcgccagcagcgcctcggcgaacacgagcgcgtagccgagcccgagcgacgagccgccgaaggcggagacgaaggcgtaggcgacgcggcttccgaggccggtcttgatgaagccgcgggcgaagaagaaggcgagcgcgatgagccacgggatcgggtcgccgaacgcggagaacgcggcggcgaacgtgagcgtccgcgtgagcacggcggcgccgaggccgagcagcgcgacggcgccgagcgggagaggctgggtgatgatcccgacgatggtggcgaggaagatggacagcagctgccacgcgttgcgcgccacgcccgcgggcggcgggaccagccatatcagcaccccggtcccgatggttgccaccagcggcttgattgccgccccctgaagcaccggcttcggcggctgcgacggcggcgccgctggagcagcggaggcggaggcatgaagggcgcggtggcgaggaggaggagaaggggtgagtggggtggggcgggagagggagagggagggggagggggagagggggc

SEQ ID NO: 93456 - DNA, 589 bp, Oryza sativa
cttatgaatatcttctttggccataaagatctgattgtaccctgcattaccatccataaaacttaaaaccttgtgtcctgaagcagcatcaactaactgatcggctactggcattggatactcatcttttggggtagctttattcaaatccctgaaatcaatgcacaccctcaccttgccgtttttcttaataacaggaactatactagaaacccactcaccatatcggcaaggacgaataaaaccagcatcatatagacgtttaatcttagccttgacaggttcgagcatatcggctttgcatcttctcggaggctgctgatgtggtctaacccctggtttgataggtagccgatgttcaacaattgatcggctgagtcctggcatctcacaatacacaaaagcgaagcaatctttgaatcttttaaaagctctatcaacttggttctaaattctggagataagtttttactgataaatgtcggccctggtcgatcacctggacctatatcaatttcttccaaatcatcggccgacatgaaaccctgtccttgtttgtcatcgagatcatctactgtgtccttggtgt

SEQ ID NO: 93457 - DNA, 542 bp, Oryza sativa
ctagaccccgttcatcaaaatctgacaaatttggcaccagttttttattcgaattccgtacaggttaacaaataaaccaatcaaatctctactactgaattgcaatatgtgttggttgcttgtgcttgaattttgatacagagggtcagagattaagtttgttcatcgcaaatcgttaatctgtcactctcctaaggtcaatctattacgtactctctgttggatagtatagaaagagaggatactgcgaatattggacacattgtattgagcctcagggggccgatatatataggagtacatggggaagagataaggaaatattacagatatggaagaaatccaaacaaaccaatcctatcctaatatgactctaactaccatatactctaacatcccccctcagtccaagcgtgagcagcgcggacacttggactggagaataaaccggcaagagtgctcaacacggataatagccctttgtgccatagtcgatgtagccaaagcgaaggagccgggagagccgtggtcgctgaagccgt

SEQ ID NO: 93458 - DNA, 1213 bp, Oryza sativa
atatgcatgtcaatcactccacattacatttcagttcatgaaaaaaaaatggagaacgatagccattcacccactaatttgatgaatctgccgccactatactacatgtgactattaagaaaaagctctaaaccaattcacaggaaagcactattgcttctaaaaattgtgaacataacttgaaactttgaaagaaagaattctaaagagtgatgtctaaagagtgatggacgtcatcattcttgctgcatatcttacctgtataaagaagttggtacgtcaaaggatatttgaccatctggtttcggatattgaataggcgagtgcaaactggccatctgttcacaagaatgtgtttggttaatgtcagtagtgaaaaaatgaaacaatgtgcttttcatttatgctaacaaagaatgtctatattagatgagcaccagcagtacttgaaactcacatctgttgcttcatggtcaggtatcccgtgctttaaggtaaagggggactttcctttgaatacgtatctaaaaattgaacaataacaacaaacgtcagcgaaccaagtagagtattgacttcatcccaaaagaagtatagaatattaagtaatattaacaaattagttgggcctcaccgttccagtgcagacaaggcaatgcctggaataaatccatattcaaatgcctgtaacagaatataaataaatctgtctgctcaatagcttcagaaaggaaaaaacagaaactgcatatcctcacttcaaaagcttgtatgacggaatacttaattagacaaaataaatgttcaggaagtctgtaacaaacataatcacatactggtctgtaattccgagctctataaagctcttcccatatccatgacttcttgagattctcccaatagagttccatcgaagatccttcaacaagagttttgaaagttgcttctgcagccagcatacctgttgtacacatccaaccctttagtacatggcttctcagcatactctacagttagcacacatgatctaccatttttggttgagaataatgtgccactttaaggagatcaaaatgtgtactctgaaagaaatgtaaagtaattgacataaaagtgaacaggcagcactacaacataaagctcaaagcatcacgtaaagagatacctgacttcatggctgtatgagttccttttattttgggaacattaagga

SEQ ID NO: 93459 - DNA, 735 bp, Oryza sativa
cgcggctgggcgctcttcgtcgactgcgacttcctctacctcgccgacatcgccggcctcctcgcctgcctcccctcctccgaccccgaccaccgcctcgccgtcgcctgcgtcaagcacgagtacgcccccgccgaggcgaccaagatggacggcgccatccagaccgtgtacccgcgcaagaactggtcgtccatggtgctctacaactgcggccaccccaagaacgtcgccgcgctcaccccggacgccgtcagcacccagaccggcgccttcctccaccgattcgcctggctcgatgacgacgagatcggcgagatccccttcgcctggaacttcctcgtcggccacaacaaggtcgaccccgccgacccgtccacgcagcccaaggccatccactacacctccggcgggccgtggttcgagaggtacaggaactgcgacttcgccgagctctggatcaaggaggccgacgagctcaaggccgacaaggagaagcagaagcagcagcagatcgtcatggccaacggcgagaaggagaaagacgaggaggggaattgaatcgaatccaattgaattcattgtgccgcattgcgttgcaattttgcatcgaattggttcaaatctgttgtttattgggttggggttgggtggtaggctatgagtggatagctctagtattggtagtagtacgcttttgtgtagcggcaaatcaatctatctatgagtcctcaa

SEQ ID NO: 93460 - DNA, 1327 bp, Oryza sativa
gctaatgacggcttaattaggctcaaaagattcgtctcgtggtttccaggcgagttatgaaattatttttttcattagtgtccgaaaacccattccgacatccggtcaaacgtataacgtgacacccaaaaattttctttccacgcactaaacatggcctcatttgggtaggtgaacgaaagaatttttcctagaaaaaactagtactattttcccacattgtagagaggatggacaagacacgtgcactggctgcacaaacgggtagaggtaacaagatatcaaaattttttcacaacactatctagacttcatatatttttaattttggaaaaagtacgaattacctctcgaactattgtggtagtacgatttacccccttaaactacaatactggacatttgacaccccaaacaattaaaactggataaattacccccctaactcgattcgtagtggttttcagtctacatggcacacacatggcgatacagtcagcaaaaatacaaataaaaataggtaggcccacctgtcagcgattttttttctctccttctcccccctctctctctctctctcccccccctctctctctctctcggccaacagaggctgcggctggcgggcggcgggcgggtgaggagccggcgccgacggaggccaccgccggggatggctgcgggtggcgggcggtcgaggagccaacgccgactggcgggtcggcggcggggatgcctgtggccggcgggcgggcgaggagcggagtgtgtgcgcgaacgggcgctgccgcagctcccccgtcggcgactctgtgactgcgaaggcgaacgcgttgctggcaactgcaacggcgaaggcgaaggcggcgacaagatcgaaccgcgagctccggaaggccagcgacggtggcacgagtgcgtgcagggcagcgatttcgcggtggccgaagaagggaggtggacgagtgctcgtgggggaggcgtggaggcgctccaggcgaccggcggccagcggcggaggcgcccgggcggctggtgacggaggcgaaggcggacctggcggccggtggcggaggagaaggtggacctggcgggcggcggcggaggcgcccaggcagccggttgcggaggcggagctcgctcggcggccggttgcggaggcggaggcggagcgtgcgtccgatgacggaagaggagggggagcgagcggccgatgaggcacgactgagacgttcgcacggctgcctcctcgtccattcttcctcaccgccacgacggctactgctcccagtagcagagagcgctccgcgcgaagggggctgcagga

SEQ ID NO: 93461 - DNA, 1533 bp, Oryza sativa
tcctgcagcccagttcaaaccagggtatataggatcgacaagctccagatggtggatactgatgaaaggagcaattggatgagcagccaatataccatgggcattgcctctgatatcccactgattacaatgcaaagggacaaaagtaagattaagagagtagagtttagttctccatacacacgattaataaaaaaaagtaaatatgacttgttaatgtgcaaacagaaaaaagaacttgctaatcacttattatcatattttcaaacacatgcagcatgctggtacctatttgacagaaattacaatagtactataaagcaagcaggcaagttcttgcaaaaacttctgctggccataaaagagcccaaagaaaggtaacattcaagtactaccaaacttcctttcactatcaatctaacataaccactctggcaagaccctactactattgttcatgtattctgattgaacatataacagccagctaggttggcacaacagcagacaggctacacttcctttctgccataatgaatcaagcatcacagaaatggtaaggttccaaagagtggatcaatatgcatgcctcccaagatctaacgcaaattctaaattgggctagttcattagcaatcccccgaatttccgtgagcatagacagcatgctatttcgcactaaattcatgcatgggatcaggagagagtggatagtccctgaattcaagtcactgtgtcactggtaactagtctatcagcagatcgtacaaagcagaacagaataagtgctccaattgctgaggcgaataacatttcataagaccactcaataatctaagcgctgttaatacccaacccacatttctgttgaatggccacaaaatgttgaaaaataagctcatacctgatggaatccgtactcgcgggagaggggcactccgagctcggtgatgcaagcatggaggcgatcgtcacttccgtacagcttggggtacctctcgatgcagacgtcgagcgtccgcgcgagcgccgtggcgagggggaggctgagcgcgacgccgccgcccccgaacgccatactgtggctgaagtaggtgttcgccgagtggctctccgacggcgcgccgacgtacaccatctccctccagtcgtacttcccgagcacggccaccaggttgtccgcggacaccacggtgtcgtcgtccacgagcaccacccaccgcgcgcccccgccgccgccgcccacgagccgcacggcctcggcggcgatgcgcgcgatccggaggcccgaggggtggcccgtggggttcgtgtaccggaaccgcgacgtgtcctccgacacccggatcggcgggaggagggacccctccccggacgcgctcggccccggcgccgcgggcgccccggcgtcgagccacacgtgcccgcgcatggcggccgggtcccaccacatccggacgtactcccggcggcgcggccagaggtgcgcggagcccgcgatcccgaacacgatgtggccgagcgactgcgggg

SEQ ID NO: 93462 - DNA, 3415 bp, Oryza sativa
gtggtgcagggacaaatttaagactcggcgacaaattaagggacttcaagtgaacttattcctttagttagatggcagtatgggacgtgaaggtaagatgagtggcccaacagtaagtctgaagaataagatgggctcacttatgttgcacatcataaaagcccaaattccctaaattatgattttccaaagattggccgagctgtggatgtgcagatgcagaacacacccaggtcgatgaactcgcgtcagcgatggaggccgacaggtggggtcaccgtacacgctagtgtaccgcggccataccgggttaattggatccatgttattattttacagttttgaagttgttattcaaaatatgccactctttacccttttactatatttctctaaaatttttggaccatattacccttttcattctcctcatccacttttcatctctagttcatttctcaagattgaggcggccaacctgatgaaattaacgaagcgagccttggcgatggcacggatgacgagtccccatcatctcacggaccgagggccggtctcccctcgatcccctttctgctgctaccgtacctctcccttctcccgcaagctcctcggcgcactatggcgtatggcggagtggatcatgaaggcgcaagccgacaagctcataccattgcccttgcttctcccggtgccaacaagtggtagatcagggactcggaccgacgagttccatgtagtgaaaacggtgcagagtagtgcgacaagctccacgatgggagggccctcttctcttcccatcccctccctcactggccacaccattctcccatcctcccatttgtcgcgtccaaccgcgagctctgacacctatcccacttcaccttcctccttcctaggtagcggcaagagcacatcctaacccatatcgcgggagagctcaaaggtgagtgccttcttggggtttgggactgtgagttgggaagctcctcgtgcaggtgagggttgtgggcttcgaggtgtgaacatgcaaataggtcaatgagcagggtcaaccaacgagggaaaacaacgctgccctattcccaccacatactgcttagagctaccattcaacgacatcagctccgtcagatctagcggtggagaagatgaatatgaaagagagtagaggatgaaggaagaatatgagggtaatatgatctaaaaattagcgtatttttaataaaggtgaaattataatgacatgaatcgaaataaccactcaaaaacagtacagagtactaaacagtaagaatgttttttttccccaaaccacaaaaattataataacaaaaccacaaaaattataataacacgaatctacccaaataaaaaagctgtcggaaattcccatcgtgcggccgcgggggtcgtgccgataaaatccaaagagaaagcaggcgtccgcccccttttcctttcctgcgtctcttcgtggaagacacgctacgtgccataattagcacgcaggaaatggcacgattagcagctaatccccacagtctaatcggggattaaaagcaaaccaaagcagctccccccactataccttcgtcctcctcgtcgtcgttgccttgctgtctctctccgttaattaataaatttcccccctcctcttccttccttcctccaccggctacgcgctccgtctctctctctctctctccgtttgcttcgaccaagctagggtttcgccgccgaatcgagctcggtggcgcggggattttgcggtggggcggagcgcccgcggcggtggggaggcttcgggtggcctcggcctccgtccggctcgatccgatcggtgagtgccctcctcctcctcctcggcgtgcctgctctggaaggcgcgcgaattcggtttgggcggcggcgtttcgcccagggctgtggtgcgagtcctgtgggctgtggctgtgggatgcttttgccttctgatttctgtggttaggtagacgcagtttttctgtgccaaggttgtacctaacatgatgttctcttcggttgcttattagtcttttccttggccactatccattggttgcagatccttaagagtcatttctgaactggtttcttcattcccgtcctggacgggtgatgaatccagttgatacgcctcatgtgcttcatgtactatagtttttattgttgttttttcattgggcaatgcagcagatagctttccttgagcaatatttgttcctaacccacaagatttaggaacatttagtgtccatcacttgtgttttttcacaaaccaaggatcatgtagatgctataggtgtagttgtttcataatcggaataactcatgtatatctgtacaattttgtatagaatggaagttaatttccctaatgattgatggaagttacaccgacatctgtagttcaccttcagacatcttactgtaactctataagagtaaggtttgcaccattgagtaagtttactataagacagattcatatgctgtatgaaaagtaacaacatgagatgtccctttgattcctttgttcattgagtataaaacatatagttgagtttgctatgaatgcccacttcatgaaatcgtaaattctattgttcactgtgggatctcttaaaatgataagtaatgcctactactctttatttgtatggacctatgatgcgtatatttataaataaattctataaaggttgtcaaaaaaatgtttaatgagtaaaatgcatggagggtcacccaacttgtttaggtgtcatattggttactctacttagaaaatgcacatttaagtcactaatgtgagttaagtgagtcatttacccatctaactatccacatgagcataccttgtacacatggcatgccacataggattaaaaaattgcatctagaaatgtgtagaaaactctttgtgtattttttcctttgtcagagcactactaattggcaatacacggaattagtgaaactaaattatttcatgtgcctattttgacgagttcaagttctcagttgccatcaaaccctagcagcttttattttcactatgtttttgttccactcaattacattgctaggtctgcacgttttcagaagtaattttgtcagtgatagatggcatgtcatgtgtaaggtatgcttacatggatagttagatgaaaacatgactcatttaactcacattagtgacctaaatgtgcattttggaagtagtgacctatatgacacacctaaacatgttgaatgaccatgcgttttactcatgttattatcacctaatggcatgcatatgtatatgcattaagtttctgtcatcacctttgacaggccaacaacggaacctttcattttaaaatagtttttgttggttacaaagtggcactat

SEQ ID NO: 93463 - DNA, 1003 bp, Oryza sativa
acacgtgatcaaggggtagctcagctaatgggaacaactaaagcccatcaattggtaagaatggaaaaagaggatttgcttgcaatttttgaaaaaagagcaatccgttttgatgagcagaaacctgatgagctggttcaaattggctgggagattatggacagatgtcacgggtcccctttagatgcaaaagccttgggttcaatgttaagcacacggaaagctgtagaagaatggagggccgtattaaccaaaagtagcatctgtgatgacgagaatggaattttacctatactgaagctcagctatgatgatctgccatcatacatgaagcaatgttttgctttttgtgcgatctttcccaaaaactatgtgattgatgtggaaatgctgatattgctctggatggcgaatgattttatcccatctgaagaagcaattcgcccagaaacaaaaggcaagcagattttcaatgagcttgcttcaaggtcattctttcaggatgtcaaggaggtacctttacacaaggatgaagtggacatagttaccgaactatatgtagcatccatgatctcatgcatgatgttgctgtttctgttattggaaaagaatgttttactatagctgagggtcacaattacattgagtttttgccaaatactgttcgtcatttgttcttgtgctctgatcgtccagaaaccctttcagatgtttcactaaagcagagatgtcaaggtatgcaaacacttttgtgcattatgaatactagcaattcttcgttacattatttatcaaaatgccattctcttcgagcattacgcctctattaccataacttgggtggacttcagataagagtgaagcacttgaagcacctcaggtttcttgatctctctggcaattgtcatatcaagtcacttcctgaagaaatatgcattttgtataatctacaaacattaaatcttccgggttgtatatctcttggtcaccttcctaaggatat

SEQ ID NO: 93464 - DNA, 1898 bp, Oryza sativa
actgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacataattacggcacgtactttctcctcactattgttccctccttgtgatcggtgcgtgagtaaggggtgtcttcatttgataggaggatgctagggtcaatcgtcaccgtgaaagggggttgcccatccaactgatcggtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgttgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttccctctggacgagcacggttacgaacatacttcttcagaacgcccatgtacctctcgaaaggaaacatgttgtgtagctacatagg

SEQ ID NO: 93465 - DNA, 1419 bp, Oryza sativa
tgtcactaaccctattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccaccagcagctatttcctcctcgcccgtttgatttccttcaaatccaacatactgagcaaagtccggaatattgtcgtcttccacttcatcttcttccatttcaacaccatgctctccgtgggatgtccaacaattatagcttggcatgaaccctgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgctggtcagcatacatccattgccgatccatctacatgagtcaaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgaaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagccccaaccggggctaaagatcaccgggatctttagccattaccaaccgggactaaagttaccaaccgggactaaagatcccgggggggcttgacaggccctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgagtggcacaaaatgaaac

SEQ ID NO: 93466 - DNA, 2557 bp, Oryza sativa
cggcgggaggaagaggatcacgggtgggccccacccgtcagcgagggtggcgggcgggcccacccgtcagcggcgcgcgcgcggggagaggccgagtgggccacggggacaggagagagagagagggggggagaggagagatgggccgggccggcccaagggagggaagggggacttttagggtttttctttttataaaatcattttaactttgtttatttcttaataattattatttgtgctctgaaaattccactaaaatttatttacgcattttaggcttttaggaaatttgcaaaaatcctccaagccttatttgacttttaactttgcacattttaattgttggaggctttcacacggattttaattattctaggcatcatttaagggatatattttagagtcgttttgggacgtgacagccagttcggtctgaatcatcgtaggccttgggttaaggcaggttcgtgtgggttcacggccttgattaataatattgtatagctctaggatcgtatttacaaaatagctttgagcaactaggtgtcttttaatgctgtttactacaaaccctaactcttatattataacccccttgtactcccttgcatttattcggcacttgtgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctgtttccggtttgtctttgtgtgtgctgggccttcgcctcccatgtaataaattaactatttatgcttccgcttgataaactctgaaatgtatcaacttttggtgtaccttgcctcctgggataaggaataatacacgcacgtaaggaatacccgttgggttatttccggtcgtgacacaaatcatattctatcaaagcatatgcccacttgccaattctcccacttagaattggcctttgcaacatgtgtttaataacatcggcttgacaagcaactatgcatgtactagataacaaataatgcctcaatttggtacaagcatagtataagcatagacaaagtctctctataaagacatacctcgtttcggcatccaaaagacggcggctcaaatatataatgatatactcctttcctcttgcgtcaaaacggcacaaatgactttgtcttcggaggcaatatataaccgaaaaggctttccggctttaggcgctcgcacaacgggtggagtagacaaatatctcttcaactcttcaaacgcctcttgttgttttgccccccaagtaaaatcggcttcttttttcaagcaaagtataggaacaaaatcatcgattttacctgctaggttagaaataaatctcctcaaataattcaccttatctaacaacttttgaacttccttcttgcatgtcggtgcttcgaaatcacgaatcttttctatctttttaggatcaatctcaaatcctctctcatgcaccatgaatcctaagaacttccccgctgacacaccaaaagcacatttaagtgggttcatcttcaaaccatactggcgcatcctctcaaaagctaacctcaaatcggctatgtgtccttccataccatctgatttgacaacaatatcatcaatatagatctctaagataatacctagcaaatcatgaaagatttaattcattgccctttgatatgttgcaccggcgttcttcaacccaaaagtcatgacaacccactcaaacaaaccaacaaatcccgggcatctaaaagccgtcttgtacatatcctcttccgccataaagatttgattgtagccagcattaccatctagaaagctaatcaccttatgacccgaggcatcattaatcatcatgtcggctataggcataggatacttatctttgggagtggctttatttaaatctctaaaatctatgcaaactctaatcttaccgctccctttcttctccaccgggactatgctagagacccactccacataacgatatggcctaataaaccccgccttcaacaaccgatcaatctcctctttgactcggtcatataacaaaggattaaaatgaagaggtggttgcttataaggcctaaaacccggtttaattggaagccgatgctcaacgagctcgcggctaagacccggcatctcatggtactcccatgcaaagcaatcaacatactctttaagtagctcgattatcttaaccttataatcggctctcatatttttgtttacaaaagtcggccttggtttagttccatcacctatatctacttcttccaaaggatcggccgatgtaaacccttttccaagcttctctacctcatcaaaatctttaacggtttcaccaatatcgttctttgtagactgatattcttgcaccctcttttgtaaccactctaaattagcctctttactcattatacaaatttatatggcttagccgtgctacactagccggctttacagagataggtacaaatttgc

SEQ ID NO: 93467 - DNA, 3954 bp, Oryza sativa
ccaaaacggcggcggaagaacaacgaacgacgacggcgacgaggaggaaacggcggaaaccttcgggttgtcgacggcgacgaagctccggcgatctccggcgacggcgaagggacggacgaggacggcgacgacttggcgagcacgacggaggtcttcccgagcgacggcgacggctgaaacgacggcggcgcacggctggagcggcggcggcgacggcaaagctagggcacacggcgctagggtttttccgacgacgagaggcgaaggcgaaggtggcaacgggtagaggagacaccgagggtccttttaaaggggctcggaggcggcggcaaaggcccacggcggccggcgacgaggaaggaaagatcgggaagaacgaatccgagacaaactcgaatccgacgctttccaaaacgatttagctaaagattccaaaggagaaaggtagaggagatcccgaggatcatttcccctctatcaattcggccggagaaggaaaggagcggccggatttggaaaggaacggcggcggcgcgaaactagggtttcgggcggcggcggccggaggtagacgatggccctgacaggtgggacccacctgtcagcgggcggacgcgcgtgcgcgcggcggcggactgggccgaactgggccgaagagagagagaaaggttttgggccgactttcggcccaaagccaaaagagactttttaaaacctttttcaatttaaattatttctttaatgcaattccatttattaaaaatactttcttagctcaaataaatcccagaaaaatctaggaattatagaattaagcaaagtatttaatgaaattttatctggcccctttttatattggaatttattaattaaaactagatcttctcttcaagacttttaaaattatttctaaaaattccatttaaacaacaatttataaattttaaattttcagggtgtgacaaacctaccccccttaaacagaatctcgtcctcgagattcggaagaactggcgaacagatgcggatgagctgacttcaattcatcttctcgttcccaagttgattcttcttctgagtgattactccattgaactttgcagaaacggataactcgattcctggttcttctctcatttgtttccaggatacggattggtttctcaacataagtcaaatcctcttggacttctatctgctcaatattagcttcttcggtaggtacccttaaacatttttttaattgtgacacatggaacacattatggactcctgccaaagattgaggtaattctaactaataagcaacctctcctcttctactgacaatcttataaggtcccacaaaacacggtgccaattttcctttggtgtgaaaacgatgaactcctcgaagaggcgtgacacgaagatacacatagtctccttcttcaaaactcaaatctctacggcgattgtcggcataactcttatgtcgagactgagccactcgcaatctttcttgaatgacctttaccttttcttctgcttccctcaggatatccgtcccgaaaacctgacgttctcccgtttgatcccacaaaagcggagtgcggcacttccgaccatacagtgcttcgtaaggagccatctgtaaactagcttgataactgttgttgtatgaaaattctgcataaggtagattcttatcccaacttccaccgaaatctaaagcacaagctctcaacatgtcttccaaaatctgattcaccctttcggtttgtccgtctgtctgtggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgccaagcgacttccggaataggttgtctttaccggaataaaatgagccactttggtaagtctgtcgactatcacccaaatagagtcatggcctgatgacgttctgggtaaaccagtaataaaatccatacctatttcttcccatttccattcaggaatcttcaaaggctgcaacaaaccggcgggtttctgatgttctgccttgactcgctgacaaacatcacatactgctacatattccgcgatttcacgcttcatacttgcccaccaaaatctttccttgagatcctggtacatcttagtactaccagggtgaatggagtataaagtatcatgagcttctttcagaactgcatcttttagatctttgttgtcggggacacagattctctcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcaaaacacaacctaacccaagtttggatgcatcgcaatacacttgaaaacccttctttggatcaggcaaaatcaaaataggagctgatattaagcgacttttcaactcttgaaaactctgctcacattcttccgacaacttgtacttcacatctttctgaagcagtcgtgtcatgggcttagcaatcttggaaaaattctctataaaccaccgataatatcctgcgaggcctaggaaactgcgaatctctgaaactgtctttggttgcttccaattggttacggattccacgttactaggatcgacggcaactcctccggctgagatgacgtgaccaaggaatttcacttcagacaaccaaaattcacacttgctaaacttagcatagagttgatgttctcgtagcttctccaatgcaaggcgaagatgttcttcatgctcttctttggttcgagagtagataagaatatcatcaataaagaccaccacgaacttgtctaggtattccataaacaccttattcatcaaattcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctggcaactcattggctgccattcgataaggtctcttatggatcggagttgttccaggtaccaaatctattctgaactctatatcccttttaggcggcataccaggtaaatcatctgggaacacatcaagatactcccggactataagaatctcttccaaagatatctggttcagtcttgaccttaaagactcagatgacaatg

SEQ ID NO: 93468 - DNA, 617 bp, Oryza sativa
aaagaaaccacttacttacctttcaaatctgatgtgcaaagaaaaaggaaagagatcgaggaactacatggacaatatcagagtatataactccatgtttgcatttacctccatgggaggaaaagttgacagagagataaacaatgggtctggaccatatgttttccgcatgaatggccagaactaccaccgaataggtactctactgcctgaagaaggcgataaacctcgctgggcgcaactttacatctatgacactgagaacgaagtcaaaaacagaattgacgcatcaacatcatcccataatagagaatcaatagattcacacattgtcttaggcctaaagaacatgctggacagagaaaacgtactagcacagacattcagaatagcaagagatagattcaaagaaggtgactatcataatgtaagcctacgacttataaggaagcgtggtggagatggcaggcagcataacatgccatcggcatcggaagtggcagcactgattgttaatgacacgagtgagaaccaaaaaggacgtgacataattgttcattataaagacacagggcccagaagaatatcagaaaaccatccaaaattgggctgcagga

SEQ ID NO: 93469 - DNA, 2177 bp, Oryza sativa
aatttgcttataccaatacagttgagaagatccagtattaccaaaaactgcagctcacctatttgatctgggagagaaatattacttgctctaatccgtaggtacctcaactgaaataacttcccaatatcctcaagataactgctttccaaattgttatttccatctagatccagcattctcaaggctgggaaattagaaagaggaggcatttgttcactgtatctaaatatattcaaggatcgaacatgagtagtaaccatggaatataatgtcacatcttcttgaccatagttgtaaaatgagagtcggtgaactttgtcttttgagaccaacatttgttttctgtcagtaacgatagtaacaaaattttcttcagttgcttttgatataatgagatcaagtatcatatcatgcaccttacatgaataaactctaccatcgtactgggtatgtactggttggatcatgcttctgtttataagttcattaaaatagcattcaccttcttcctcaaaagttcttccaccattagccttgatgaatccttctgctacccaccttcttaccagatagtccctgttgatcacataatcctctggaaacatacttagatacaataaacaagtccttaaatgatgaggaagatcataataactcagagataatatcatgttcatctcctccacatcagaatttttctcaattcctgaaccaattgaatcccgcaccttgaaccactctgctcttacatatgatttagtagtcaacaaactagccatagaaattattgccaatggtaaaccaccacatttcctcacaatttcaactgcaatatctttcaattgatgagggcatttatcttcagaaccaaaaattcttctgaaaaataaccttttagagtcatcttcgctcagcactcttagttcatatacaagattaaggcaaggggaggaacatgactttgcaacagtacctattcttgttgtcactaatattctactgccacaattattctcaagcaacgaatatctaatggtcttccatgcttgggcactccatatgtcatctatcacaataaaatacctaagaaacaaaataaagttataattcaatggtgaggtttttgcaagaaagcctatagattaatatatgcatagtattatatgaaatgtgtgacaaattttgtttagaaatgcaaaattctttttttttgttttaatttgtttcctatcaagatagaagttctcaattacaggaaagtctttgtgattggtacatgggtggataccgcttttcatgttgtaaattataacagatagtctattagctggtggtgtcaaatacagataatgataaaagttactagtgtatttgaagctagagcggataaatttatcatattggaatacctcttgttcttcaggaaagccctcagttcattgatgacctgctccttatcccctgatctgattgtaccaacctcatcattgacttggtagagtatggtttcaaagatcattcccatgacaggatgctgcgaaagtgacacaaaagctttgcaatcaaattggttcccgattttttggtacacctgattagcaagagtgctcttgcctaatcctcctgaacccacaattgaaactaccttcatcctctgctccccatcatccaatgacttaatgatctcatccctcggaccgtcaataccaacgagagcatccaactccgcatacagcgcaggcaaccgacgatcaattggcacaacatgattacttttacagttaactgctgaatcaagcttgtaccgctttcgccgctgtcctgcctcgacaatccgagccttgagctcctgaatctgctcggcaatctcatgccgaccgacaaggtccttcaccttctgcacatagccactgaagaaccccatgatgccattgccaccgggcctctgcggccgcccatggcggagctggcgcgtgtactcgtcgatgcagtcctcgatgtcatagctcatctccctcacctggctcctccactccttcgtctgcggatcgagcgtcgcctccgtgtcggccagcccctcgaggagcgcgttcatgctgctcaactcatctttcaggaaggcgatctcgcgcttcatccccttgtgcatctggtagtcctcctccaccaacgcg

SEQ ID NO: 93470 - DNA, 620 bp, Oryza sativa
cacggttgcatcatgtggtatagcagccttacttcttcatggggggagaacagctcactcaagattccacatcccactaattgttacagaagagtcaacatgtgacatcaaacaaggatcgcacctggcggaactacttaaaaaaacatcactcatactgtgggacgaggctccaatggcaaacagaattgcttcgaggcgctagacagaagtctaagggacatactaaggtccaagggtgaagataacagcacaaagccattcggcggtatgactgtggttctaggaggagacttccgccagattcttcctgttgtgcgaaagggaagacgcacgcaaatagtaaatgcatcaataaaacggtcctacctatggcagcacttccacatcttcaaacttacaaggaacatgcgcctgagctgcatctcaagagatgaagacgagcaaaaaaggactgcagatttcgcacaatggattgtgaacattggtgatggcaaaacaacatcagcggatggagaggaatggatagaaatacctgatgacctgatactgaagaaaggaggtgatccaaaggaagaaattgtgaagagcatatatccaaacttggtacagaattataa

SEQ ID NO: 93471 - DNA, 955 bp, Oryza sativa
agctgcagtcccacctgggaaaaaaaagaaaaaaaaacataaggatatttttgcaaagagaaatgcagtacacaaattggacttgatttgttgaatgttgaaagaaaagaaaatatactcataacgggtggtatccatgctcatcacaagttgaaataagcctcacaggatgcctcaacaacaccaacagccttcatggctctgctacagcttcttgcctgccaaaattacacaaagcatcaagcaacaaaagaatgtagccaaatattcaaactacctgttcatacctataattatgaacaacttacaaggtaatcaacatcttggagttcctcaaaaatgcggaggcctgaagccatatttaaattaacaacacattaaattatcaaatgagaatcccaattacataagagaaacagggtaaatgacataatataagtacttgccattttggcatctgacaaggcgcaatgtcttctagagaaaacatgatcaggacttccctgatttgatattcccaaatcattttcacgggtccaatcatataacgattctggaggacctacaaatgacaacaatagaacaatttcccagtttgaactttgaactagaaaaaaaaatgatgcaaggaagaagacaagtcatgcacaacaccatctcacagaccatttccaatcgtcgttcttcgcattaatgatcgttgattgtcctcttcttcttcctcctcttcatggctgtacctgacagaacataataaggggacatgtcagtttgataaaaaaataataatcacaacaggctatacttgaacaaatgaaacaaagttacacataagcatcagtcgatgtgactaatatgtataacaaacctgaaaacttcaaatatattttttataatggagctacaaaaagctcaaatgtttgatgtctagcaaaacaattaaggcagtttatat

SEQ ID NO: 93472 - DNA, 626 bp, Oryza sativa
cagaaacatcaatctgatctgaatcctcctcatccagcactacagttaatgaagactatatcatatgcaaactagactcctatcatgtctaaaagtctcgaggaaaatggaatcacaatgtacctggcagtttaacaggtgcatcatggccatgagttgatgtctgcacagtatacataatcttacttagaatttaaggtgtgagtaaattggaaacactatgagtaattcatcaacctcttgctcagattcaggtatttgatcttcatcttcatcagattcctcatcaagcattgtagattgtctactttggtccatttgaaggccggtttgcatagtattatcttgtgttgttctccctttcttagaagaaacaggcggagccatattggccataacaggaatcctaggaagtattagattttcatcactttgtgaaaaccattccctgagccctgtcagtaggaaaaagaaggtgcatcgcaactttgtaagtaatagagggactgtaatttttgtaagtaatagagcacagcacaaccaccaactcatgtaatatcaaccttagtcaacttaaaggaaaattctacgatttgacactgacaagcgctcgattcaacaaaatg

SEQ ID NO: 93473 - DNA, 3441 bp, Oryza sativa
ttgtttatgactcatccatcatataaaactagcctactcgcagttagaaataaccagcaagaaaccgaaattttcgacactttttcatgtatcacgaattatagcaatcaaggaacatatacgatttgtgtatgctctgcatcggatttattggaaatgcctccatacctcactacggatgaaaatcatcaacaagaagggggcaagaatatattgattcattttttgggggaaaaagcatagcatttgtttcaagttgctaccttcaccagaaactggaaatatcttcaaattcaaaacctcttagtgctatcgatgaaaggaaactaaatactcgtgttgatgcagaaaatgtatatcaagtgttacgaggccaaaattatgggggctggtatctttcttaggcatacctttagtgcgagttcttcaaaacacttctcaacattatctcgtgttttcgcgctactctcaagaaataggcatccagattcttctgcaaaggcaagcccttcttctcttgtgacagttctttcatcctcctgaaagatagaaccatcaaaatcaactatgctcccatgagatgttcaacagtattttatgaaatcgatggaacttaagggctgaaaagggcatactataatgaacttgaatcaatgaaataaaagctaaaactcaggaacagccaggatcactttttttttcaaagaaataactactttggccaaatagtaccttgtcaattttgtttccaacaagcatttttatgcactctttgtttgatgagtgtgactctatttccttactccatacttcagccagatttgtgaagctttctctcttcgtgacgtcatatactaggagtaaacaaaatcacgtcagttgttcatctagtgtgaagcatgaaaacgggagcacacatgacctgatagcccggttctcaggttaattatcataaaacaatttctgcatagtcaacctaggcacaaactattcaaagcaccattaataaaaaaataaataccgcggtgaattatacatgtaatgtataactttcggtggttcaaagagtcgcacagatggtcaaggtagaagaaatagttggtgcatcataaagacgtctcaagatgaaacagacattgatatgtcacaacacttggaagtttaagtgaggatcacactattaggctggacaagtctgcaagatatgatcttaagaattacagcagtgcagaacaacatgtttataatttgagcaatcgatcctacctaacaaaattgttatttacctagaataatgccttgagcacctctgtagtaagaactagtaattgtcctaaacctctcctggccagctgcaacacaacataatagtgctgtcagaatatttgagatattggaaatactgtaaagtaatccattttccattcaacaatagcatggttcattttgtttatagacaactcataaatttccagcaacaatgcagttgtaaggaaggactgggtaagatggttaatactgagacatctagagcaagtaacgtaatgggctacaaatctggaatattggaatctctgatggtagatggtagggagggaagggggtaccagggaggatgaaccaaaatattttaggcacaaaccggacaggtggggctataaatctgtgaatcaggagtcagaacctccaatagcaatgatgtaagcacagggcaggtgcaacatggagggacaacaccaaatatattaggtgcaaagcaatcacaaaaacaagttctaattctaatgacagcagaaaaggatggaaagtcaaaattagtggaaagcaaagtatgttactgcaaagaagtgaactgaggcttaaaaactgagtataggttgctcaatcattctaggcatgttcctcacttattgatgttcttggattgtctttagttggtgtttgcaatagcttgtactagtagatctcaagatgcccaatcatcatcagatctgtacaggaaattcaactacttcctctgaatcaaataactattgcgtgcataaccagttactgaggccctcttttattgctagaagaaagaccgtgtgctaaagtttctaaacatggagaacaacatctagtaggatatacggaataagtgcccgtaaaccatatcatgaactctgtttcactcataaccttaatatactccaagcaaacatttgctagcccctcaaaataatcatgtactaagagcaattccatcattccacatgtgacagatcatcaactatacttagtattgcatgataattgtttgcactttacactactaaagcgcagaaaggctttccaaacattgtatattcacatctgaagctaaatatcatcgaaaagcaggccatttctatacaacccaagttatgaactcaccagtatcccatattgtcagcttcaatttctttccaccaatcgtaaggaacttgatcttaaaatccactcctgccaaccagtgtggaacaaaaatcatgaaacaagtgaaacgacaaccatgaccatacactagaagaagtgaactagaaattctgcattggtcaaatttattaaccacacataagaccgatcatgaagggctatggggtaaggctacactgaccgaaatttcccaaccaacaagaagaaagctggggccttgttcagtataggagcaaaggaagaaaacagctaggacaagaaaaaaggacaaggttcgtccaccaaatcccaatgtccttaaccctctacctaccactgatccattatcctcgtccaactgaaccagaaaatgaaaagggagaacatcccacatttaggatcgcccacattcagtttggtcgctgtattgattgagctacacaataactactagtagtagtagctagcactagtactaaaacgaccaaagtaccctacctgattggagtacaaaatctgaagttctgaaccaacatttgagctgcatttcaggcgtatttccaaggaaagaactaatcaagatcgtagccaagctgggatttatatttatttatttatttttgggcggcgcaccgacagatgggtagaatcgtcgcggaattatactaggatgaacagctagtgtacgttgtggtggtaagctacgacggcgatcggtgggctgcatctgtccgggagtgatgtgggggggcacgtacgtacgtaccgatggtgggagcgatgtcgtcgtcgaggtgggcggcggcggcggcgacgacgaagctgacgaggaggctgctcttgccgacgccggagtccccgatgagcaggatcttgaagctgcactcatgcccacctccaccgccgccgctgctccccgcccccggcgaccccatagccaccacctcagattcgctccctccctcccgcccctcgtcaagagggggacccaacctggaccggcgg

SEQ ID NO: 93474 - DNA, 9933 bp, Oryza sativa
  unsure (1)..(9933): unsure at all n locations
ggtggcggcaaccactccccatcttccttctccgccacctccatcgacgagccaccgtcgtcgggctcgggcggcctgtgaccgtaggccgagctgcggctccgcttggaccgcgcgcggcgcccggcgagcacgaagtccgcggggcggggatcgggctccaccggctccggcgcgtccccgggcgacgcggccaagacggccacggagccgatggggcactccgtccacccgatggcgtccacgtcggcgctcaccacgtcggcggcgatgacggcgtcggacggcgggccctccgccgcgcggtgcagcgtggagcgccgcggcggctgcaggtccacctgccccaccagccgacgcatgatgtcgccctgctcgcaactccgcctcgtcacacataacgctcgcaacaacgagagagaaaaaaaaagaagaagaagaccgaaacgtatcgagaaggcaaccaaccaaccttgttggagcggtggagcttgacgaagccgtgcatggagatgatctgtgtgccgcccgcccaccgaagtacgtgacatgcatgccgccaacacagaaagatcaagcacaacgaaatcagaagcagcaatctagactaaaaagaacacaacacaagcagacgacggcgtgcgggcgtgcgggcgtgcgggcgtacgtacgtggttgaggtggtcgatggtgaggcgggtgccccatgggtcgacgaagaaacggtggtacctctccagcgtcaggggccctccctgcatctccctccctcgccccctcggcaccatggtaggttcttcctccctcctctgtttctctcctctcctctcctcttctcttccccgacgcaactctgctttcacctctaggagtctcctcctcttgtttctttccgctacctctgctctgctctgctcagcgctgcacaagggaacctggggagcaaaagcttggttgttggtgggtggtggggcccacctgcaggctttcgcacaggagaggaggattggatacattttactcttgaccgggcctgaacaggaggagatgatggaggagccgaggtgggaagtgcgtgacgaatctcgtcagatcattcatgctgcagcagggtggttgcaccaaaagagggattatcaaagccattgctgtgtccggttcgtttcgcgtgttgctcatcagttgatcgacgagaacgataaggtgaaaatacctgcccgggcgacgcggcatgctgccttgccggcagagggctagacagagcagcttttgccttgcctttccttgccggcatgttgccattttcgttcaccaatgtggtggataggtgaacgtgaacactgctgcacacctctgcgtttcactattctttcctggtttcaatgcacccatatctttggtttcaatgcgtaccctgataaatgcaggactgcaggtgcagttccaaagattggaaaagaacgttttaccacctaccatatcatgccacaggacaagaacattgcaacccattcttggacgaaatggatgaggacgagagcattgcaaacatgattcttggaggaaatggatcgaccaatacacgtaataagtgataaccacgaaacagcaaacagctttaattgagtaagcatgttaggtttgatcctttaacacggatggattcatctaagccggtaaaatttacagaccagcggtaaagcaaaatgtaggacgtcaactgaactttaaacaccagagctaagctgagcacaacccaaaacaaacactaatgcaacttagtactggcggtgattagtactactagtaagaaccaaggagaggccatggcgtcgccgccctgcagatggaggagccccgggctccgtcaggcggtggccgccaagttctcgacggacgggagcgtgagcaactgcacgacgcgccgcttcctccccctcatggccgccttcccctggcccttcttgcaccgcttccggatcaccaccgccccggggggcgcgggcgagcaggcgctgagtatgctcggcggggagacgcgctccacggcggtggagccagggcggatggccgcgatcggcatgtgggcggcggagggcgccgcgtcgccgccgccggcgcggatggagaggagggagccgacggggcactcgcgccagccgaggtcctcgatgtcgtccctggcctcgtccatggtgagcagcgcgtccgacggcttggcggcgccgcgcggtggcgcggccgcgttgatgccgacggtggagcggcgcgggcgcatgaggtcgaacttgttgagcgcgtccacgatcaccggctgcgagacacgcgtcacgggtttttgcggaagaaccgaaccgaaatgggggcaaatagaggtggattgggggggtaccttgttctggcggtggaacttgatgaacccgtgcatgaagacgatctgcgcgacgcgaccagcagcagaggaagacgatgagtggagggagaggggggcgggacgggagtcgggagggagggaagagggtgtgggtagtacatgtacctggttgaggtggtccatggtgaggccgtggccggagcgggtggtgaagaagaggatgtagtcctcgagagtcagccgcggtcgctggtccatcggcagcttcggcatcgccgtcgccgctccctccctgtctctccacacgagcacaccaactacgctacacgccctccctccctccctccctccctcccgcgatccggcgaccgtggcacagcgcggaatcgtttataggtgaccgtggcagctttgcgaattttggggggattgggaaaccaagccgggagcgggcaccaaaaagtttccgcgcgctccagccccggcccgtcccccagaacgcaccgccccagccagctgggtctggatggcccacatgtcagtgtctcattttcctcttggacggtaatcaaagccttgcaccgaacacccaacccagagaaaaatttcatattccccgttcgaacctaatgttccagttgtatattagaaatttcatattccccgttcgaacctaatgttccagttgtatattagcggcatgcagctaggtcatacgttggatataaacaacacaaaactttacttatttcgagacggagaaattaacatttaaaaaataaatacattatcaaaatatattaacgttatatttaatgaaaataatttaatgttatagatgtcgttaagtttttcataaatttagtcaacctatgaagtttgactagaaaagaaaagttgtagtttgaaaaaaaagaggttaaaacgatttataatataaaacatattataaacggagaaaatagttgtctagaacagaaaacgggcgtgcacatggttgatggaaggacgttaaacagcgagcaaatggggcatggtcgcatagatatacaacaagcgtgcaagctcaccaggaaattgtatcattcacatcatgtaatctacatgttacagtcaatatatgtttcatcagggcagaagaacaaaaatggagagaattttggtacattgggttcccccaaggcctagcgatcccaccccgacggccgctttctctccctcgtgcgatccctcgagctgcaatccaagagaattttgaccgttggttagcatacacaacatataacaggcgtgtcataagtactaacaaaattaccagggaagcagtactatgcaagggcacgcacctttcagggtttgggttcgcattttcaacagtgttttctgcaggtctggaagcagggacaaaggagggcgcaggcagtactgcccgtgcttggtttgcgtctcctcctatggtgccaccagaaacaaaaccacggagtgccggtctcacaaaggaggaaggagcacctcttgaaggtgcgctgttgcttggtgtatttgatgaagaggcagagacaaagctgctcttaaaattttgcatcatccctgtcttcaatgaatttaatgcagcagatcttggagcaggcaccgatcctgattcagcattgtaccctatgccaaggccaaagtcaaccccacgtacaccacgcccacgaccacgggcaccgctaccgccgccacccccgcctcctccaccttttcctttgccacttttcttcccacctgatgaggataactaattgtcagaacaatctgccacaaaaaagctctatgccatctgttctgcgatgaaataaacaagatataccttttcttgaatcccggtttgctctgaatcttccatcctgcaattcatatcaccaatggatcagaaaaggaaataggttgttcatgcaatagtgactaggagaaagtttagtgatagcatgcacatgttgcaacttttcaatttaaattcactgtgttttaactaaaattgaatgcaaattactctgcatagagagacaatacaaaatgtttgtgcataagcaaaaactcaccttcattgccagatccattagttcatttggcacatcctgtcctgcagcaatcaaacaatgaaccaattcacctgcaaagcgcacctccttctgtgtaatcagagtatatgcagttccatctttatcaccagcacggccagttcttcctatccggtgaatatgcatatccatttcttttgcaatatcgaaattaacaactgttttaatnnnnnnnnnnnnnnnnnnnnnnnnnnnnnnnnnnnntgctactaggacgtgataaaccccggatttgaacttctgcaatgtctccatgcgagaagcttgatccttgtcaccatgaagtgctgcaattctgaaacctctctgatttaactggctctcaatctcatcaactctggccttcttagctgcaaatacaagaacgtctccatcatcaatcatcccaggaagtttttccagaagccaaggcatcttctcagcatcagaagggagtacatttacaacttgcttaatgtcttcattagcactgccaacctgacctactgtaactctaatagggtcagtcaaaatttctctagccaaacgttccactttgtatggcattgttgctgagaaaagcaaggtttgtcggtctggtctaatttgaccaacgatggatcttatctgaggctcaaatccaagatcgaacatgcgatcagcttcatcaagaaccaaataagttgccctaaacatcttcaatgccttcatcttaagcaagtctattaatctccctggggtagcaatgactatttcacagcctgccttcagttctttgaattgatcaaatttggaaacccccccatatacagcagcaactcgaagattgtaaggttgggcaaacttcttagcttcaaggtatatctgatgtgccaattctcttgttggagcacataccacacctattggcccttcttctttctcaagctcaggctgatccataatgtgaacaatcatggggagtacaaaagctgcagttttgccagaaccagttttagcaataccaatgatatctctgcctgaaagtacaattggtaaagcctggcactggattgtagttggtttttcataaccctgcttggcaatggcattcattagttgtacaggaaacccacaatctgcaaagcttttgattggtcttggcacatcaaaacctgaaactcgaattgccaaacttttcatataatcagccacctcttgctcactcatccctacaagagaacagtaaggtttcattcagtacatgactattcatatcacgcagaacgaaaaaaaaaggcataattgtcatgatcaatcgtgtctgtagatgttattaccatatcaaacatgaacaaatatgtgcataactcaaaatttcattgacctgctaatataggaaggtacacagaacaggaaagagacaaccaatgctcaactagctgaaaatgatggtccttcatttggacatacaactaatgtaatgtttaagctggaacagggaaagtaatatttgggcctatgactagtaaaactaaattctctagctagtattctcaaatacaataacaacagaaaaaaatccacaatccaagcgggaaatgttgttacatatggcactaaagaccggaagattctacttgagcacaaatacagagaaaaacgtcccttaggtcatgtgatgcaaatgcaataagagtttgctcatctgtcctttcatcatgagtgtatatctcaacttctatatatatacagttaggtaggccagatcaatcttgctattgagtattgacaatttgacatatgccagggctgcatttatccatttagaacactagcaagtagcttcataagcaagtctagagacagtgccaaagtaattcctgaattcctaatgttgaattaacaaacctattggaatgcattacaatagtacattgtaccattgtcaaaaggggttatggataatgatgtactgaaaaattgcttcattgcgaagtgcacggccacatgcacatagagattgcaaaaagttataagctagcgcatgccttctcaaaataacaaagtggcaacatctattataatctccagtgccaaaccataaacaacgtatcaaattatcaacatagaagaaatcccagaactacaaacagtttccaaatcctatttcatgacgatgattttcatttgacatggttcaagctggtaatttcaccattgagatttcagtatccaaatagaacagtagttggatttcctagctacaggtgagacctaattaacctttgcaccataaaagcagagacccaggttatcataattcataagctcaatgagacatgaaatatgctattatacggggcaatgtgcttcacctgaaaccgagggcttctcctcgtagaaatccttgttgaagggttcatactcgatggtggaatggtcgagcggcggaataggctcgatcttcttcttgtccaccactatggggttgtcgtcggagtcgtactccatcatgccggcgtccacggccttggccgcagcgtagacctcctcgtcggagtcgtacccggcgtgcatggcgtcggcggcgagcgcgagcccggattccttcttggcccggaggaagctctccacggggtcgtcctcgtcgtcggagtccgcgcgccggagcgcctcgggcttgggcgccggcggcggcgcgcgaatctcctcctggatctcggccatgaaggcgtcgagcgggtcgatctcctcctcatcccccgccgccccgcctccccccgcggggggcgcgtccgacggggccgccgcgtcgtcggagaaggcgatgtcgtcgaggtcggggtcgtcggcggggacgtagaggcgctggggaggctgggagcgctcgaagctgtaggaagtggggcgagggatgctgaatcccccgagcttgggccgcttcgacatggccgggcgggcggggggcggtaggtagggagaggcggaggcagcgggcgggggagcgcgcgagctagggtttgcgacgcgaggaagagggaggaagacgatggcaagcgcgcagaatttcggttgggtcgtcgactcgcggctcgcgggcgctggcgggctgggccgtggctgtggtggatctacgacggatggaaaaagtacaccaaaggtacctcaacttatcggagagagagcgctaagcgtcggacgtacggcgccagacgaaaaatcgaacgtctacttctcgtgcgaccgtgcgatgaaccatccatctcatgcagtttgcgtcagccatgcatcatacatgaattaagctagctttaaactattttttctcttaaaatatttatctaaatcatgatccgattgtaccattaaatccgttgtaattaaatctttaaaacaagaccacacattaatataatccaacgaaaaaaaattttagcttattattaaattatttttaaatattgcacgttgttgcactaagtatatcggaattgtttcactaagtagatcgaaaatgtttcatcggacgctatttcaccttatatgaaaataattttcagcgaatagtgaaaggatgtttcaattcactgtgatatttgatccatacatagtgaaatattacgagtacactatgtgaaacattttaaaaattgaaaaaaaatcgtacggtcaaatgttgcagttgatcaacaagtgaaacagaaaaatagcaactgaaatatttaaatattttatgaaacatgatgaaaatacacgtcgaaacatgccgctgtcacatatgaaacaacaagtattaacggtttgaaatatatgtttttcttttatcaaaatataatcatgcaatatcttgttgtaaagatttaattacaacgaatacaacgatgtgatcggatcatagattgaataagtaatttaagagaaaaatcattttgaagcttgctaaaatacatgtatgtatgcatgcatgaggtggagagagtagtagcaggtagtttcaggaattttatgaaacacactgaagacacgtattgaaacatatcactatcatgtatgaaacattttgttttaatggtttgaaacacatgtttttcttttgagataatataattatgtgatatcttgttgtaaagatttaattgcaacgaatacaatggtgtgatcggtttgtatatcggataagtaatttaggagaaaaaatatttaaagagaggaggaaagaatgaaaagaaacggctagacatgtatgttacagtgacaagggttcatccaatccacaggcctgatttgacgtcaacggagaaaaagaagaaattaagtaataaggagtaagctggttgtaggtgttcgatgttttctgtctgatcggatgttcgaagagaagcattttcgcagcttatcatcgagttacaaaatcgtcccccaactgcaaaactagatatatgacatctctcaacttacaaaaccgttcactttaggtcattcggtggttttgaccccggttttatcctacgtggcagctgagtcaacatgggacccacatgggacccacgtgtcaggatgtccacgttagcaccttttcgctttccctcttccttctctctcgcactcttctcgttctcgttgccatcgtggtgctgcatcttggatgcagaggatctcgccctacgcgacggcgagctgcatctgcagctgcgacgcctggttctgcaggaaggagatggcctcgacgtagccgtaaaaaaacggagcggttcattaatgcgtaattaattaagtattagctattaatgcgtaattaattaagtattagctatttttttaaacatgtatcaatatgatttttttaaacaactttcatgtagaaactttttgaaaaaaaacacatcgtttcgtagtttgaaaagcgtacgagcggaacacgaggaagaagggttgggaacacggagcaaggaacacaccctaagatttaaatgtgatgatatgttttcttctttcctcaatccttatttcgtccacgaaagaaggaatgtgcggtacataggagtattattttaaagacaaacaaatgtgataagcatataggtatagtaggctcccagtaatgattgcgttcgtttaagcattttgagtgggctaaacagtcgcacatgaaatgaaaaaagtcactgattaattaagcagtattcgctattataaaatttaaaaataaattaatttgactttttaaaaagaaaatcgtacatagaagatattttataacggaattgctaaccttctttcgacagaaattgcacctccccaaattttgcaatttttggaacatcggatgagctttgagattcgtgctccatgctctcttccaactccggcaacctcctcttcttctccggcgctggcgacaccctagactccggcagaggaccctacgggttagggtcccggggtggggtgggggtgggagggggaggggaagga

SEQ ID NO: 93475 - DNA, 4160 bp, Oryza sativa
ttaataactcttcttagcagctgtttccagaagcactcctccagcagatactgaagtccatggtacatccagatgttgacactcgtgtgggggcacaccacatgttttctgctgttattgttcaaggaccaagccgtcagaggagtgaatcagactttctatatgaaacaaaaaaatggcagtctcggactacatcagtatttgcttcagctactgctctacttgagaagttaaggagagaaaaagaaagtttaggttctgataagacaggaaacatggatgatgagaaggaaaaaagcataagtgaagaggaaaataaacatgtttgggcacgtaaaaactcggcttatttttcaaagctggttttctctttcactgatcgatatgcagcactaactagttctgcagaggtattttttctttcagtgagtttgattgtttgtcctgcttgcagtgacatggcacttctactagtaattgaagcacacatcctttgttcatttcttgctttagtgtcattgtctccgatgtttttttttttgtgtgtcggacgtagtaattgaagcacacatcctttgttcatttcttgctttagtgtcattgtctccgatgtttttttttgtgtcggatggggcatgcatgtatataatcctagagtatggtaatcgtgatatttgaataatcctctctatgtatttcccaggaggctaatattgtcatgctaactgaagatcaaaaaaatcaattgctctccgcgttttgggtacaggcaattcagacagataacactccttttaattatgaggcgattggtcactcgtacagcctcacggttatttcttctcgccttaaggtacgggttgatttgaaaatatataactattactgttattcctgcatgcagtggaagttcacatggtttgtctaagctatatttttttttgccatggaaatattttttttggtgctgcaggattcaaggaacagtaataacattcagttttttcagttgccgctgtcccttcgtagtgtttccttaacctcaaatggtaggacccacacagtgaaatttgtgattgatctcttctgaaccacaaaagtcacttgcctttatgtatgtttttccaggagtcctttccccttcttgccagcggtctatttttaccttggcaacaagcatgctagcttttgctgggaaagtctgtcacattactgaattgtttgatgtgctgaggtgctttacatcttgcaatgtaagtacctaattctaacacagatgctatcttttcacggaatcatgcatatgcatgaaagtgcttcattttggcaatagtttttatttgctgtctagttttttgctcattgcccaattatttgtgtaccaatttttgcttacttttactatttgacaaataaaaatagtttatgtccatgactgtttagtgaaaataactcatgaaatattttgcagatggatccttatctaagaattggtgaagacttgcaactctatgtaaggttgcaatctgatctaggtaactatggttctgatagcgatcaagaaatcgctagatctgtactttctgactgcaggacaaaagtggggattaatgatcagcgagtacttgatgtagttgcttgtgcactgtgtaatttaactgaggtaaaggttgattttgccttctatttgctgttgacactgcacgttgtgttcttattgaggtcacatgctgttgacagcaatggttgagtgcagttatctaatattcttggaattgctattgccagatggacaaggatgtactggtgaaggagctcacagaaatgtttacacctgaagaggtgcccttgtttgggtcaaattcagcatttgactgggccaattttcatgttcaggcattttctgatgaatccctttcttttgatgaggtatgtacattaaaactggcgtctttaatgattcatctggtggaagctcttataaaattctttgatggtgcaatgatccttgtaactgtaccttaccattatgaaaattattgttactttttgtatcttctcagttgtcttctgcattgtaggagtgttcaagaacctcttcagtagatggtgggttgcatgagtcaccaattacaaacaccggtagctcgatatcaaagactacgatgccacaatctgttcctcgtgtcttaggtgttggccagttgcttgaatcggtgagtacttatcagctgcctttgcacatggtttgctagttgctgctactcagctagctctagttgccctaatcttattaattgttaaggtggcatggaaccataacatgttgtgtttgtacccctttctgctgctgtcaaaatagtatttatcacgtggtggattcggctacaaatatattatggagcatttgaatctatgtaacattttctctactgtgaactcatatctttgtaatcaggcgttacatgtagccggccaagttgcgggagcatctgtttcgacctccccgctcccatacggcacaatgaccagtcaatgcgaagccttgggatcaggcactaggaagaagctctcaagctggcttgtcaatggccatgactctacgccagacaatcctgctccaagccttccatctgcgcagcatttcatcattcctaaagtacatgatttgtcctgtctttctcccatgtcattctggaatgttgcctattctgcatctgtgtgtatcatctggccctcacgatcgcaatcgacattcatccaggtaaattcatgcggtttcgagagcagcatccggacgactttggagccttgctcggcagtgaagctcccacccgccagccccttcgacaacttcctgaaggctgcatatcgtgcccagtagcagccatgacaagccttcgagattatgcctaaccatgtttagtagtgctaggatgtagtacctgagcatcagaactagattatcttttgaaagacttggccgatctggcttatcctttattatctgtagcactgttagttgtagtagcttgtgtatcaatgtatggctatgtctgtgtccctccagtaaatgacaatcgtatatgtactatgtagtatgaccatgtagcccactagtaaatgtttgtagggtatgtatgacaatgtatgaccatattgtttttttgagatgtaggattctatttcagactcgagtaatctgtgggggacatgttcgtcgacctccggtgctatttttccttttatcactgcaaggattagatggtttcctgcaatatttgcatgctattcgcgcggatgaaattgtgaagtcatgggtttctcaagtccacaatcattagttcacattattacggcgttcatgaatattacattttggaggatcttatttctatagtttttctatatagctctttgaatcaagaaatgtttttcatgtgatctaatcaaaaggtcatttctatgtttgcaattatctattttacatttacatttctatcaaaatcttttttttgttttttttcctatttatctgttttttttattcctgcgattcaaagtgacgcttaaaatttagggaaaattgcaaaaaccatcctataaatcacttgaaacttgacattccactttataagccattttattgcaaataccacccatctactctgtctaatcgaatcaacatgttttcatgaattatgagctgtcaatgaagcttttaccaaaattaaatatttatatagtacagtcttgacacttttgtattgagtttcgctgtattttaaaaaaaattaattaaacatgaagaataaatctgatacaaaagcacttggacaagattgactcgactagttttaacctgtggtatccctaccccagcgataatgggttgattcggttaaacacgttcgcactagaatggtttttacaaaaaaaaagaactgagtaggggtggacatttacaataaaataacttatgagatgtaatgtgaaatttcaagtgatttatagggttgtttttttttaaattccctagaatttaacgggtgtgtgtctggtggacgtccgtggtgcgcgcgcgcgcgcgagggaatgatcaaaaaccttttcggggcgtcacgtaagcccatgacccgacgtccaaaggcctaccaaca

SEQ ID NO: 93476 - DNA, 737 bp, Oryza sativa
aataacagataaacatataataaaaaacaatatttagcaagggctcacaaatagcatggtgagctaacgcagggaaattacagaccgtgagcagcatgaatgatggtggcttaaacggatagtccgatggcagctggatccttccatggtagattcctccctcaaactcactgtctcgtggccccaggatcgcaaattgccactcgaagatgtcctcctacacaaatacatacatttaaatcataaaaaacacatcagcctcgatcagaataccataagtaaatttgtaatccgaaaatatatcatggaaacggcctaagtaatactggaatcccacttgattcacacaccagttaatcgaaatgacgtaatactacccaatatcaagagtcatcctgcatacgatgatctaatcgcaacattgatatacgctaacatcccaacatttcgttattgcacaaactgcacaatcagatcaagaagaaatgcagatgaacccccaaggtcaacgcattaaatcaagcctctaaatttccgcaccctaaaaacgccatcaaaaccagatctcgccccactagcgttcgattcggacacaaccaagaccagatcgggcaggaatgtaaatgcaggatgcagggttaggatcggggacctcgaggggcatggccatgaagtccggggacgggttggactgcattctctttgacctcctgaaggatccccttcaccgcccggtt

SEQ ID NO: 93477 - DNA, 1479 bp, Oryza sativa
tgggatagtcttttaacagaaactaacaaaaatattgattggctatcatgtgctaatttattcagatttattttgtttaattaattacacgttacacgcatggcgtttattctcttcagctgcggagatggctcactaggtgagccactggcaagaggtgatggctatcagtgtggaaacatgaaactcctcttaaaacaacaacaacgtgtgagagctctagtcttgtattgcttgtttatctttccacatcattgtgctgtactatcttaactgcgttgtttgttgatcatggatcagatattgcttggaaaatctgatgttgcgggttggggtgcattcattaaggttagatcaatgaaaaagcacctttggatatgatgcattttgcattttggctaattccttttttttctttctttcttgcaacatgtagaacccagtaaatagaaatgattaccttggtgaatacactggcgaattgatttctcatagagaagcagataagcgtggcaaaatatatgatcgagcaaattcatcgttcctatttgatttaaatgagcaggtgtgaactaggtcttcatttctggccagttggagtgtcctgggtttgttaaaagtgaaacaggtaacctttatttgatgtgttcttgcagtatgtactggatgcttatcgcaagggggataaactgaagtttgcaaatcactcgtcgaatcctaactgctatgcgaaggtaatgacttatttttactgaatattcatcatgctctgttgcctttctcgttctgattccgtctgcccgtccaggttatgttggtggctggcgatcatcgagttggtatctatgcaaaggaccgcattgaggctagcgaggaactcttttatgattaccgctatggacctgaccaagccccagcttgggctaggagaccggaagggtcaaaaaaggatgaagcatctgtctctcaccaccgagcgcacaaagttgctagatagtccaacagcagctccagatgataatatcaactgtaaattataccgtcattgaaacacatagttcaatcctagtccattatacggccaatcgttggcataataagcatattctatattccttagttccttggtaaataaactgagatatcgagtatgcgaataaaagaaaaataaggcactgtaagtttatttgtacaaagtttggaatttatgctatgtatagttttgcctgtactctgacattgattctactccctccgtctccatattataaggaattttgggtaactactagaatatgtcacatctacccaaaatcccttataatatgggatatgtcacatccacccaaaatcccttataatatggatccacccaaaatcccttataatatggaacagagggagtacaatattaggcatatgaatctttatattctgaatgggtgtattttattttccagctattattgtattcttgta

SEQ ID NO: 93478 - DNA, 1043 bp, Oryza sativa
acttttccttgtcactttgccatatcctctctttacttcagtatttctgcaataacaaaggtgtcaactaggatcgggcacatattgttcaaacatatacttataaggcatataactattgatggatatagacatacatatcaaacaaatcaaggaacggaacatttccttctggtgtggcacccatcccattcagcaagatgtaggtattttcatcttgcttcttaacttttgcaataacatatgtccccatggcagttcttcgtagcattggtgagccaggatcagaatatacatcttcagaagatctatcgaataagatgcgtggactgacatcttttttatctggggagataacccatgttcttgttttccgtgttttgtaccaagattcatacactaatgcaagagattcatcacaccaagaggtccctctgcatcaacagaatataacaggagattaattatctgatagagttagttaagaaggcaaataaatcgtcacaaaggattagcataactaacattctaaaaggaagtgtcatttaatcatatctgagcaccaaatatagataattttgatgtaagagacttatactatatatatggtttattggtaggaagctttgtattaatgtccttgtttatgggaagtttcctaccagtagtattgaactatgccagatgcagaaagcttaaccatgatgcaaatgcagtgaacataatttactgatcctactaaagtaggctaacacatcgctcaaaatacatacgcatatcggaggtcaagtttatgcagaatctctggttgttcaccatttataggctcagcattttccatgtaaactatgtcacgaggtgacacctctacttttgcatctccaccatcctgtgtctccaccctgacaaaaacaaaaatatataaactattttgcatgcaccacttaattatatgatacttttgcctggcaattcatttagatagaattacgagtagctaagccaagtaggaaaatgaactctttctatatgctcataatatg

SEQ ID NO: 93479 - DNA, 716 bp, Oryza sativa
tgatgaagatcactatggtctaactgatgtaaaagaaagaatattggagtttatagcagttggaaaattaagaggaagctcacaaggttccataattctatcctgtttttattttctgtgtattttctatgtattatttatgtgtgtatgggaggcctttagcaagccattaacatcgatgcaattgggtcttcaaatgcatagtatgctatttttaagcaatattgccgtggcatagatatgaacacattaataattcgaattttgcacctaaatgtcatgtgcagtcctgttagagtaaggagaggtcggggcatatgtattgttcacaatttgtactgaattttgtagccagcatggctcttgcagtattcctttacctgcttttgcatgttacctgtgattaatccatttccctatcattatcaggtaaaattatatgtctctgtggaccacctggcgttggtaaaactagtattggacgatcagttgcacgtgcattaaaccggaagttctacagattttctgttgggggtttgtctgatatagcagaaatcaaggtgcaacgctactatattcactatatgctgttttttggacaacaacgattgtatctacacaggaattcaacctgattagcattttgaaacaaccctagggtcatcgacggacctatgttggggcaatgccagggaagatggttcagtgtctgaaat

SEQ ID NO: 93480 - DNA, 805 bp, Oryza sativa
agcaagcttctgaacacaaatgtgtgcccatacttctggagattcacgctcctccctgcattgacgattacatcacttggttaagcataagggaacagataagatgcttcaaatatttatgtagcacaaagtatgactagaagaagtgtgttaaaaatatagatcggtaactatcgcaagaaatgcacttatgaaatcaagtccacattcatttattgattggtgaatcaatcagcaagataactctgctattcttccgaggggaattttttagatggggaatgcattcaatatccttctaccttaactgatagataacttctggcatgctcttcttataaatcttcatacgcaacactacttactttagacaaacaacattaaataatagttgaaatacatatacagcttaaagtgtgtcagttttccaattatagaatgtatatatccttcaaaataggaaggataaagacatgatttattgcattgacaacaaacaagactgaaataaaatgaaggactggggtatcacaataattacacttttctgcacagagattaggaaacgagagtgcagaaacacttattatctacaaagtatacaatttcagcacaaagtttaggaaattgtgtagcaagcacataataaagatacttcacctggtcagggctgaagaatccctagctgatcgcagtctaatagctgtactgttgcaatttacatcattaccaccacctaagccagctctcccctcacgtcttactatttcatcaacccaattatgctgcggtgcatgtctttctt

SEQ ID NO: 93481 - DNA, 584 bp, Oryza sativa
tgccactcttacaaactagttcatgaataacatggggaaaaaatcaaagatactatatgtatgaagggctccatgaacaaaggtagaaaagctcacccctctcctaacaacttcctcagctgcagcctcagcactagttactagctgctccacgtacctacaaggtagtttgcaatactaaaataataaataccatggtacaactgtagcatagattggaagtttctaaccacaaaagaatggagttaagtataaaaaacaaacctgtcattggcctcttcatcgccttctccaataatcgggatggttggacctgataaaatagcaaacctggcaacggaagtgatgacttgttaagtgacaacacgcaacagaaacaaaaaataataattttgtgataaatgcatcaacaatttgaaggtgagaagaagatgttgtccttgagaaacagcagtaggaaatgtggtatgcatattcttgaatagaacgaaaaataataccctctagccaaccaaagcagtggggatgtagcaccaatccctggaaactcattaggtgagccacgcacttgtccagcagcattc

SEQ ID NO: 93482 - DNA, 586 bp, Oryza sativa
  unsure (1)..(586): unsure at all n locations
gagcggaacaagggttttcatcaaaagaaatccggagcagtttcattcgatttgttgtggattggatgatggaaaaactagcaagcagcaagcgtaggctatgttgccgtagcgcgccctacggagttgtacaaagtcagcaaccattttggggcgcaagcataggcaacacaggactgatgacggggtggggcgcgcagtgaactggttttctaaaaagattggaagatccggccaaagaaggtgatagccctgttcatttgttcccatggttcgatccttcccagtaaaacgcggcgtgttcgaatgatgatcgcttttacgcgagaaannnnnnnnnnnnnnnnnnnnnnnnnnnnnnnnnnnnnnnnnnnnnnnnnnnnnnnnnnnnnnnnnnnnnnnnnnnnnnnnnaatcggggagtgcaatagagaacttgagatccgatgcgaacaatcactcgaaggagcgaagcgcgggcgcactcactctaacggcgtacctttcgcatgatgggtcagcgaggaaatgggaacagcggcttaaccattaggtgtaagccctttccagaggtggaagatttacgt

SEQ ID NO: 93483 - DNA, 1794 bp, Oryza sativa
  unsure (1)..(1794): unsure at all n locations
gggaccgtcttggtctatcgcgacattccagggatatgacatcaatgggtacacattctacacgagagcccaagacatgaagagcacgaaccaaaacagcgctgttctgtgtcgatgccatgggacacgatggaacaactgccacatattaccgtgccatcgaggacatatgggaacttgactatggtcctctcaaggttcctctgttccggtgccaatgggttaggttgactggtggaggcgtaatgattgatgacagtgggatgacaactgttgaccttaacaaggtgggatactcggacgaaccttttgtccttgccaatgatgtaacgcaagtctttttcgtgaaggacatgtctagcaaaggaaagaagggcagagggcctgatgagcctaagcgtcaagtggttctcncaggcaaaagaaaaatcgtcggagttgaggacaagactgacgaggattacgatcagttggatgggccaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagttcaaatcatgtatatgctagttatatgtgatacttacaatttttaaaagttttaaatcacacaggtggcaatttcatatgtacgttaattagagtttttaacatttaatttactagcattcatatgctaattataattgactattgtatttttaaaagttttaaatcacgcaagtggcaattttatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaagtaattcccacgctaagtatatatgatgattacaatttttattaattttaaatcatgcagtatgtacatacatattttaattagagtttttaccaatataataatatcattcatatatatgctaagtatatatatatatattggaatttttattaattataagtcatatatttgcttattacgatttatccacttaatttattacagacaaaaataatttttcgaagtaattgtcattaatctttagtactttaaataatgttaatgcattaacttctattttataaacacatatgtaagagaaaatcatatgcagtgctataatctttagtcccggttcttaaccctaaccgggtttaaaaagaatttcgaaatagcgggaaaagatatttactcccggttgttctcaacaaccgggactaaagatatctaatgtagggtttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacg

SEQ ID NO: 93484 - DNA, 1105 bp, Oryza sativa
tgctttccaaatcattggttggtgcagattttacatcttcagttgagtgtggtcacccaaatttccatgatctgtatcctgccgagaacttgacaagggtccttctcgatttccatctgataaccggttttcccgtggccatgaaagcatttctagaaaatggtcaaatctaggtctcaatgcattatcgatctcttttgttacaggggtggattgaaagaacataacaaggatcaaggcacatattaaaaccacaacaattatgaagatcacagacagtgatgttgcaacatccctgcaccttcctgcagcataagcaaaaatcagaccaaacagttcggctatgacacacacaaacaatgcctgagtccttatcccatgccggctcaattctgtgctcagaagtaatatgattgtgaccaaagatgccacaaaagaagttgcattggaacaggtgaaaatattgaagcggcgaaggttgtgcctgcgaagaacaaaagtagctggacggtagccatgactgttttcagcccaaaagccaccaggtggactcattccagcttggtatgtgatagtagcagcaaaagttgagagcatcaatatgaacttacgagcttcctcgatttcttccttatcattttggttgctcctttgcttcttggggagatgacaaatggttagaacttgcttcagcattctttgcagcttctgtacagtttgatgcataaatgtttgtacaccctcttttaaccattttggaaccacccttatgaatactagaatgtggattccaacatagaagaaaacagataaaactagcaccaatatataaacagaagactttagagctctgcaactccctgcagcataggcccccataaggctaaagaggtccaatatcatggtaacctgcatcgcacgaagccataaatgctgattggccacacccctacttagaagcaagatgattaagaccagagatgcagcaaaggctgttgcattgcagtaaaagaatgcttcatatcgctggaagaatttagatggaaggagaggatccccagcatgatggacagggctgtcgtccgtccaaaatccccctggtgga

SEQ ID NO: 93485 - DNA, 2445 bp, Oryza sativa
gcattctatctgatgcacgacggctcctcagaaaagtgaaattggtttcaggattcgatggtagctcaatggtggtgaagaacaacaagaacagagatattgtgaacgatacaaaggagacaaagagagaagacctgctgaagtcaatgaccaaacaatgagaggcacaagagggttggcgcatgggactgcttgcttgaccccacggcaatagcaatgttttgttttctagcagcttgcccaagttactataaagaaattgagtgagacatgtaaacttgtaaatgactaataagttggaactaggggtggatatcgagccagctcggctcggctcggctcggtaaagctcgttaggataacgagccgagccggctcgttatcctaacgagctaaaaacccagctcggctcggctcgtttaaaagctcgagctagctcgttaagctcgcgagccaaaccatccaaaaactgcccctagccctcagcaacagccaacacagcaagcagccaagcatgcataatgatagtatgataaattgttacatgaaaatatcaaagcaacaaatcacattcacatattaagtaatctactcaaagtctgggattaaacacatttcccaagtccataaacgtccgcactccagtactccacagtcacaatgacacattctgagttactgacatagtgacatacatcatcagttcatcacatattgcaattaacttcaaaatagttcaacaaaagactgtaattaaacataggttcagtccagtacaataatccatgcttcaagttcaatagttcaatacttcaatacaccaatatttagcataagtgcatatctagtaaagctgcagcctgcaaggttcatcattttcatgatttcatccaacacagttgcacataaacacaaaacacaaatagcatggcaattggcagctccctttctcccatagtcccacactccctttctcccatagggtgtaggcttgtagcctgcaggtaaacaaattatagagtatgatataaatgggtgaaagtcataaacttattaaataaatataaattgtccctactagttgcttgccaccacacaattggggaagtccactatttcgatgtcatcatctccattttctccctatgaaaacagtccaaagtgaacattttatacaaaagacttgacaaaaataaagaataaaaaataatcattgcattacataccacagggataggtgcactattgtcattttgagaggctcttatccagcttgaagcacaaaccaaagcctgaactgtttctggcttcaaagaactccggtagtcatcaagaattcttcccccggtactaaaagtggactctgatgacacactgctagctggaacagccaagaacctctttgccatgttggacacaacaggaaacctatgggcatttaccttccaataattgagtaagttgaaagtgctatcttcgaggacacatttggttcatctagatagatgagtaactcagactttgaggattctttagcatttgactgcaaaaaggattgaaatccacttggaataattgaagccaatgaggtggtagtagagattgaggatgaggccgagtgaccattgtgtggactgttcccaccttggttgtggcgacatatccgctcatactttctgtagagtttttccatctcatcagttatggcagcaacctctgttacacaccttgtctcaccaaaaaattcactgaagcaccatctaatgtacctcattttgaacctagggtcaaggattgtagcaatgatcatgatattgtttgtgttctcccaatatttattgaatttttccaacattgcatcagccatagtcaccagcaatacatcattagggtcaggttcataaagtctagactgctgccctaaccttgcagcttctaacagtgcagtttgtgcttgtgctctagaagctaatattgcaatcttaactttagctatgtatggatagaaaacattggcagtggggtaggttgaccctgaaaatgcagtggttgcaccagacattgttcccaagattggctgaattttctcaaacaaatcccattcagattgtaaaggtagccattcatatttggtgtctgattcagcataataatcaaaaccatttctatactcaatgcatgtctctagcatccgataggtcgaactccaccttgttttaacatcaatagacaaccctctaccaactttaattgaataagtgttgcacacacccacaaacttatacatacgggctggagacttcttaaagtacttcacagtgttcctaacattggttatcaaagattgaatttgttgcaggccatcattaacaaccaaattaactatgtgggcagcacaacgaacatggaaataatctggatcaaactgagcattctttctagcag

SEQ ID NO: 93486 - DNA, 1960 bp, Oryza sativa
gttaaccgttgagggtcaacaacaaatggtgtttttagttaagggtgaaaagtgaacttcaagaagatttcaaggaccaaattacacttaacccaattcctgagataaaaccaacgagatgtttccccaaacctattcatgcaaaactgtccaattcattttcatgtgaacagccacctgtattataacgaacgaaaagaaaattcgcatgtttcaagcattattcatctcctcatgaaaccaatcagttacatacaactaaacatgatcaaaattctaatcatattcaaccaaggagaagaataaaaaaggctgctgcgtctggaatcttatctccctaaatgaaaaatgttgaatattttgttcagcaacaaagaacatcatatcctgtagtcctgaacaaaaaccaaagacatgattttcatctaaaatacaaagacatcacaacagtggcaaaaaggagttttttttttcaacaacctgcaagacgttcgcacatcatagcattaagaagtaaaagaatggggcagacaattgagaacatgtgcgactactgccccctagccaaacttgggaaacaactaaaacgaaatgacaagcacactgaactattcaaaatgacttaagagaacttatatgtgatacaagacacagtctacctccacctattactgtccttttgatttcttgaaccaaatgatcaaggaatttgaaaacattgttccaacaatctgctcagctccttgttattttgttactccttgttattctccagcacagaggccacctacctttcctttctttcagccattttgcgataccactcaataaaataattacaatcataaggtatagcaccaccccgcatactaccaagaagacaaatattgatgttctgacctttctgcagcttccagctgcataagctgtcatcagagccaacaggtctagtatcatgatcaagaacaatgcttggagtggaaccttattctttctcacagatttactcagcagaagcatgattacagcaatagatgccatgaaagagatggaattagaaacatagaacaccatatagcgtctggagtgtatgtcttaaggagcgggttgccagcattgtagccatcacgactgtcatatgaccagatacccccgggtgggttcagaccagcttggtaagcaatggatgcagcaagaattgcaagcagcatcaagtacttatgcctcttttctttcttttcactgataaggggatctgacttgtcactttcattttttgactgacctggacttgctagtgacttttgagaatcagcaagcccaaaaaacttctgtaaccatctccgtgacctggctggcggttctagtgcatcatttgttgatgacagtacaagaacttgaattaaaagacagatgagaactgcagcagttatgataatgagataacctattgattttactttcctgaagcttcatgcagaataagcaatcaggagaccaagcaaacccgctatcaagcagacacgcagtgcgtaggacttgattccatgctcgcacgattccctattgacaagtagtatgataaaagccacagatgacacaaattagagagcatttgaatagtagaaaacatcataacgctttggatggctatcttgaagaactggattgccaggtttgccactcccatcaggccaaatgccacctggagggttcaggccagcttgatatgtgacagttgctgttagaatagcaagaatgaatagcaaattacgcttccgctccaagtccttctcatgagcatcttttgcatcattatctacatgatgttcttgtagtacatcctgtcgccgcttaaacaattgtttccactgttcaggaactgcatactttgaagccaaaacatgaagaaaagtatatgcaactactacaaaaaatatcaccactgatatgtaaatgg

SEQ ID NO: 93487 - DNA, 2546 bp, Oryza sativa
cagttttgtcacattctttttcagcacaaaaaagtaaccttgcacctaccaaagaacacaattatgttattttatattaattagttctataaaataacataaacatgtataaaattgtttacaattctctgtcaaatttgtttagtaactatatgcaatactactcatctgcagataacatggcacctgataatttgattattgcattaacaccaaagaacgataggtggaaaatcaaagtaaaagttactaggctatgggatgcggttaatcctacaatggctgatgatttctatggtatacagatgattgtactagatgcagaggtatgattgttgtaaacatgtgatttaatatattgttctattgtgtaaatacaatctttttggtgcagggcaactcaattagagtaaaagtaaaataataaaatactcagaccatgtgacaagttataatgcacgcataatgttatgatgccggactaggtcatcgcatagaatataattatgattttaatgtttcactgcttaaatatgttaatgatttttaagataactaacgctcaacatttagttttgaaaatatcaaacactcatattcaaaacaaaaggatatggttgtataattttatatgatattatcataagtactaaatattttatggacaaacatcgtatattgaaactattattaattaacatcttaagtaaaagtcgtcgcatatctatacggcaataaaatcaataaaataaaaataagatgtccgtgcatcttttttttccttcacatagcatcgaggcaatcaagccactaatgcaaaggttggttattatttgtgcactgatggatgataattttatcttggtgggttaataaattttaaattcccgtgtttatgtacacttcttttccatactatattttgcacatacatttcaatcatatttatgtaccttttctattttcttttcaaaatcctatgttacaaaggagtccctaaattctttcacggatagacaaagtcataatatttcacaatcctaataacaacaaaaattatgatattttaaataagatgcccgtgcaattgcgtgggctaccttcctagttaggcttaaaagattcgtctcgcaaattagtctcaatctgtgcaattagttatttttaagcctatatttaataatttgtgtaagtgttcaaacgttcgatgtgacagtgtgtaaaatttttatgtgggaactaaacagggccttacaataaaattggttatggggtagaattctagaatcttgaagcaagactgacagttagaatgttttatgtaacttataactttttaagtttgtttggcattaaccattaactgtcttgttttaatcttagttattggttacaactaggtgattccccgcgctttactgcgggaattactaagtaattattaatttttttgacagcaagttaggagtaaaaagaaaaaaataataatgaaacatcagggtttatcaatcaaataataccatgcttcaatgtgaaacatattgataagtatatgttaaatattataaaagtgatagatagatttgttaaaatatcgtgcaaatgatatgaggggtgatgattcaaggtttcaaacatgctgaacatgctgctacccagtcaagtgaaatgtccatgcatgtttggttttcaccttaatattgctatgttgtaggaagcaaacttatttagcaaactgtaagtttttattatactatgcaacaggtaggaaataataagaatacctggtgatcagagatcttgacaggcaccaggaagaagtcattgtccacctccatagtatcctttcccccagccaccacctctttccgcatcttggacaggcggggatcgtctttgtccctaatcttcgtctgcagcacaccatccttgaatagcttcacacaaagtagcgaaagagagataatgccagaatagattgctagtgttgcccagcagaaaaaggaaagtctgtaaattcattctcacctaagatgaacaacagaggtctgcccccaattctgtgtgtctgcaaaaatcaccaagaaacaatgaggataatgagcagcacaaccgaattagccaaggaggaagatttcctcttgttggccaaacgaaagaaaaaaaagggcaccaattaacctgcagcagtagagtgggcgagcttccaagagagaggaaccgatgatagcagcacgagcaacagaagcaaaggcgctgctgcccttgtccgtgtccgccgtcgtcgtcactaccgccgccctcgaccgctgccaccgccctcatccgtgtccgccgccgccaccgtcgactacagccgcctcgtcctcgtccaccgccgccctcgaccgctgccgcctccctctcccgcgtccgccgccgccgccctcgtccgcgtccaattccgccgcagtcgccgcgctcgtccgcgaccgccgccaccatcgacagagtccgtcgccgccgtagtcgctgttgctgtcgcgcgggggggggggggggggggg

SEQ ID NO: 93488 - DNA, 1204 bp, Oryza sativa
tagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacattcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagagccagaagcgtgaacgaggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaagggt

SEQ ID NO: 93489 - DNA, 697 bp, Oryza sativa
ccccccaccccgtccgggagtgagtattctagtgggagccgcggccctcgtcaccgccgccgcgactccccaactcctccccgccgcgaaccctcgcggagggaggataccacccgttcggtggttcggccctctcttcgcccccgggcggggggaggccacgacgcgtcggggcacgtcgccgcctcacttacggcgacgacgattcgccccgaggcgcgcttcaggcggcgggtgcccttctgtggcatccccccgtaaactcggagccagagacccctgttcagcgctggctagacgacttggccaacttggtcacctctgcccagcggcagttggctgctggcgaccgacctgccgccaccggtacgtcgcgtacccctgttaccctctcctcgtcggcaaggaggagggcccgtcgctcggccaccgcctcaaggcggtccacggcgccaacatcgtcaggggcctcaggaagccggaggcgtcatgacggtctctacggggagcaggacgctcggatcaacatcgagcgacgcagggacgagcgctgagctgcccgcatggggaaaggcgcctcctcatctggagtgccacgttcctcctcacgaggcgaccctcccccacgctctcccctggagggacgggttgtaaagccttcgtggtgagtctccagaatgtcctgtggcccctgaag

SEQ ID NO: 93490 - DNA, 1275 bp, Oryza sativa
caaggagatcccccttggcgatgatgtgtccaagaccgccaaaattggcggaaacctgggcgccaaataggaaggcgcgcttgtctccttccttcgggcaaattctgacgtcttcgcatggaagctgtcagatatgcccagggtcctcaaggaggtgatcgagcaccgctttgccgtccggcaaaaagtgcggcgtcaagccctggagcgacaggccttcatccgagaggaagtggcgtggctcctggaggctgacttcatccgcgaggttatccatccggagtggctggcgaacctggtggtcgccccgaaggccaacggcaagctccggatgtgcatcgactacacggacctcaacaaggcatgccctaaagatcccttccatctaccacacatagatcagatagtcgactccactgcggggtgtgaccttttgtgttttctagatgcctactctgggtatcactagattcgcatggctagggaagataaggaaaaaactgccttcattactcctgtgggcaccttttgttatacaactatgccttttgggttaaaaaattcaggacctacttttcagcgcatgactcgtattattttgagtaatcaaatagggcgcaatgtagaggcgtatgtcgatgacctggtggtaaagacgcgccactaggacacgttgctgcaggatttggctgagactttcgatagtcttaggtccacacgcgtgaaactgaatcccgataagtgtgttcggtgtgccggcgggcaaacttctcggttttctagtctccttccgaggcatagaagcaaatcccgagaaaatacacgcgatagagaggatgggcccccctacaaacttagggatgtgcagtgcgtcactggatgcatggccgccctaagtcgattcatatcgaggctgggagagagggcgctacccctattcaagctcctcaagcgctctaggccgtttgtgtggacggaggaagctgagcaagctctcaaccagttgaaagcttacctcacctcccccccatcttggtagccccggggccggaggaaccgttgctactctacttggccgcaaccccccatgtggtgagtaccgccctagtagtcgagtgcgaagagggcgaaccggaggcccctttaactcgcgatggccctacgtctcccaaaggcccggagcccgaggcccccgtgggaggaagggaggctttggcgagtggtcctaaggcctatgatcccgacatgactcgagacccccccggggcccccgag

SEQ ID NO: 93491 - DNA, 668 bp, Oryza sativa
ataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctctgaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacaacaacatctcatgggtaacgagtcgatcaaccaacaacttgccttcctggcgaggggaccgtttgggtcgatcgcgacatt

SEQ ID NO: 93492 - DNA, 673 bp, Oryza sativa
aacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaaaaagaaactacatgttgttcgtgaagggaaaaggagaattgttggattggacaatattgcagacgaggatgattacaaccagcacgtccacggcataggtcaagaaatacctctagaagaggaggaggaagaagatgaagttcaatatgcacgtgtcgaccatgaagaaggattatttttgtaatttatgtacgtagtttatgtctacatgtctgtatctgtatgactctaatatgttcgcaatgatc

SEQ ID NO: 93493 - DNA, 569 bp, Oryza sativa
aaagcccccgccacttcaaccggtaacgggcgagaagaggccaagaacaaggcccccgccgatgatggcggtgacagtgaggatctggatttccagatacctcagggaaccgtcgccacgctcgacggggggggggggggggggcgtgcgctcacacctctcgccggggcttcaaggccatgaggcgagagcttttggccgctgttcccacgcacgaggcggctcggaaggcgcgctggtcggaggtgaagctcacctttgaccagagcgaccatccgacagtgctcgctcgaggagggaagttggcccttgtggtctccccgaccattcacaacgtcaggatgaagcgtgtcctggttgaatggagagccagcctgagcatcatctccccagccgccttcgacgcactcaaggccccggggatgaagctccagccgtcgctgccgatcatcggcgtgactccgggacatacgtggccttttggccacgtcgagctcccgatgaccttcggcgactccaccaacttccgcaccgagcgaaacgacttcgatgtggcggacctcaatctg

SEQ ID NO: 93494 - DNA, 712 bp, Oryza sativa
ctgcagccctggatcggcaatggatgtacgctgaccggcggtccaaaagaggttattgccggcgtgcactatttttggaggggccgaagctaacaggcaaaggggttttatttgttgtccatgcaataagtgtaagaatcagaaggagtattctgcatccaagactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggaacaaaacgttggataccactctggagttgttgcaatggaaggcaaaaaatggggttagtgacaaggcatttggcgatttattgaaactcgtcaagaacattctttcgggggggaaacaaattgcccgagacaacgtacgaggctaagaagatagtctgcccattaggactggaagttcataagattcacgcatgtccgaacgattgtatcctatatcgcggtgaggagta

SEQ ID NO: 93495 - DNA, 666 bp, Oryza sativa
atgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaaattaatatatttttaaaactatcattcatatattagagtttttcacaatttaatttactatctttcatatgctactta

SEQ ID NO: 93496 - DNA, 1633 bp, Oryza sativa
agtccctacccacacaaatggacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccatttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcgtttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatataatatatatatatatacatatatatatatgtatgcatatatatgtattgaaacatatatatgcatggtttatatatatatatatatatatatatatatatatatatatatatatatatatatatatatatatatatatatat

SEQ ID NO: 93497 - DNA, 507 bp, Oryza sativa
ttcctgcagcccatgcttcctaaaatagttgcattgctgttttctcgtgtgaaataccgtacaactttatatcctctagacaaaaaggaaaaaagaacgaattatccctgaactatcgcggttgaccgaattaccccttaacccaaaaaccagatattgctcaccctgaacttttaataccggacaaattacctccctcgacccaatccagagcggttttgtcctacgtggcgtgcgcgtggcaatccagtcagcattttatttataaaaaaagtggaacccacctatcatactcctcttccctcttccatctcttttctctctcactcttcctttctcttctctctctctttcactcactcttcctctctctcgcgtgcgggccgagcagcggcacgtgttccgcatgcacggcgcgcgggtggtgggtcgaaccgtgggatgtggaggaggcggtggcgcaggacgccaaggcggctgccccctcatgcggtgatggacggagca

SEQ ID NO: 93498 - DNA, 702 bp, Oryza sativa
cggaaacaccagtcggcggcggtcgaggcggccggtccgtgaaaaagtagacgcccaccaccggcggcttattaggttcacccgtccaggcggtgaccccagtcggcggcggacaaagcagccggtcggtgaagacgtagacgcccaacaacagcggcataataggccacccgtgcaggcggaaacaccagtcggcggcggcgaaggcaagccggtcggtgaagacgtagacgcccaacaacggcggcataataagtcagccgtgcaggcggaagcaccagtcggcggcggacgaggcggccggtcggtgaagacgtagacgcccaacaacggcggcataataggccagccgtgcaggcggaaacaccagtcggcggcggtcgaggcggccggtcggtgaagacgtagacgcccaacaacggcggcataatacgtcagccgtgcaggcggaagcaccagtcggcggcggacgaggcggccggtcggtgaagacgtagacgcccaacaacagcggcataataggccagccgtgcaggcggaaacaccagtcggcggcggtcgaggcggccggtcggtgaaaacgtagacgcccaacaacagcggcataataggccagccgtgcaggcggaaacaccagtcggcggcggcgaaggcaagccggtggtgatgttctgactgatccattcctggagcgtaagagat

SEQ ID NO: 93499 - DNA, 519 bp, Oryza sativa
aacctctctatgcggcccaaccacaacccgtcggacaagatcgataaaccagcaccagtctcgtgaattctctttctccaccaaggcaaaagctaaaggtacaagttggtcctccgcatcagctgataatgcagtcatcaaggcaccaccgtatttcccagttaggaaggttgcatctatagctagtactggcctacaatgcttaaaagcctcaatggaaggaccaaagcaccagaatgcacgcataaaaattttcttggtcactccatcaacgttgacaaccctatcaggatgagtatcgatgtggtagaccatactgggattcctctgcttaatggcttgcagcaaagtgggcaaacggacatacgcttcaccccattcaccgtaaatgagcttcatagcctcctctcgtgccctccaagccttgccatacttcaccctatactggaaaacctcaaatatatacaaagctaacgcagaagcagagagtgtaggttgcagttttatggcattgcataa

SEQ ID NO: 93500 - DNA, 4005 bp, Oryza sativa
gatcaaggtgaagaaggcgagcaagtgctaccctcctcgcccaagaatccaccaaagtatccaaagagatcatcccaccgacaacatcttaggagacatcaacaagggagtgtccactcgttctcatattgcaaatttttgtgagcattactcgtttgtgtcttctcttgaacctctaagggtggaagaagctcttaatgatctagattaggtgatgccgatgcaagaggagttcaacaatttcacccggaatgaagtgtggactttggtgtagcgacctcggcaaaatatgattggcacaaagtggatcttccgcaacaagcaagatgaggccaggctcgtaataaggaacaaggcgaggttagtggcgcaagggttcacccaaatcgaaggattagattttggtgaaactattgcgccggtagctagacttgagtcgattcgcatattgcttgcttttgctactaacctcaattttaagctatatcaaatggatgtcaaaagcgccttcctcaacgagcctatccatgagttggtatacatggagcaaccactgggcttagaggatccgaagtatcccaaccacgtgtacaagctccacaaggcactctacgggcttaagcaaacccctagagcttggtatgtcttcgcaattttcttgtgaaaaacggctttgaaatcgggaaagccgattcaactctttttactaaaagacatgataatgatatttttgtttgccaaatatatgtcgatgacattatatttggttctactaacaagtcttttagtgaagagtttagtaggatgatgaccaaacgttttgagatgtccatgatgggtgaattgaagctcttcctcggccttcaaattaagcaactcaaggaaggaactttcatttgccaaacaaagtatttgaaggacatgctcaagaagtttgggatggagaatgccaagccaatccagactcccatgccatcaaatggccacctcgacctcaatgagcaaggtaaagatgtcgatcaaaaggtatatcgttccatcgttggctcacttctttacctttgtgcatctaggcccaatattatgcttagtgtgtgcatgtgtgcaagatttcaagccgctccgaaggactatcaccttgtggccatgaagagaattcttagatatttagtgcacactcctaaccttggtctttggtatcctaagggagcgaggtttgatctcattggctatgccgatgcggattatgccggatgcaaagtggataggaaaagcacatcgggtacttgccaattcttgggtaggtcccttgtttcttgttcttccaagaagcaaaactctgtcgccctatccaccgccgaagcggaatatgtttcggcggggagttgttgtgctcaacttctttggatgaagcaaacctgagagactatgacctcaatgtatctacaatcccactcctatgtgacaatgagtgcgccactaagatagccaacaaccccgtccaacactcccgaaccaaacatatcgatattcgccaccatttcttgagagatcattccacaagagacgacatagacatccaatatgtaagaaccgacaaacaattggcggatatctttaccaagcctctagatgaagctaggttttatgagttgaggagtgaactaaatattttggattctcggaatgtggcttgatctattgcatgcatgtttgcttggtagaataggtttgcataccactttgtgacaaaatggtcattcaactcatggatggacactagtcacttttgtggagaacttgaatctatgtgtatggggatcttatttttcaatgaattttggtcctagcacaacttgaaatagattcacacattccctctctcgagggtgaattatcttgtatcatggtaattccctctcttttgatccctcggatcgtccatttgacttgtggctattgttttgtgtgattgattgtgtgctagtcacaagttcaaatggagcctctagtgctcgaccatccctcctttcctaaatactatcaaaaacctttgagaaatgtgtttttgtcaaaaatttcccggtgcttgtcccttgcaaaatccatttcaaatgtttgcaaaatagtttcatcaaaattcctagcgaaatccccttgcaaaactgtgttttccaggaattttcggactttccggaaaatttttggacttcccgaaaaattttcggatatatccgaaaaacattagaaccgtgcgcaacccttctggatccgttcggacttatccgaaaattttcggaaatgcccgaaaatttcggggtctttatatatcaccccgtggactcccttctctctcctttccactttttttccccacgggattgactccctcctctctccccaccggcgaccacctcctctccggcgacttcctgcggctcccctcctctctatcctcgtgggagcgcgcttgggggacttcttggggcttgcattgtcgatcttcaccgcgttcttcaagtgttcttcgcgttcttgaggtattcgccctaaaatcaaatcctttgattcctcaagttttatcttgcgattccctttggtggagatgttcccctagtgccctagaacctgcggattcaatctcacaagtttttgttggcggatttgtgcggcatctgagttatagggttcggcaggattcttttcggacttttccgaaaattttcggatatgtccgaaaatccctggccgacccctatcacttcagtgttgcacgattcttaccttcacttacttgtttcttgcctttttggcttccattcactggtcccttgtatctcgcttgtttgaaggatgcctcccagcaagcaaacctcccacaagtccaagcgcccgagggatcgctctcccactccatcctctcatgatgattcggacagtgattggtctggtggagaggatgcggttcctcaggttgccctggtggctcggggtggcaacctccctcctcggcgatctactcaagctcttggtgctggtggtggtggtgaggactcctctcgtcaactgcaaacgccgccgcatcaacccaatgtccccattggtcctctccgcattcatacccccgagagggatccagcggtgattcgccaagtgtatgattggaggcggaagactgaggttgttgctccctggtgggatgaggatccgcgccctcttcaccactccgccacgaatccgcggttttggactctctttcaacaagacttttatgagtcagtgatcaagtccaaagctcatcccaccgttcccatgcaatggatcaactgggaggagttgcaggcgcataatgatccggtgctaaactctgtgattgcaaattgtgagcgcatggggattcgctctttcatgactttgcagcaggattggtgcaacgaagtcatcgctcaattctatgccaccgttttctttgatccacaccgtgccatgcattggatgacccaaggatcttggtattctgtctcctatcctcctttggctgagatttggggtttcgacttgcatgacttactcaaccttcctgatctgcataatctacccattcctaccaacactgatctcctccctctttacattccaaatgatcctaatgtggtgttgggtaaggtcgacggtctcaaaccgtactttgcctacttgaaccggatgtttcgccggtcctttgtgccaaaggatggtgatgctagcagcattaaccgcctctccaggactgtgcttctcaggttcgatccccctcctcatcgctttcatccttatcactttgtgtgggaagaaaaccgcatggcttccattcagtacaggaaggggttggtctatgctcctcacattatgcggatgatcgagtctgtcactcagcttcagtttcgccatgatgtgtctcattcctagcttcacttgtgccttgttaaggcgccccgctcctcagccgctcgggacatcccctcc

SEQ ID NO: 93501 - DNA, 1426 bp, Oryza sativa
ccaaatatgccatgttgccagaaagaaaacctcaaggaaacccctttgtgcaaacctgattcttgccaaaacaatcatctgaaagaattccaaattacaatcccaatgaatgcctagctattgccaacaagccatactgaaaggacatgtgaagaagagatgaagtctggtggtgtgtattgcataaagcacatgtgagatcatcatcttcttttgcacaaagccttctgtcaagcatatcccttgtgttaagtctatcacagaacagaagccatgcgaacaatcttcatgacacatttggtttccacagccaaatcatgggcctaggaggttgcaaagaagagtaattgagcttgtaaaatctcttggctgtgtatatacctgttccccaaataaaactccaaacatcacttcttcctagctgaagctgcagatgattcaattcctcttgcagttgcaaaaattctccacatgcatcatctgagaggggaagaacaaaagagtcctccattggccgtaggcacatggtcctaactgaatcattcttatacaaagtcacactgaacagattagggtagcttgtgcacttaaaatcatcattccatagatcattccaaaaaagggcagttgcacctgactgaattgtacacttagctatacccctgaaaatatctgaaagagatgtgatatccctccaccagaaagaacccttgttcaaaaccagatggggtactctagaaacataataagtctgtgagatcagtttcacccatggcagctcaacaccattatataattttaccatatgcttgaaaagcaaagcaatgttctgaactctcaggttaatcacacccatacctcccttatctttaggtgtgcatactctgtcccaaaaagctaaaaacttttctagttgaggatgggttgttgcctctccaaagacaactcttccttgctgtatcaattgcctttatgacagtgactggaagttgcaaagagcacatataataagttggaatagaagaaagaactgaattaatcaatgttaaccttccccattgaggcaaaaacatagagcttgctgtcaatctcatttctactctgtccaccaatggtgcaaaatcaaccactctagacctagtggtaccaagaggcaaccccaaataagtgaaaggcaaggaaccaatggagcatcccaaaataccagcgagcaaagaagcattgtcatgagaaagattcaaaggatacaaactggatttgttaaaattcacctttagacccgtggactgtgcaaacatgttcaggatagttttgaaacagaagatttccttttgagaagctttgagtaagatcagggtgtcatcagcatattgtatgatagggaacccactcccatcattttcattaattggcttagagattaagt

SEQ ID NO: 93502 - DNA, 669 bp, Oryza sativa
acgagacccaggattacccctcaaagctttcagttatgcagagcttgagaaggcaacggacggattcaaggaggtgttgggcacaggtgcatctggtattgtgtacaaaggccagctgcaagatgagttaggaacttacattgctgtcaagaaaattgataagattcagcatgagactgaaaaggagtttgctgtggaggtccaaaccattggacggacgtaccataagaacctggtccggatgctaggattctgcaatgaaggaactgagagactgttggtgtatgaattcatggttaatggatcgctcaacagattcctgtttagtggtgtcaggcctctgtggagtcttcgagttcaacttgctctcggtgtcgcaagggggctgctatacttacatgaggaatgcagcacacagatcatccactgtgacataaagccccaaaatatccttcttgatgataatttcatagcaaagatttcagactttggcttagcgaaactactccgaaccaaccaaacacagacatatacgggtatccgtggtacccgcggatatgttgcccctgagtggttcaagaacgtcgggatcactgccaaggtggatgtgtacagctttggggtcattcttctggaactcatctgttgccggcaaaatgtggaaatgga

SEQ ID NO: 93503 - DNA, 1801 bp, Oryza sativa
cctgcagcccgtaactctgattttctgatgtctttcaacctgcaggtaattctatacatggaactgtttgtaagtacttcttactgacaattcagtttagttgtgtatttgtattagattattagttgatgctataaaaacattactctctcccgaataaattagtaacgcaatttacagaaagagttaaattaatgtattactaaatggtttgtaatagaatattgagtttagtggagcaatttggtttcagaaaaagaaagtcaagcattaaccctactgaaaattgaaatttatgcaagaatagaagctggaaaggttatcataaatcaaatataccagaattgtatgttaagactggaacaactttattccgtaaagcattctacattgtagtgttaaaaagaacagatgaattgaactttgaaccattctgttttattttgtacagaatattggcaacatattcattggtcctaatgtttctctacaggcctgttgcattgagtatctgatattagagagtgataatttgtcaaagttgttccccaatgcacacctgaccattgggacatttacaataaatgcgcatatattattcgcaatcctgactactctgattgtcatgccaacaacttggcttcgcgatctcagctgtctaagcttcatttcaggtatcaacacttgtcaccggaatcctttgtttcaccaaatatatttgcaaaacttgaacttattgaatattacacacacacacaagtactctttcaaaaaaaaaaaaatagtgggccaaggatatgctgctggtatttgttactttgagtatatgtggacacacaccaaacggatgtgcaagtgtggtgtttgcgcatacatataatcgggaaaaaaaaggggtgcacaatgtgccttggatctcatcttgttcattctgttatagctggaggagtgattgcatctatagtcattgttgcttgcctgttctgggttggacttgttgatcacattgaggccaaggatgaagggacagcactgaatctcccaggaattcccattgccgttgggttgtatggctactgctactcaggtcatggagtgttccctaacatctactcttccatgaagaaacgcagccagttccctgctgttattttcacctggtaataaccctagaacaaatgtctgtgattcataagttctttaaaaaacagtgatgccaagctttgcttatgtttttttttcttgacagcattgcattatctactgttttgtttgctggtgctgcaattatgggatacataatgtttggtgaatcaacagaatctcagttcacattgaacttgccatctaatctggtagcttccaagattgccgtctggacaacggtattgttcttgtctaaattagaggaagctatgacatctagtacaatgttgacataaatgcatcacttgtatgattgagtaaaattaagttatgtatgactctttatttcagtcatctttagcattctctgtaacatctggtatagcttctaatacttaatgttgttattaggaatattgtactctactgatagtgtatactttgctttttcttgcaggtgacaaatccaataactaaatatccttactgtgttattttgtcttttttacacctattttcccacgctactttgtcattattgaacaacatgttggcagttcattacaaactaatagatagctagttcaattatacggaataagaagattttcaatttattaggttgtaaaaaagcatatttaattcaagtttctca

SEQ ID NO: 93504 - DNA, 720 bp, Oryza sativa
cgctcctgcgttgacagcacttgtggacagatggaggcctgagacacacagcttccacctccccagtggtgagatgaccatcactctacaggatgtggctatgatcttggccctcccattacgggggcatgccgtgacgggcaggacagatactcctggatggcatgcacaagtgcagcagctgtttggcattccactgaacattgagcaggggcaaggggggaagaagaagcagaatggaatacccctgtcttggctgagtcagaacttctcacatcttgacgacgatgctgagccatggcgtgttgagtgttatgcccgtgcatacatcttgcacttgttgggagaggttctgtttcctgatgctgggggtgacattgcttcggcgatatggattcctttggtcgccaaccttggtgatctgggccgtttcagttgggggtcagcagtgttggcgtggacatatagacagctctgtgaggcctgttgtcgtcaggcaccatcatccaacatgagtggttgtgtgctattgattcagatgtggatgtggttaagactaccggttggaaggcctaagtggaggcaaagcttcactccttggccctacaatgagccagacatggagaagacagtggcctacctttttgagagtactgccactgcacatgctcaccgggatgtggcatacaagcattatgtcaatgagatggactgcttgca

SEQ ID NO: 93505 - DNA, 1055 bp, Oryza sativa
  unsure (1)..(1055): unsure at all n locations
caatacaatacaatctgtacatatatggcaaagtattcctaatacccacccgcagtcgcagcgagaggctcacggatgcaaaggctggaccgaaaatctgtaaataactgcactggcaagcctttggtcatgatatcggcgaactggtgtgtagacggaacatggagcacacggacctatcccagagccaccttttcccgaacaaaaaggatgtcgatctcaatgtgcttggtgcggcaatggtgaaccgggttggtggtcatgtagacagcactgacattgtcgcagaagacaacagtcgcagtggagatgggagcatgcaactcctggagtagctggtggagccaacattactcggcaaccgcgtgagcaacggcacgatacttcgcttcggcactggagcatgagaccgtcgtctgtcgcttggaggactaagacaccaggttatcgccgaggaagatgtagtagccggaggtggagcgacgagagtcggggcagctggcccagtcggcgtcggagtagtcagtcagagaaccgaccggacggtgccgatgtggaggccggcagagagtgagcccttgatgtagcgcaggatgcgtttaaccaaggcgaggtgaggctcgcgagggtcatgcatgaagagacctgttgaacgacataggcgatctcaggacgggtgagagtgagatactggagcgcaccggcgaggctcctgtactcagtaggatcggcgacgggggcaccctcctaggcggagagcttggcgcgagcatcaaccgggttggcagttgggtggcattcaaacatgccggctcgctgcagaagatcgatggcgtactgtcgctgggacaggaagaggccgtcggggccatgatgccgaaggcctgccctgaaaagtgaccttccaaaaaagccagctccctaacgacctgngttcggcctaggataaccttggaagctgaatatgaagtggaaagacacaaccagccctatacatgtccatatctacaagataagcatgtaaaaacctatatacttggatttgtagttagagc

SEQ ID NO: 93506 - DNA, 3571 bp, Oryza sativa
acagagtcaccgtccatctggtctcttctctgtttcaatgagatcaaaaggagatggtggtggttgctggattggggaatttcacagggatggggaggagagtttgaggattgccgtttggcccatagtgagcgaactaaagtttgtaaaataatctgcttgtttgtttttgtatatttgatttgcaatttattgttgatgtgcatttgttttcagtttttttttttataaaaacatccatccatgttcttgggtgtttgctcctgtgttttccagatacatagatcgcagcccttctgcccaggtattttagttttgggttccattttgactccgcgtataccgccataaattcttcgctgtcaaagaattaactgctgccctgtgcatgtatgagattgactctcatttcggttggatattaattaatgtgcatggctcagaggagctaaaggattggctgatgagctatttagtccaatacaacaacaccaattccagacttacgttttgtttgatgtttatgcattggttatttgaatttgaatttatttcgtttgttgtaggatcattttggaaattctgagtcattatctaatggagcaccaggcctccaccttaatggtacgagagagtttaatggacagcaatttggaccaacccgggttcatagtgttggcgctatgctggatcactctgcagttaatgttggttccccatggatacagaccaaaacagatgatgctgactttcataggcatgccgagaatcgcttcatgccaaacatgggaaagatgaatgcttttgctagaagggaccttcagtccacctatctctctgactctgatctttcaaatgctttatctagggtgaacttgtctaatcatttagaatatgatgaaaggggccttgccaaagacctgcttgatgaaatggaaatgcgtaatcacgacaggcatttttcctctaagattgccaatgactgccgttctcctttatctggcaatgctttgtgtacgcttggttgtgagcacttggatgttcattcactaccttcatatggagatggtcttctacgcaggcagaacagtattatggatagtccctatgtttcaaggaataataaccatcacatgaagaatgtggatcgcctatctcttgctgatcaactagctttgatgcagctaagcaatcttgacgagaataattaccatagcaatgcagatatggtaaatataatcaaccccttgagaaacagacgcaacatcacagacttggacttaatcaggagtaggaaccatttccttgaagaacttattgcacagcgttgtttgcaggaagataatgtctttcagtcaaaatctggtccctcatataatgacaacatactatatcatgatggacctcgttttccatattcaagaatgcaaagatcagggtcccatgcttattcacatttgaggggcattccatatcttggtgatcagcaatcgcggatgttatcctctagtaggaggacacctggtagaaatatgggatcacaaatctaccaagataatcctgtagcaaactgcctggatctgtcttctttggatcttgcaaatagaagtgttgcttgtcccttggagcttgttaatgtagtgggccatgttatggaagttaggtacatttctcttccattctcctgttgtagattttcaactttaatgctttgtcacattatctacttcttattttaatgcagtatggatcaatttggaagtcgttttattcaacaaaaactagagggttgcctcagctgatgacaggggaaaaatctttccagaggatactgaccaatgctattgctctgacaactgatgtatttggcaattatgtgattcagaaggtacgcctatctgtcctgctaatttgattactcatatttatattttgaaacctaacattcagaattgtacatttgcagttttttgagtttgctacagaaagccagttaagccagttagcagatcagctcagaggtcactttttgcaactcagctttcagatgtatggttgcagagttgttcagaaggtaagttatctttttttttcttggggttcatgtaaatctgtaacccatgcaaactctacaagtttataatcaatttcctacaagtttattgtggacagcagtgtagtctcctaaagtaaatctgttagtaatgtacaaaaaagaattttaatgtacacaaaaataatttgagtggaagcctgaaccaagattaaatcatccgctgcttttaacactcaatcttatctcactactagcattgagctaatgtgtaaaagctacaattgatgacaaatgatttaccatttatgatttttctaattgttatgtggcaaatcattttttcatggtggctgacaagagataatgaatctctgtttattaaaaaaaatgaacatgctttgttctttgtttgcgttatgagcgttatgtcttcaccaaaagtccatgcatggaatgccaccttaactaaaattggtgtcactctgtcagcattatgagtgagacattgatgaggcacgagtcatttcactttagaggtgcttgattggaattttatccatgcatttgccacaggtcattgatgtggttgacttggagagaaagatatctattgttggtgagcttaagaattctgttctcagtgtatttctgatcagaatggtaaccacgtaatccagaagtgcatagagtgtgttccagaagatcacattccatttgtaattgggatatacttcagaaaatttatccgctttgcactcaccaatatggctgcagagttattcaggtacaaattgcaaccttctgtttcctaagcattaaattctgtaactttaaatggtagtttctaaccttatctttgcagagagttttggagcattgccataatccagcaactcaaagtgctgtgatggatgaaattgtcgaacgtgcttttgatttgacagaagataaatttggaaactatgttgttcaagtaggttaacatattccatttatttattcacttgctgcaattgtcaaacttttgacttaaccctgtataaaaatagttacactgccttgatcattaaaaaacctagtagtttacagatattgtggataaaattagtaaaataaattatgtgtgtggagccagggttcaaacttttgttggatgtggctggttgccagcggttactaggattaccacatttcttctatgtattagggctatttttatctccatttgaaatggttacatataaatacaacagtaacctcctgaaatacgatatattcttcatactctggaaacaatcattaactgattaactgagtactttgacaccagcggattatcattttacctactgggaattaaaatatataaaacagcaccagcttatgatgttcctgggctcaattaacttgtaaatgtttcttgttattattttaaataagttgatacattgcagcatggtaaaaagaatgttatatcttttaggcccagtttggaatgtagtattattttttttc

SEQ ID NO: 93507 - DNA, 710 bp, Oryza sativa
gtcacagagaggggtggtataacgcgtggtggtgttagattcggcgcaagagccttcaaagttgaaggtgaggggaactcatgttcttgccaaaggccattgctctaccatatgccttgctcacatcttatacacgtttatctgattcatgcaattgataaggaatctcccaaccgaatgccgtatcagttctcttcaagagccgttgtgaacacatgggcaagtcgctttgagccatacctcgaccccacacagtggccatcgtacgatggtgaagaatttgttgctgacccaaatttgaagattaaaacaagagggaagaggagatcgaaacgattcaagaacgaaatggactcaggtctgggtggttctggaaggaaaccaccttcatgcgttcaacttgatgctgcgccggtgcaaaatagatgctcgttgtgtcaccaggagggtcacaagaaaactaagtgtcctaagcgtccaaaaaagaagaagtccaaaaaaaatttaagtgttagggaggtaaatattttgttttcctactcatgttctcgcattcattttcttttaatatatgtcacattggtaactaacggtgaatttattactttttcatgtaggatggccgaggagggacaaccgccgacttacccagccttggaggcgtactacgaggcccgtcatcgcggggctgcgatcgaggcggggagggt

SEQ ID NO: 93508 - DNA, 3398 bp, Oryza sativa
caatgggaagccgatgtctaagatgatggttgatggtggggcttctgtgaatttgatgccatatgccacatttaggaagctaggcaggaatgttgaggatctcatcaagacaaacatggttctcaaagacttcagtggcaatccatcagaaaccaaagtagttttgaatgtggagctgacagtcggcagcaagactatccctacaacattttttgtcatcgatgggaaggactcctaaaacttgttgcttggaagggattggattcatgctaattgttgtattccttcaaccatgcatcaatgcttgattcaatggctaggcgacaagattgaaattgtaccagccgacaggtcagttaacgttgccagtgctgatttagctctttaggagatggatggtcttgattgcttgtctggaaaggtatgggaaggagattttctaaaggtgtctgattgtgatatacaaccattgaagatggagagcccaagttattattttgagggcgtcgtggagggttcaaacgtctacaccaaggacacggtagacgatcttgatgacaagtaaggacagggtttcatgtcggccgatgatttggaagaaactgatataggtccaggtgatcgaccaaggccgacattcatcagtaagaacttatctccagaatttaggaccaagttgatagagctcttaaaggaattcagagattgctttgtttgggagtattataagatgccaggactcagccgatcgattgttgaacatcggctacctatcaaaccaggggttagaccgcaccaacaacctccgaggagatgcaaagccaatatgctcgaacctgtaaaagctgagattaaacgtttatattatgcttgttttattcgtccttatcgatatgccgagtgggtttctagtatagttccagttatcaagaaaaatggcaaagtcagggtgtgcattggtttcagagatttaaacaaagctacccaaaaggatgagtatccaatgccagtagccgatcaactggttgatgctgcttcggggcacaagatattgagttttatggatgggaatgcagggtacaatcagatctttatggctgaagaagatatccataagacagcttttcggtgtcctggtgcaatcgtcttgtttgagtgggttgtgatgacttttggcttgaagagtgctggagctacatatcaaagggccatgaattacatataccatgatctaatcagctggttggttgaagtctacattgatgatgtggttgttaagtctaaagagatagaagaccacatagccgatttgaagaaggtttttgagagaactaggaaatacggcctgaagatgaacccaacaaagtgcgcttttggtgtatcggctggccagtttttgggatttcttgttcatgaaagggggattgagataactcaaaggagtgttaatgcaatcaagaaaattcagcctctagagaacaagacagaattgctaattttgttagaaggtttattttgttagaaggtatatttctaatttgtctggaaggttagaaccttttacaccattgttgagattgaaagccgatcaaaaatttacttgggggcagagcatcagaaggctttggatagtattaaagaatatcttagctctcctccagttttgattcctccacagaagggaataccttttaggttatatctatcagccggtgagaagtcaatcggctcggttttgattcaggagcttgaaggaaaagaaagggttgtgttctatatttaagtcgtcggcttttggatgcagaaacaagatattctcctgtggagaagttgtgcttgtgcttatatttttcttgtacaaggttaaggcattatctattgtccaatgaatgcactgttatatgcaaggccgatgtagttatatatgttatcggctccgattttgaaaggaagggttggaaagtggatattttccttaacggaatttgatcttcggtatgaatcaccgaaggcggtcaaggggcaagctatagctgattttatcgttgatcatcgtgatgactcaatcggcttagttgaagttgtgccctggactttattcttcgatgggtcagtgtgcactcatggatgcggtatcggcttggttataatttcccctcggggggcaagttttgagtttgcttatactattaaaccttatgcaactaataatcaggctgagtatgaagcggttctcaaagggttgcaattactcaaggaagttgaagccgatgctgtggagatcatgggtgattccttgctagtggtcagtcaattggtaggagaatatgagtgcaaaaatgatacattaatggtttacaatgagaaatgccaagagttgatgaaagaatttcggctggtgactttgaagcatgtatctcgagaacagaatgttgaagctaatgatttggctaaaggggcatcgggttacaagccgatgatgaagtatgtcaaaatagaagttgccacattaacagccgatgattggaggtatgatgtgcatcattatctgcaaaatccatctcaatcggcttctcggaaattgcgctatagagctttgaagtataccctgttggatgatgagctatattatcggacgattgatggggtgttgcttaaatgtttgaatgccgatcaagctaaggttgcaatcggtgaggtacatgaaggaatttgtggcactcatcaattggctcaaaagatgaagtggttgcttcgacgtgcaggatatttttggccgacattgctggaggattgttttaagtattacaaagggtgtcaagattgtcaaaagtttggagcaattcaaagagcgccagcatcggctatgaatcccatcatcaagccatggccatttagcatgtgtttggttctgggactaggtgggataggatgaaaccatccctgatttgaggattgggatgattccattcgggtgtttggtttgaagaataggatgatcccagttttttgtttggttcaaggaacgagggagggatgggatgagcgccgtttacaaccaccgacaacgccgtttgcaacaaccatggccgacgccgcctctgccctcacctccagacgtggtcgggcgggcggagaagcgcgacgacgcacggtcggccttcgcgtagagcagccgcggctcgacgacgacgacggcggcgaggtccgcgcgggagagggagagggagaggccggtggagaggagggcgagcacggccaccatcgcggtcgggcgggcggagaagcgcgacgacacacggtcggcccgccgccgagttccccgcctccggatccgtcgccacaaccttccccatcgctggatccgccgccgccgccctacacaccaccggatccgc

SEQ ID NO: 93509 - DNA, 2886 bp, Oryza sativa
tcccatcccatcccatcccagcaaccaaacactagaggttggggaattgatatgatcggtatgattaatacaccatcgagcaaaggacacatgtttatattggtggcaaccgattattttaccaagtgggtagaggcgattcctttgaataaagttgattctggggatgctatacaatttgttcaagagcatatactctatcgatttggtattcctcaaattattacaaccgatcaaggatcaatcttcgtgtccgatgagtttgtttagtttgccgatagtatgggtatcaaattgttgaattcttcgccatattatgcacaagctaatgggcaagccgaggcatctaacaagagtttgatcaaattgattaagagaaagatttcagattatcctcggcagtggcatactcgattggccgaagcattgtggtcttatcggatggcttgtcatggttcgatccaagtccctccttataagcttgtttctggacatgaggctgttttaccatgggaagttagaattggttcaagaagaacggagttgcaaaatgatttgacagccgatgagtattataatctcatggccgatgaaagggaagacttggttcaattaagattgagagcccttgcaaaggctaccaaagataaggaacgtgttgtggtgcctaagtccttttctgaaggtgaacttgtttggaaattgattttgccgatagggactcgagataacaaattcagcaagtggtcaccaaattgggaggcaccgtttcaaatttataaggttgtatccaaaggagcgtacatgttgcaaggactcgatggagatgtttatggacgagcactcaatgggaaatatttgaagaagtattacccaagtgtttgggttaatgcatgatcggctggtgttgccgatagcatgatagccgatgtattcacatcaccttgagatggccgattgactgctttcatgactgccagattcagtcaagtctgcagtagccaccatggtccacctactccaactaccgagccgacagctatcttggccgatgcattgttcaacatttggtacagatagccgaggaggattttgcctaaggggaattgtctttttgattctagagcttcggctataaactgccagttggttgtagcaccacaactggatccatagaagaggaacttttctagccacatcagcagaaaggctatatgctctcgagaggtgactgaccctgtgcccatgtattccgccacataaccagaccaaccacctatgctcttggtcctgaagtcatattgattcttggtgttcagactcataggattagccgatgaggtcacatccagaccggtgatcatggtgatatcaatcaaagttggggtcatcggccttggttgaacagaaaagcgttgatggtattggaccagaaataggtggcagcggccattaagggttcatccttagctgaatttgctatggggagggcaagtgcttgaccgattccaattttgtcctagtgtgtttgcttgcttgctgatacacgcttgtaccatgtggtcaagagatggccaagacgtaaaagtgtttgtccagtgacctagattcgggttggctaatctaaaaggaatcctattggtttcaccgatgatgaactcagtgggatcaagatcaccgattggacctaggaaatagtgtctctcatgcgacaaacttgggattgcgaccagattggaaaggtaatacgaattcaaaaggaatagagaagaataaaacaagattagacgacgaaaatcgatctattgcgcagaaaaaagggatctagccgatgggcacgtacctcagcatactcggctgatggcgcgatagacgggctggcggaggtcaacatcgccgtgggcggaaatttggccgaagaagaaatcacctggaaatcgccttgcgcactgaggggatcgccagagagagagaggacggagtttgcttcggcggtgaaaacggaggaaacagtgtgaagtttctcggggacaacggttagtatttaaagcgctgggtaacagtcggaaaacggcaagtgcagatttctctcggagtcgacatatggcaaatccaaaacattatccaatattccggacttggggggcatgtgttaacgaccaaatttggtaatccaaggatcggagatgaagaagaaatcgagatggagatcatcccggaaatggagtaaagatcggctggagtccaaatcggctgcgaccaggatcggcagagtccgagttggacaaggttagcctattgagtcgaatccgacaatgtgacacggcatacgttgtcgggttgaattaatgtgcttcatgaggattgccacgcatggatagagtcctgagaaggcaattgtatctattaaattaggatattttatgtatattccttagaaatatgtttgggcaaaagtctgccgcaaagacttaaggtgtcttagagtttgttagagataagagtcgtgtccgacacggacttgttttgtaatctctggtataaatagaccccgagccccatgtaatcaaactaacacacgttcaatacaatctcggcacatcgccacccttttactttcattttgtttcgacgagttcttgctttcgggttgagctgcattggtttcgatcttcaacaagaggtaaaacttgttatggcggcttgcgttgtcgggattagtgcttccatctttatgatactctaatcttgtttatgtaattcgtcgagttatcatatgccttatataatctctggcaatatcactatctaacctccaatcggctaacgtctgttactagacggcagccgactaggttaaatatcgatgttgacttagattatata

SEQ ID NO: 93510 - DNA, 4640 bp, Oryza sativa
tgacactagccttgctgctcttgtgaggcattttgatgctctcaatgctggaggcaatggtgggggtaatgacgatgacattgacggagagtacgtcgaggataatttggaggatgaatatattgctgacactgaacaagatgatcgagatgctcgagatcgtcgacggctacacaacaatcgacgaggtatgggtggtcgccgccgacgcgaggtacgcaacaatgatgatgctttttctaaaattaaatttaagattcctccttttgatggaaaatatgatcctgatgcgtacctctcttgggagattgctgttgaccaaaaatttgcatgccatgagtttcctgagagcactagagttagagctgctacgagtgagttcaccgattttgcttcggtttggtggatagaacatggcaagaaaaatcctaataacatgccacaaacttgggatgctttgaaacgggtcatgcgggctagatttgttccttcttactatgcacgtgacttgctgaataggttgcaacaattgagacagggtgcgaaaagtgtagaggaatattatcaggagttacaaatgggcttgcttcgttgtaatttagaggaaactgaggacgctgccatggctagatttttgggtgggttaaaccgcgagatttatgatatcgtagactataaagattacactaatatgacccgattgtttcatcttgcttgtaaggctgaaagggaagtgcagggacgacgtgctagtgccaaggctaatttttctgcaggtaaaacttcatcatggcagacacgcaccactcctccggccggccgtactgcttctccatcttccacacccacaactagtcgagcagcacctcctccatctagtgacaagtcagcgacaaaggctgctcagccagcaccgagtgcttcttcaatggcatccacaggccgaatgagagatgttcagtgccaccgttgcaagggctttgggcatgtgcagcgtgactgccctagcaagcgagttttggtagtcaaaaacgatggtgagtactcctctgctagtgatttcgatgatgatacacttgctttgcttgcggctgaccatgcagataatgagccaccggaagagcacattggggctgcatttgcggatcactatgagagcctcattgtgcagcgtgtccttagcgcacaaatggagaaggcggagcaaaatcagcgacacacgttgttccaaacaaagtgtgtcgtcaaagagcgttgttgccgcatgatcattgatggaggtagctgcaaaaacttggctagcagcgagatggtggagaagcttgcacttagcaccaaaccgcacccacatccatactacatccaatggctgaacaacagtggtaaggcgaaggtaacaaaactggtgcacattaattttgcaattggaaattaccatgatgttgttgaatgtgatgttgtgcccatgcaagcatgtaatattctgctaggtagaccatggcaatttgatagggattctatgcatcatggtaggtccaaccagtactcttttctgtaccatgataagaaaattgtgttgcatcccatgtctcctgaagatattttgcgtgatgatgttgctaaggctgccaaatccaaatgtgagagtgataaaaaagcccaatctgatggcaagaaacctgagacaatcaatttgaaacccaaatgcttacttgctactaaatctgatattaatgagttgattgcatcaccttcagttgcctatgctttggtatgcaaagatgctttgatttcacttcacgatatgcagcattctttgccccctgctgttgctaacattttgcaggagtactctgatgttttcccaaggaagtgccaccggggctgccaccggtgcgcggcattgagcatcaaatcgacttgatcccaggtgcttccctaccgaaccgtgcgccataccgaaccaaccctgaggaaaccaaggagattcagcgtcaagttcatgagttgcttgataaagggtatgtacgcgagtctcttagtccatgtgcggttccggtaattttggtaccaaagaaagatggttcatggcgtatgtgtgttgattgtagagctattaataacattaccattcgatatcgtcatcctattcctaggttagatgatatgcttgatgaattgagtggctctattgtgttctccaaagttgatttgcgtagtggttaccaccagattcgtatgaagtagggtgatgaatggaaaacagcatttaaaacgaagtttgggttgtatgagtggttagtgatgccttttggtttaactaatgcacccagcactttcatgaggttgatgaatgaggttttgcgtcctttcattggaaaatttgtggtggtctactttgatgatatcttgatttacagcaagtctatgggtgaacattttaatcatttacgtgctgtttttaatgctcttcgtgatgcacgtttatttggtaaccttgagaagtgcaccttttgcacagatcgagtttcttttcttggctatgttgtaactccgcaggggattgaggttgatcaagccaaggttgaggcaattcagagttggccgactcctaaaacggtctcacaagtgcggagctttctaggactcgcggggttctatcgccgctttgtgcaggatttcagcaccattgctgcaccattgaatgcgcttacaaagaagggagtgcctttcacttggggcacatcacaagagaacgccttccacatgttgaaagataagttgacccatgcacctctcctccaacttcccgattttaataagacttttgaacttgaatgtgatgctagtgggattggattgggtggtgttttgctacaagaaggaaaacctgttgcatattttagtgaaaagttgagtgggcctgttctgaattattctacttatgataaggaattgtatgctcttgtgcgaactttagaaacatggcagcattatttgtggcccaaggaatttgtcatacattctgatcatgagtctttgaagcatattcgtagtcaagggaagctgaaccgtagacatgctaaatgggttgaatttattgaatcttttccttatgttatcaaacacaagaaagggaaggagaacatcattgctgatgctttgtctaggagatacactttgttgacacaacttgactacaagatttttggcctggaaacaatcaaagaccaatatgcgcatgatgctgattttaatgatgtgttgctgcattgtaaggatggaagaacatggaacaaattcgtcatcaatgatgggtttgttttcagagctaacaagctatgcattccagctagctccgttcgcttgttgttgttgcaggaagcgcatggaggcggtttgatgggacattttggtgccaagaagacacatgacatccttgctagtcatttcttttggccacagatgcgaagagatgttggcaggttcgttgctcgctgcgctacatgtcaaaaggctaagtcacgcttacatccacatggtttgtatatgcctcttcctgttcctactgttccttgggaagatatttcaatggattttgtgttaggattgcctaggaccaagagggggcgtgatagcatttttgtggttgtggatagattttctaaaatggcacatttcataccatgtcataaaactgatgatgcttctcatatcgctgatttgttctttcgagaaattgttcgcttgcatggtgtgccaaacacaattgtttctgatcgtgacacaaaatttcttagccatttttggagaactttgtgggctaaattggggactaaacttttgttttctactacttgtcatccccaaactgatggacaaactgaagtggtgaatagaaccttgtctactatgcttgggctgttttgaagaaaaatatcaagatgtgggaagaatgcttgcctcaaattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctggtgacaaaggtagaagggaattgaattttgaacctagagatttggtttggttgcatttgcgaaaagaacgatttcctgatttgagaaagtctaaattgatgcctagagctgatggaccatttaaagtgttagcaaagattaatgagaatgcatataagattgatttgcctgcagatttcggggttagtcccacatttaacgttgcagatttgaagccgtatttgggagaagaagatgagcttgagtcgaggacgactcaaatgcaagaaggggaggatgatgaggacatcaacaccatcgatacatccatgtccccccatgtacagcatgatggtcctattacccgcgctcgtgcacgtcaactaaattatcaggtgagttctttcttgagttcatattcctcgtctttataccccggagacgcgtgcactcgtgttttactcaggaacgat

SEQ ID NO: 93511 - DNA, 4434 bp, Oryza sativa
catttccagggcgcttttcgtccgagaggccgcgcggggcgcactcggcttctgtggcgacgacctcggggtcggagggcgacaggcgcggccttcccgcagtggccccggggccatcctgggggtcgggggcgcctggcaccatcggacaaacaggcggagggccagctccggccgttgggggcctcgggccgctgttcggctcgggggcctctcctccctgctctctcccgggtctagtcgacacagagtgggggtgcgcggagtgagggttgtcctcatcacgctccacgaccaacgccgcgctgaccacctgcggggttgccgccaggtagagtagcaacggctcatctggcttcggggcgaccaggaccgggggagaactgaggtataccttcaactgagtgagggcccgctcagcctcctccgtccaggtaaacggcccgaagcgtttgaggagcttaaataggggtagcgccttctctcccagcctcgatatgaaccgacatagggcggccatgcagccggtgacgcactgcacatccctaagcttgctgggggggcgcatccgctctatagctcgtatcttctcggggttggcctcgatgcctcgggcagagaccaagaacccgagaagcttgcccgcgggcacgccgaacacgcacttatcggggttcagctttatgcgggcggagcggagactttcgaaagtttccgctaggtctgagagtaaggtctcttggttgcgcgtcttcacaaccaagtcatcaacataggcctcaacattgcgtcttaactggctacccaaagaaattcgagtagtacgttgaaaagtaggacctgcattctttaacccgaaaggcattgtcgtataacaataagttcctatgggggtaataaatgcagttttttcctcatcctccctagccatgcgaatctgatgataaccagagtatgcatctagaaaacacaaaaggtcgcaccccgcggtggagtcgacaatctgatctatgcgtggcaaggggtaagggtccttaggacatgccttgttgaggtcggtgtagtcgatgcacatccgaagcttgccgttcgccttggggacgacgaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacatcggcgtttgcccgcaggaaggagacgagcgcgtcttcctatttgtcgtccagaagaccaccgattcgtgtggtcttggacgggccgtcgcccagggcaacctccttgaccgggacctcgtcgcacgtgatcatccgctgcctcggggcggctgggacggaggtgctgagcctctcgtcgccacccgcgggcttggacgccgcggcgaggtggtccgcgcgctgctccatacaagcaagcgcgactttgaggtcgccatggacggtaatggggccaccggggcccggcatcttcatctggagataggcgtagtgccgccgccatgaacttcaccaacgcgggcctccccaggaccgcgttgtagggcagactgaggtccgccacatcgaagttcacccgctccgtgcggaagttggcggaaccaccgaaggtgaccgggaggtcgatatgacctagcggccaagtgtgtcccggcgtcacaccgatgatcggctgggacggccggagcaccatccccggggccttgatggcgtcaaaggctgcgggggaaaggatgttgagggctgcacccccgtctataaggacacgccccaacttcacattgcaaacggtgggggaaaccaccatcgcgatctgtcctccccgagcaacgcacggcgagtggtcggtctggtcgaaggtgagggcaacctctgaccaccgcgcccgccgcgtcgcctcatgggtaggggccgcggccagaagctctcgcttcatggccttgaggctccggcgagaagcgtgagcgcacgctcccccatcgacggtggcgacggtggcctcgggctcctggaaccccaggtcatcgtcgccatcgtcgatgtcctcggcggtggccttctgcttggcctcacctcgtcggttgccggcgggagccaccggggccttgccctcacggcgctcctgcctcctctcctcctcccacttcctcgtccgctcagccaaacttttgaccgcgcggcagtccacgaggtcgtggagggaggtgttgtgcacggaacaccacttgccggtcgggcgctccctgctgggagcgccggcctccttctttttgtcgctcgcaggcctcccctttcgggtggcccgcgaagcgccctcgacggcgaggacgtgaccctcgtcgtcggaatgggccgacctcttcttcctcctcctgtcccgccgccctgaccgagcggcggacccgggggcggccgaagctgccacaccggaaccggaggagttccaggtccaggcctcctccttgcgagccacacggtccgtgagctgaaaaagctccgcggtggtctggggctccttggaggcaatcttttcgagcatgcggttgtgccgcacccccctccctgaacgcgtagatcaccccgtgtgcggggatgcatggtatggtgttgcggacttcacagaaccgctgcatgtacgagcgaagagactcatcgtcccctcgctgtaccgcgtgcaagtccgcttcttcacctgggcgtggatatgtgccttggaagttcatggtgaactgctggcacaaatcctcccaagagtggaccgacgcgggtggcaagttcattagccaaccccgcgcttgacctttcagggccatgggaagaaattcgccatgaccctgtcgtcacccccggcggcctcaatcccggtcgtatagatctggagaaactcggcggggttgacgcttccgtcgtatttttcggtgatggtgggccggaaccttgggggccaacggacgttccgaaggctcgccacaaaggctcgacagccggcaccgcctaccggggacacgggaggctggcccccgtgcccggaccgaagtggcgctccggacgaggaagcgccctccgttgcgtgggcagcacgacgaccattgcgccggtgctcgatattgaggcgggcatccggtcccccacgcacatcttcttgggtcggaggcgttggcgagggaatggcggacgaacggcgggtaacagccgccgctcgccgcgccctccgcctcgacgacacggagccggcggtagcagcgccagaggccttggtggcggaggaccgcccgccggtgcctaggcgctgctgcgccgtcatgaccaagtcggccacgtcgtccagccaacgtcgggctggagtctctggatcggggacgacgggcgggtgacgcaggagcgcgcccgcagcctggagcgcgccctggggcgtgctgccatcgccgtagacgaggaggcgacgctccccgtctcgccgtccttctccattgcccgcgggtggcgaggtcgcggatctttcgacctcctcgagcgcctcctcccgcccaagacttcggcgagagggggacggtggagtacgagctcgacggcgcgggttctgctctccatcgtcaccgctagcgctcggagagaggttgtgcgccactgcccgttcggccattgggctgagcgggagaagcttggcgcacacgaaagaggacaagggcttagaaagacacacacgcacccctacctggcgcgccaaatgacggagcgtggggctcctcaccgggagaccgcgcaggtccccctttgccggttcggccgggggcgctaagtgaggttcttagccctcgatctgtggaatgatcgcgagagagcaaatgcacgagacacgggcgatgtagacaggttcgggccgctgagaagcgtaataccctactcctgtgttctggtggatctgtgtatgaagaagttacaaagagctggggaaccagagaattcaggctctagaacccctctattctccttctggatctggatccgggatccccctcctcggtgggcaaggtcctccttttatatctcaaggggataccacatgcaccacttttacctactcttcttttgggtggggacccatcctatcttgaccaaaacttggctcgcgccttcgcctggaagctaaatcacagcttgtccttgagtgagggccagcgccgtcactcgcctgacacaggggatacccctgtcatttcttcattaatgggtggagatttgcaatggatgctgtccgaatgaccctccgatgggatgggccatacctaccccca

SEQ ID NO: 93512 - DNA, 808 bp, Oryza sativa
ttggcaaggggatgaccataagaaaaaaatacaggctcactaggtgggatgttgtttgtcaacccaaggaccaggggggtcttgggattcataatttggagatacaaaataaatgtcttttaagtaaatggttgtttaagttaattaatgcggatggggtttggcatgatttattgaagaggaaatatctttataataaatctataacccaagttgacaggaaacaaggtgattcccatttttggtctggtcttatgaatgtcaaaagtactttcttaaatatgggttcttggattgtcaataatggggaacaaatcagattttgggaagatagatggattggtaacttggcttttaaggataaatatccatctttgtacgcaattgttcggaggaaaacatcttctattgccactgttatgggatatgttccgcttaatgtttctttcaggagagctttagttggtcagaatcttgtttgttggcatcagttgtgtgcctctatagtacatattcagttgaatgatttgtctgatagttttagatggaatttccatcagaatggcttgttctcggtgaggtctatgtacctagctttaattaataatggctatatcgagagaaacaagtgtatttggaagcttaagttgccacttaagattaaaattttcatgtggtacctgcttaaaggggttgtgttaactaaggataatttggcaaggcgtaactagaatggcagcttgaggtgttctttttgtttgaagaatgagtcctatccaaccatctctttatggattgtcattttgcg

SEQ ID NO: 93513 - DNA, 1332 bp, Oryza sativa
cctgcagcccaagttggaggcgctggataaaaaggcagagactgttctcctgtctcaagaggaagttgatattagatggtttttcaggagtaggttatctgtcattctaagggaagaagaaattaaatggtatcagcgggctaagactaaggatattttagagggtgactctaatacaaagtattttcatttagtggcaaatggaaaacataggaaaactagaatttatcaattacaggagggtgatcatttaataagtggtgatgccaatttaaagtcgcatattaccacttgttataaaggtctttttggccctcctgatgagtctgaccttcagtttgatgagaattatgttgctgacattcctcaagtttcatatttagagaatgaagccttaactaaggaattttctgaaaatgaggttaaggatgctattttccaaatggaacataacaaagctccgggcccagatggatttcctgctgagttttaccaagttttctggaatgtcattaaatttgaccttttagagctatttaaggactttcattctgggagtttgcctttatattcgcttaactttggtactatcattcttttgcctaagtgtgctgaggctttaaagattcaacagtatagacctatatgcctacttaatgttagctttaagatttttaccaaagttgctacaaatagaataatggatgtcgctcaaaaggtaattagtcctactcaaactgcgtttattcctgggagaaatattatggaaggggtggttattttacatgagactttacatgaattacatcgcaaagataaaagtggtgtaatttttaagattgattttgagaaagcttatgataaagttaaatggccttttgtacaacaaactttgagaatgaaaggcttttctcctagatggtgtgaatggatagcttcttttgttcaaggtggtcatgttggtataaaagttaacgatcaaattggtaattgttttcaaacttacaaaggacttaggcaaggggatcctttatcccctattctttttaatatagtagctgacatgcttactctattgattaagagggctaaagaggcgggactcttgaatggggttattcctcatcttgttgatgatggtgtgtctatcttgcaatacgcagatgatactattatctttttggagcatgacttgcaacagacaaagaatttgaaactgattttatcggtatttgaaaagttatctggcctaaaaataaattttcacaagagtgaattattttgctttggtcaggcaaaggaatgttatgaacactattctgatatttttgg

SEQ ID NO: 93514 - DNA, 2187 bp, Oryza sativa
  unsure (1)..(2187): unsure at all n locations
tcacaggtaagaccacctgtgacgggcccaacgctgggggccgtcacaggtgaggtcacctgtgncggccctacagatagagcccgtcacaggtgagtttgcctagagcaattttattttattttatttcacttagttcttttattttccttaacatattttcacatacactacatatttttttatacttaattattttatttgactatttcataagcaatatactattgatcattgcgtacatattagagtcatacagataacagacatgtagacataaactacgtacataaattacaaaaataatccttcctcatggtcgacacgtgcatattgaacttcatcttcttcttcctcctcttctagaggtatttcttgacctatgccgtggacgtgctggttgtaatcatcctcgtctgcaatgttctccactccaacaattctccttttcccttcacgaacaacatgtagtttcttgttacatgggtcaactatgtagaacacttgaacaacttgtttggcgagaacgaacggttcatccttgtacgcgttgttagccaagttgacagtggtgaaaccttcattgtcaacttttacattgcaaagatcgacccatcgacaatgaaacaacgggactttgaacttcaagtaatctagctccaatatttgctcaactttaccatagtattgatcacgacgaccaccgtcactagcagcctcgatgcgtaacccactgttctgcactgtgcatttgctgtcttgctttactgtgtgaaaggtgtatccatttatgtcatatccttgccaggtggtggcactccattcaggaccctgtgacaaccactgaagtgtttcactagacaagttctgcaacctggtaattcggttcttcagccactcgttgaaagaagacatgtgcttattcctgacccaactctctgatcggcctaggttctcttgtcggataactacaaggtgttcatcaacgtacggcaccacctcagtcatatgctgtagtaccgtgaaatgagctttatcgtacaccttccgatccaacctaatagtctttcttccaacagtaccaacaccgtcaagcctcccttcatgatgagatcgtggtaatccaattgaagatgtttcagacatgtagtccacacaaaattcgatggcctcttcggtggtgtaactctcgatgatactcccctcggggtgtgaacggttccgtacataacccttaaggatccccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctgcccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggtgttgagaccatcctttgtagtacctgggttaagcagtattcccattaaactctcgcatacattcttctcgacatgcatcaaatctatgcagtggcgaacttcaagatccttccagtatggtagtctccaaaatattgacttttttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtattctgtgtccattgaaattctttctcatattcctatacgggtgacaccttgggagaaatctcctgtgacccatgtagaccgtcttgtgtgaa

SEQ ID NO: 93515 - DNA, 829 bp, Oryza sativa
caagcatgacttgccttgctctgctgctggaggaacctcggcgactatttcgaagtacgccggagcgtcggaagagccggaatctaacgacatacaaggcaaacaatgcaaacaggctataagtctactgaaacagagaacaaaaccatttttaatggattctacacatttttcttgatttactgagacttgaaggggcttaaacggagctcggatgaattagttatgaatttcagaagattcactgtgtttattactataacaaaaaggccttaaataatttattgggcaataattcccagggctgacgtcatcaaggggggggcggcgccgacaggcgggtcccaccggtcggtggctcgcgagagagggggaagggcgccggcacacgggccccactcggcagtggctcaaggggggcggtccaatgtggaccgggatcacgcgggtggtccaccgccggtccacgggaccgacggcccagatcggccctgagccgatcgggcggtggcggtagaggcggccgccgagctcggctcggcatcaaagccggtcggccagccatggctagtggcgacggcacgcggccgacggcgacggcgaacggcggcacgggaggcggcggcggcggccgaaggcgacggcgcatgacttgaagcggcggcgcggcactaggagggagaggaaggggaaaagaggggagggatgcctcaccgcgagtggccggcgcggagggagacgatggctaacggcgatggcgagccacgggaagacggcggcgacgggcggacgagcttcgggatgccctaaggaagcaagagagagagat

SEQ ID NO: 93516 - DNA, 3081 bp, Oryza sativa
tccattgtcctctcctctcctcccgatggcggcagcggcggcggcgcgcggcgacagccgcggtgggcgtaggcgcgcgccggcttcctccacgttgtggcggtggagggcgtgggatccggcgggcggcggccgtccctgcacggatccaacggcggcggccatcaacgcaaaaatccagcggtggcggtcgtccccgcacggatacggcggccggccgccctccccccgcgtggcatccagctcccctcccctcctcttccttccctccctagatccggcggaggggaggggcgtcggcggcggtgcggccggaggggagcacagatccgaggcgagcggcgtggaggccgccgctgacgatgatgatgacgacgaggaggcggcagcggcaagcaggagcggcggcgccaccaccagattctagggtttcatttttaaagaaagtttatgttttttcgggtttttgttttcccgtgggggtgcgccacctgcacgcaaaaatcgtcattttcccagacccctaagtgcatgcgggccgtttaccggcacgcaaaaatcattttagccctgacacaaaaatcttggttgtagtagtgaatggtgaaagtgaaggtggaaagtgagagctaggtgtcaacacgaggggtagaaacgatttaaaggagttggcagtgatttgacgctgtgatcccacttgtacttcactcaacctagcatgagtggctgtctagtggccccttgtagatgtttcctatgagaagatgagaggtatggtgaagtttgggtgtaaattggactttaactccctctctctctctctttctttctctctttgaaaatataatttaggatcaaagagatgattcaccaaggttttttgctgtgtttggacgacaaatgggcccatatatagatctttcctagaaggcttggagtggtagagtggcattttgagtggaaattgaatttaaaccgttctctcaccttttgagaaataaaaaaaaattaaatgagagaagagcagatgatgtgttggctatggttgtatgatgagtgggccccacaaggacttggtcccacatttaagagagatgtagaaggagagaactagaagctctaaattttccatgtgttggcattatcacactaaactatattactctctttctctcatacatttaatttagaattaggggggtgggtggggggggggtgggggacagggagacggcaaggtagacaaggatttgatggttcaaggtgccaagttccaaagtttacgtaatttatggctcacatttcatgtggttacattttgaattagactaagccattgcaccagatggtaaagtatgtttaacattctgaccttgagattttgctagaggagttatggtttaattttggtgaaggtgcaaactaggctaattggtatgctgtttccagatttttagctgtgttgaaggatttatttgggttatcaattgatgtgataaattcaaactaaaattgctgggagcttagggtgttgtttagtatttatgagaattttggtgggatttattgttgcttcatttatttttaggaattttctttagacaaagcatgcatatgcaacctatttaaaatcctcttcctaccttttggctgaaaccatggctgaaaccaagccaactcctatccctctccacgcaggcccaaaggccagccgggtaaagtctatctcttttccctcccctccctaaaacgaagccaacaagtctagtttacatcggtctacgaaagagccccagtccacccctgcctctgccgatgtcgttggtgctgatagatgcgatgcccacacctcagggattcgcgcgccgtggtgtgcagccggtgaatcttctgccgcctcctgtccttccgttgtctgacgaggaatggttttaattctcctccgatttcccccattgctacataagttagtgattcattggtagatctgcttgtggttgaatgtacaaggatgcttggtagatctgactgatgttgaatgtgcaagaatgcaagaatgaatggagtgaactaaagcatatgtcctggtatgcatatttcaaagtactgcgcatatgtgtattataccatattgtattatgtacttatgctatgaaattatatgtggaatcctccactgcatattttctcttggttaattagtttaggaaaaattgcaaatatgatcttgtgagaatttgtaaagtacatagaaggccatttgttttgacaatgaagtatggtttgttgtttgttgatttagatctccgtaatactgcctaaatttaaatgtatgtttggtgaactgaaattagatatggttagtgctgtcataattttttaatgactatttgtccttgtgagtaaggttgccattcctcggctgtattgcctttagcgtggctatatgtctcccaagactaagaatacaaggaatgtgatagcagccgagaaattgaccatgtttcctcccccctccctttgctttcctagtaggattcggaatactctttggcatgacaatcttaattatctcccatagtctaaaactcacaaaaacatcagaaatccgctaagaataaattaagtaaagaacatgcacacacaaataataataatcatgttgcattaaattgctaaggtcagagaccaacagatgacacattggatagtgctatggccttattaaaagtagcaagagaaattaaatatgcttgtgagcgcacacatgcacgacgtacaaatagttgggaccaacagatggatcgactatagatcgctccatatggtcaacaatttattggagataaacattaacataacttggccataacttgaagcaaaacaacatattcttatgaaaggcattaagactggtagcaatgcgagtatgttgttttaggcttgtccttccatcttagcaagaactcccatttcgtccatcttagcaacaactgtgaaattaaaatatggaaatcacattagcgcattagttaattaattttgtagtggaagtagagcattaattgtcttcatgttgca

SEQ ID NO: 93517 - DNA, 1110 bp, Oryza sativa
aactggtgctccccacggtgaagtactgggtctgatatatccttcctgaagcaaatcatccacctgtctctttacctctgctaactcattagctgccattctgtatggtctcttatggatagggttggttccaggtactaagtctatccagaactctatgtctctcttaggtggcatacctggcaaatcctcagggaacacatctggatagtctcgtactattgggatctcttgcaaagcaacttgatttaatgtcaaaccgtgagatttaggggatgacacaaagaaagacactgtttgcccattgctacttgttaaagtcacattacggttagcacaatctataactcctatgtgatgggttagccagtccatccctaagataacatcaagatcattggattctagaaagataagtgaggatgggaaaggtatttcttctatttctatagtaacggaaggacagtactgcgttgaggatacttgattgcctagggtattaactagtaaaggtctcccaagactaataacttccatcccatgattgcccgcaaaacttttagacaaaaaggaatgtgtagcaccggaatcaaaaaacacagttgcgggtatagagttaataggaaacgtacccaaaaccacatcaggtgcattctgggcttctgcggctgcaacatgattaacacgagccttcggtgctggagcattggagttgttctgaacaggtgcattcttcacacgccgaggcattggacacttatcagcataatgtcctggatcaccacaattgaagcacacccctggcttgcttccctgttccttcctgacaggatgattctgagttggagctgctacatgacgagtgaccatattacgattatcgttgctgtgattactagtgttgttgttgtagaactggcgttgagggcgagcaactgaagaggatcctccctgtgggtatggtgcagcttgaggtcccaaagcaatgcgcggcctctggctactacgctttttctgttccatcctattatacttgtcttcttggcgaatcgccttgtccaccaactactggaaatcccggtaatccatagccatcaatgcaaaagacaa

SEQ ID NO: 93518 - DNA, 1271 bp, Oryza sativa
caactccctccgtaggtgctgccgccgcccgtccgcccctcctcatcgccgggttgtcgccgccaccttcatcctccgctccggccgccatactcgccggtgaggatcccctctcctccctcttcccctctctcttgtttgcgccgcctctcttcatgcgctcgccgtcgccttcggtcgacgccgccgtcctatacaccgtccgccgtcgcttcccgcgccgccgattgccgtcgccggcgaccgtgcgcgtcgccgccggttgccatggccgccggtcggctttgaagccgagccgagccaggccggcacctccctcccctcccctttgagccaccgcctggtggggtccacccgccgggtaccaccctcggccccgtggacttggtccacggtggaccgacctcccccttgagccgctgacccgtgggtcccgcatgtcggcgccgcccccttttggatgacgtcagtcctgggacttattgcgcaataaatacatcaaggcttctcttttatagtaataaacacagtttatcttctaaaattcataagtaattcatccgagctccgtttaagtccattcaagtctcagtaaatcaagaaaaatgcgaagaatccattaaaaatggtttggtttcctgtttcagtagtcttatagcatgttttgcttgtgtgctttgtttgtcgcgtagattttggccgtttcgtcgatccgcggtttctcgaagacgttgctgaggtctcattagtgcgagagcaaggcaagtcatgcaatacgttgatcatattgtacccaatttaccaatatctcgcatttctattaaatgttgcattcttttacaatatcacgtgggatgggtcctactactcagccatatattgatttccttatgccattggcaacttgggttttaaaatgactagatgttgatttaggaaatgcttacccatgcttagttctactagtacacaaaaggggaatcacattaaagcattgactttgattattggcaatagctttggattggtgccaccgcaatggtgttagttaattaaaatacactgaatggtgggctgtgggtgcacggttttgctggtcgcaccgtggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcagccggggtgtccggttgtcca

SEQ ID NO: 93519 - DNA, 622 bp, Oryza sativa
gggtacacagagacggtccacgggtcgacggaagcggatcccgtgtgtcaaccgaggcgagtgaccgacaaacggactccactagacaccacacgggttgcacacgtggaaatcacgcggctaccgagcgggcacactaacacggtcaccacacgcacaagcgaacgactaccgacaccggtacacgggtaccggggtcgacaaccgcacaacgggtacggcgcgacaccaaaaggacgaggacggggaagcgagaggacggatccttaccaccacgcgacgaggcgtgggaacgacaacgacgaacgggcgcggcggagacagctcggggatgacggaggcgaacggcgagggaacgacttcggcggcgatccttggacaaggcttgacgacgcggagtcgaggacgaagacgaggacggggctgccgcggcttgcttggcggacgcggacgacggacgagaacggctcgacggagggacgaacgccacgacgaccgggaacgacgagaggacgacgatgatgaccaccggggccggtgaggaggcgacgagggcagccagcagcggctgcacggagaagaggacggcgctgaacacgccgctgcgatgacgatgacggtg

SEQ ID NO: 93520 - DNA, 626 bp, Oryza sativa
tccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcatt

SEQ ID NO: 93521 - DNA, 5963 bp, Oryza sativa
  unsure (1)..(5963): unsure at all n locations
cagacgatccaggtggttggcgagcaccctcgtttttaaaacggcgacgtcgacgtgaggcgactacgacctcaacatcgatgtccatctctctctaactttgagtaactgatatgtttatctacatgttagagaacagtgagtgcatcagataagtctcggttacgtgaccctgtcacggaagtcgtaaatcctccgatttactgtcatctgactttgaacgattgacgccccacgtgtcagcgactcgctgtagagaacagtaaatccgaggatttacactggtggagaaaccctttgtagtcccggttcgtaacccccctttagtcccggtttccaaaccgggagtaccaatccggaagtaaagatcgatctttagtcccggttggtaacaccaaccaggactaaagatcgagctgaccttttttttttgcatgcccctgttgctgcatggtttatatatatatataaaccatgcatatatatgtttcaatacatatatatgcatacatatatatgtatatatatatattatattatattatatgtatatacatgcataatatatatgtatttatacatatatatgttatgcaaatgcatatgtatatagatatatatatgaacaaaatatatttacattatagaaaagtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttaaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgatggaaccgataccaagccctacatggagtttaaagctattattcgtagtagcaattaacataacaagattttcttaattaacaaaggaacttatgacggtacctgtctataagttcgaaaaccttgtcaaacgtagactctttnttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcaatgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccaatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcagcgtcaactttcgccttctttgttgcccttgtgtgggcaagcggtggagctgggggggcccttgactttgaaggtaccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaactttgaccttggagtatcctgctggaatcggcctggagtggtaagtacctgaagggtccgttgggatggccatgcccgacgccaccttcatattgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctactcatccgactcctgtacgtgtggatgtactccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaaggatgaatgtctcgagcattgtggtccacagcatctctttctccgaatctgggacaaagctctcatgatcttcgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgttaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcgtttctgcaagatacaaaaaaatgtattaggataaatgcgaagtaacatatatatatatatatatatatatatatatatatatatatatatatatatatatatatatacatatatatatatatatatacatatatatatacatatatatatatatatacatatacatatatatatacatatatatatatatatacatatatatatatattgacggagcttggggctcctcaccgggagaccgcgcaggcccccctttgccggttcggccgggggccctgggtgagattctaagctcctagtctgtatgtggaaggttcgcgagagtagaaacacacaagacacgggcgatgtatacaggttcgggccgctgagaagcgtaataccctactcctgtgttttggtggatctgtgtatgaagaagctacaaagtgcgagccagcccccgattgttctgggatcctttttctctctctcaaatcccctcttctaagtgggcaaggtcctccttttatatctcaaggggataccacatgcaccatctctccctctctttcttttgtgtggggactcatcctctcttccctccaatttgacttctcttcattgatggacggagatttgtatggctgccatccgaatgaccttctgatgggacggcccatacctacctccacttccgccggaagcaggcgcgacgtgggaacatggctgtctgctgacgacatgaccattgtcagaccggtctcaaatcggtcattcttgtacaccacgtgtcagtttaac

SEQ ID NO: 93522 - DNA, 11760 bp, Oryza sativa
tgcaccccggattaaaactctccctaatcaattttggaattagccaaatgaatcaagcggatttgagggaggaaatggctagggttcacggaggagagaggaggaggccgggcgggaggaaggagacgaccgggcggtgggacacacgcgcggcgcgcggtcagcgcgcggcaacggcgcgcacgcgcgcgcacgtgcgcggcacgggcgggagggcgccgctcgggttgggcccggaggcggcccatgtgggagggggcggggaggcttgggccgagaggcggcccaggacgagaggagggcgaggaggcccgggagggagaggggaggggagggagctgggccgggagggggagggaaggcccaagagaaggagggagagaaggagagggagagagggaggaagagaggactttggccgcgggccgagagagagagagagaggactttgggccagacttggcccaaagggaaagagagggttatttttaggtttttctttttaataaactctgataattgtttttgttgcttaataattatttccggtgctctgaaaattcaagtaaaatttgagggctccttttagaccaaggagaatttaacaaaaattctccggaccacattcgaatttttctggcacgtattttagtgtttgtcaaattcttttcgaattttaattaattctattattccttttagggaatgatttttatttcgggatgaatttatcaggatgtgacaagcatagagataagataatttattttctgctcttaacaattgcaaaagtactcgagtagtaaactctgatccgtgaaactttgttctattaatgacgaactcatgtcactcgtatgcatgtctgggaagcgcctaggccaactcccggtgcttgggggctatgactagtcgggcagagtgtttaaacgtaaggagtcatctgctcggggaaatcaagattgacgagaggagaaatacatatttataaatattttaaaatacttgaattttcctcgagtattatatttacatcagatactagtcatcctatatgtttgttctgcaggatccagatccagatatgcataaaagggattcatggctttaagcttatctcctacaggaatagatcagtcagaacataaccatcggcttgccatcgtcgccgccgactggtgtcctcgcctatacggttgggtggccacaccgccgttgttgggcgtctttgtcttcaccgactggccgcctcgtccgccaccaactggtgttttcgcctatatggttggttggttacaccattgttgttgggcgtctacgtcttcaccgccggcttgccttcgccaccgccgattggtgtctccgcctgcacggctggcctattatgccgccgttgtaggacgtctacatcttctccaaccggccacctcgtatgacgccaactgttgctatcgtcttcacggctggccacgtcgcagccaccgcaaataggcgtcatcaccttcaacgcaagctgtctacgtctgctgccgactggtttcttcatttccatggctgtaagattctgccaatgttgattggccttatcgtcttcaccgccggtcatctcgtctgctgttgactagtgcccttgcctctacggttggtttatactgctaccactactgatggacgtcatcgttttcattgctggccgccttgtctgacaccgactggcttgttcacttccacggttgcgcgccttcgtcatcattgactggcgtcatcgtcatgatcggtttacctttgccgccgcccatggtgtcttcgctttcatggttggtctattttgccgccgttcaaggacgtcttcgttttcgtcatcattttacttcttccatcgccaactggttatgccgccgccgacttggtggagcgacttcatcttcattatcttcggaaccggcaaaccctattgcctcaacttcgcaagttttgctacttcaccaaccacgacgtctacaagatcttcgacatctcggcacacacttccagattcgacgccgtgatattctactacaacaagtggttctccaattttcaagaattctagtcggacatcttcaacacgtatcttcactcaagtaaagtctactcgacgacaagctacagttctcgactctatcacctctgatgagcaatatcatcttcatgttggtcatttcatttccatgccgactgcgtcagctattgccaatggataattttgattatgacagaaggacaagctataaatgctcaggggcttatcaacttcaacacaaggatcataccttcaagttggattttgttctgagattattttctatgctcgaagactggaccaatcattattccccgtaagggctatcaaccgaatacttgcgccagtcgggattcaatttttatatctattttggagtatcccataagggataatcactcagatcagaagctattcatatgagctacacttggtctatatcaaccggaagaattattactcgggagcatgttatatgcgtcatcctttaaagggtgtcgaaggcatattttttgtcctagccctaatatgtttgcagcccatatttttaggtgtggcctgtcacgttcttttagggacttaggtactttttgcttcggccaaagtgcgcgtgatcaagtgcccaataccttaaaatccttttataccacagttattcaactttttaggagttggtacaatgcactttaaaaggtgcccaacagtgaagtttttcatagctgccctgctgacttttttatatagttaaggcgctgtttgggtttatacagcaattgattggatacaatatcattgctttttgccacgtaagtgtgcatttttattgaccaatattatggcttaggctgattatatattgtggtcatttttcaggcgattggtaaatcctttatgagtttatttactcggattttataccacatatgccgtgtatttccaggtgtggtgaaaccatgtgtcttttagggacttaagcacatttgttaaagcagtgtgcgcattgtgtgtgcttaatactttggaaatttctttattcgcagcatacaagcttcttttataactgttttgctatatgaattttccatgatgtacacaactttaggttgctcgcatcatattttacaaagcaatcggtatatcactcggatcatgttgttcggggattcacgatgcatatgctatatattaatattaagtcacttggttgactataattattaaaaacctttcagttggttggattatttattccttgactatatgctttgtttgttcaactaaccacatagtcgggggctacacctattaggtgcatctagtcgatgcacctgactttatttttcagccctccacagtcttctgatttggtaaaagtactcgggagatcatggcgaagatgattgaagcactaggctttggagtaatctagtccgagagaagattatcttttcgactgtgaaggtctcaggggctactgtggagattatgggtaccctatacccacacggcatggttatccgactggttataggggataacttatatctatgaaatatgtaacggatcatgacttgggtattacgtttccatgtatattatggtacggcctaaagtcctggtttgataagattgtaaagtagatttagaaaaccgataccgtattggttaaggtttctatcttgtaatcctgccccccatcttatataaggtgggcaggaggccctctagggggcacatgccacaacctgatcgtcagatcaatacacacccggcggattcaaatccctaaacaggagtagggtattacctctcactgagagggcctgaacctgtctaaatcttttgtctccgcatccatccacttttaggtctcgtgcgctatcccttttattattgccgaattcatgtttcgacaggtattataccttgattatcttaatttttataagtgcctgatttcagcgtactcaaggtaaaattcaacgcgattggagcaaacgacaactgattctagtggtttatttgctccatcggactgtcgacctacacgtgcatgatcatgtaaccaatatacaaagagggaattagtgttgcatgagaagtctattgcaaatgacgaatgattaaacgttatacgaaaatcaacaagattgtcatactcatacattttaaaacggaaggagtatgacgcagtcttagtctttgcgatcggtttgcctctctcctgcacgctgcgtaatatattttctagaagcaatttggaggccaaaaagggtcctagttgacccgatcgcgatattgtcagccgccgctagcatgcagtgatcaaagatccttgccattaattaagtacacagtagtacctttaattgattatattatggttaagacatcgaacgcacgtatacctaatcaaggtaaacacacacatagacatcaattaattctctccatgagcatctttaaaaattgaatctttaatctttatgttgtgttattctccctattttccaactcatttatcttatttttcacatccatgctttccaaaatgctaagtgatacatttttttaaaaaaaattctacatgcatattgctttaaacaatcctatcaatctatttttaaccatttttaactaatacttaattaattatatattaataaactaatatattcttcatgcaaggaagtgatgttccaaactccactcccaaaagcagcattggattaaggtacaaagtcatctcatatagataaaaaggaagtgttttacataaaaacgaggtagtattaatgtataattaattaggttttaattattataaacttaaaaaatatatttatctaatattttagagcaacttccgtatagaaaattttcgcactgaatgtaccatttagcaatttgaaaaacgtgttacaaatatccaaattttcattcaacctttgtaacaaaacccaaccctgaagttggtagttgcattaattgctggattattctcctgtacgtcgtgctctgcccgttgtcgtcttcacttcgctatctcgtcttctaattaattaacggatttactaattaattaagcaactcgatctggaagatgccttcctgccccacgacccacgggccacggtattcaatctgacccacgactccgacagacggtatacactagctacgacacattccatggtacgtgattaatcaggtggtttatactaaaaggaggaggagaagaggaaagatgttaaaattcgcagataattaatcaagcacaatttagatgatgtgaaatctgcagctcattgttgtccagttctcactttcgctcgacgtggcaagacacaacggatccgagcaataatccactaaacccgccaattaaccatcctgggaacgacgagcaccacacatattcttggtcgtcgtgcagaaaagtacagtgaaggaagaaaaaacaccaaaatactttttcttgctagtacgcaagaaaaagaacggaaagcaacactttaatgcaagtggtcagtatttgattagcttatagtataagtaatctttttcttttgtcccttctaaccaactctgctcctccatttccaacacatcctcgatcgatcccctttcccctcgtgtgggctctacattggaggaatcgagtatggctttctttctttgacaaaaagtagaaaaaataatcagccccatcgtttggcctaaacagtcaaagaatatgccaaaatttagattttttaatttgattttgaaatgcttttaacgtaatttttgttaatgttggcttttaagtcgcgacgaacaaatctacaaaagttttacttataaattaattttaattttttaataagccaaataagccattttggaaaaaatgggcaaccgatgggagccaatgcatatataggcgagacaatgtcggcaatcacttttagatcattcggtcagaaaaattcgtaaacggtatatccacccattggacacgtgacgatgatgtcaacacatgttcggcaaagaaaacaaaatcattgcattaggatgcaatgattttctaagtttaaacaaaccgttgttgttggctgttcgtaaggcttcattgaccatctatacgtctatattttatttttctttataactttagccgtcattagtcacacactattctattttttagagggagcttattagatctatggttagttcttctaatctggatagaagatcactagttaagacgtaaacaggaaaacatatatagcagtggtggatacgtttacaataaattataaaatatttggtattgaatgaaaagtgattataatgttggtctatttgtaactttaatccatatgcacaatctaaagtaaaatacacatttaaagcttgtttgagagtttagttttatttctcaggtgtaaaataaaaacacctgtagtttggtgtggcccaaaaataccactgaaaaagagctgaaccctactcagctctagcaagcaagcatgatttgcgtaaaggtcataactgattttttttaaaaaaagagtataaacattgtcatatacagaaattttaatgagaaaccaattgaaactacatcaaaattatacacagaacatgaaaattatggtcatccaaacccttaagagtagctgacagcagaaacacacaagagatcgaggcatatttcataaatttgtgaacataatcaactgaccccatttcacaagcacacaagaaaaatctctcatgtgttctgtgcccatttcgcaacctcgatatctcgtgtttctgctgtcagctactctgcgaagtggggacaatcggaggtatatttagtgggctacgggccatccaagcaccacttgtacattaaaacctaatggaataagtctatcctccctccctcatcacccttgatcaaatcgtctccctcagccccaaaaccgggtataacacctcctccatttttgaaaaccggtgcaaatagactcctttggtggtttgggaagcggtttatgcaagtggggcccacatgtcggtgagatatgaaaaaaaaatacggtgggcccacatgtcaagtccttttttttttcttccccacctctccatccttcttctctccctctctcttcataggcagcagcaggagagcaccgcaacggcgcggtggatgatgagtcgacgacgcaaacaccatgaacgctatcgctcggagcagagacgtggaggcgtcgttcgccgggttgccgactggcgaggatgacgatgacgacaacctactgtagcacgggtgaatcccgtcgatgtatggcgcctcatctgtgacctccacgaacctcaggttccaaaggagcgtcgtctcccccgccatcgccttccatagttgcgcgacgaagctgccggtggagaggaatgagaaggtcatcgctgaggcccctgatccaaaccgggggagagagaaaggtggaaacgggcaatgacatgtgggccccacccgctgactcaacaagtcaaccgtgatcaacctgccacgtcagcaaaactactttccaaaccatcaaagagtctatttgcaccgtttttgaagacggaagaggcgttatatctggttttgtggctgagggaggtaatttagttagcaacaagagataagggaggcaaaatggacttattccacacctaaaaaagatttaggctggtattttacattgctatttggccacaaacagggcttccaagttggcccttaataatgatattttcaccggcgcctccactccaatctgtatgtacggcactggaaaaaacgacagaaaaaaaaataaaaataaaaaccggaccacgtccacgtgtacgcgaaaaatccacaaatagtagcgaacacatagtactgatcaacttgtggagctcgatcgatcgctgtccagtttcgcgccacgtggcaattggcaaagatagagcgtatgacatcggagcaagcaaaccactcgctaggctagctatcaaccttagcagccaggaagctgggatcgagaagcaaggagagagagagagagagagagacagcatggaagcgccgccgccggcaacgtcgagcaccgtgtgcgtcaccggcgccggcggattcctcgcctcgtggctggtcaagctcctcctctccaaggaccactacgtcatcaacggcaccgcgcgacctcggtaagaaaaccttcgattttatctctgtaagaaattttctgaaacgaaggatcgctacaagtagtacaagatgattgcaataattttttgagctataaattgagaaagtatcgtgcaggtgagggcaagaacgcccatctgaaggcgctggagaacgccggcgagagactgcggctgttcaaggccgacgtgctcgactacggcagcgtcgcggcggcgatcgccggctgcgacggcgtcttccatgtcgccagccctgtcacctccggccgacccaccaatcctgaggtcagtagcttacaccatcctgaacctttcagacaaaattaccttttctttcagaagtttcagtcaaaattactgtactatactagtttggatttgcttctagttccaatgtaatcactccgatgacatatactactagtactgaactaggttcacttagaagcaaaaagtgtttttaacttttaagatgtgtaataaagtcctacaaaaattactgtgatgcaggtagatatcatcgctacggctgtaactgggacactgaatgtgttgagagctagccacgaagcaaaagtgaagcgagttgtggtggtttcttcagttgtcgcagtgttcaataatcccaactggccaacgggtgagcccttcaacgaagacagctggtcagatgaggagacctgcaggaagaatgaggtactaagttgttattaagagtactgatgaagtagtgttatgtcgtcctaacattttctacttttgtaacatgcaatttttggcatgttgggttaggtgggcatatgcaatttttcctatgcactctaggagagagaaacagtctgaattgatttttaaaaaaaattaaaaaagactttgtcttgtcctatgcactccactttatatagataaacaagggcacaatctgaattttcttttcctgatatttggtacaattttttttcctttttggcaatgcgtgcatggtttgtttaccaatcatagagacaatttccttaccttcagtaattcatgctacttctttgtcaaatgcactaaaaatcaattaattatgctgtttctgataggagtggtacccctattacctttccaatacactggcagagcgtgaggcttttgagtacgcggcaaaaactgggatggacattgtaactatctgtccggcgttgataatcggtccattgatgcagcctacagtacctacaagtattgaagtcttctttcatattataaaaggtggataggaattttcttatttcagtttgccttttacattcaacaatagtagcggatttagtttaactgaaaattcccgtatgatgttgtgttagacaataatagcatgcatgatatctcaccacttgtttcatattttttccttttccaatatgaatcatgcaaagaaattgctataatattttcgtagctcaataattaaacatcaagctactttactctgtataataagtgtaataagtgttgcgtactgaaataccatactgctcttatcggtggtggagcaaaaaaatatgcaagctagggctgaatttgacaatttcagttagaaattatatacttccaaattttatttacaattcactaaaggatttacttggagttttggagccaagtattggactcgaggccaagttgccccaagcctggctgcgcccctgtttctaatgcaggagacaacgagacggctggaaacagactcgagactctgttggatgttcgcgatgttgccgatgctattcttttagtctatgaaaactcagggggatctgaacgatacatatgcagttcaactccaagaaaactaagtgatataataaacacgtcaaagagcttatatccagctttcaattatccccaaaagtaagcttaattatttttgtgttccttaattagtacatgcctgaagtgtgatatatgcatttttgtttattcgtgatatatgtagagacttattgtgttgtgtttttctttatcgaagtggatgaggaacaaaacactaggtttagttcagagaagcttgagaagctaggttggaccttcaggcccatggaggaaaccctcagggatagctttgaatcctacattggtttggggattctgacctgagcgtcctactggcacaaccttatgaagattctgtaatcagtgataaacaatcagctggagatataatttcgttaatggaggtacatgattgaagactccaacgttcaccacaattgtttcaatgcttaagaactcgtatgatgcaaaaccgttaaataatgtaatatcagaattgattgttttcacataatatcataattgaacgctcgtagatgaggtacgtactgtcacttgagatctgctactggtttccgtctcttaaaacgtgtgttaggggacacattcatagaggtgtgagtgtgatgttacgtgtgtaatggtgtgtgtgcgtgcatctatcgtgtaatataaaaagaaaaaaaattattagcacatgactttgctcaatcaacaatttttttttccgggacaatagaaggacgccgaccaactacactcaaattaagacaaaacactatattttacagttttatatgaatcaacaactcagaaaaaagaagcacaaagcacgctatggtgcaaagcgctacaaactacaccggcataacacacagcagcagcataacccaccgctgctatgctctgctcaaaattagtaatatttatatttatattttattattaaaatatattaaaataacaaaataattttaaataccgtactaatttgaccaaactaatcagtgtgtaatatctatattatagaagtgtcaataattaattattttttaattttaaattttagttatttctaaattatattcctatatgaattttagaattttaggctcttctttcaatgtttcttatttattaattctaaagttccattatttataaatattattcttatatggactctaaacctttctttcaatatttcttattttcaaattcagagttttacttatttataaattttattcccatacggactctaaaactcttttttcaatattcctaattctttcagagtgattttctcaaaactacgaggggaggaggaagctatcggcatgattgagggtaggggtgaaaacggagcggatattatccgatccgatccgctccgaatccgtccgatgtgaggatacggtaagggtttttagatatctggctggatgtggatgtggattttgtcatgcgaatgcggatgtggtatcaacgatatccgatggatgtggattattcgatattttaatcggattatccaatgttctgtttggcggataatccgcaactttcaggccacacaacaactctatttagcttattttacatcgggcggcccatctagcacatctagtgtaacctaatccaatcctcctcaaatctct

SEQ ID NO: 93523 - DNA, 1856 bp, Oryza sativa
ggattcatgctaattgttgtattccttcacccatgcaccaatgtttgattcaatggcaaggcgacaagatagagatcgtgccagtcgacaggtcagttaatgttgctagtgccgatttagctctttgggagatggatggccttgattgtttatctggaaaagtttgggatgaagattttttaagagtatccgattctgatatacagccaattaaagatgaagaacccaagctattattttgagggcgtcgtggagggttcgaacgtctacaccaaggatacagtagatgatctcgatgacaaacaaggtcaaggttttatgtcagccgatgatctggaggagattgatgtaggtccaggcgatcggccaagaccgacatttattagtaaaaatttatgtgcagaatttagaatcaagttgatagaactcttaaaagaatttagagattgctttgcttgggaatattatgagatgccaggactcagccgatcgattgttgagcatcggctacctatcaaacccggggttagaccacatcagcaaccgccgagaagatgcaaagtcgatatgctggaacctgttaaggctgagattaaacgcttatatgatgctggttttattcgtccttgccgatatgctgagtggatttctagtatagttcctgttatcaagaaaaacggcaaggttagggtatgcattgattttagagatttgaataaagctaccccaaaggacgaatatccaatgccagtggccgatcaactggttgatgctgcgtcagggcataagattttgagttttatggatggaaatgctggatacaatcaaatttttatggctgaagaagacattcataagacagcttttagatgtcccggtgcaatcggattatttgagtgggttgtaatgactttcggcttgaaaagtgctggagcaacatatcaaagagctatgaattatatatatcatgatttaatcggctggttggttgaggtctatattgatgatgtggttgttaagtctaaagagatagaagaccacatagccgatttgaggaaggtttttgagagaaccaggaaatatggcttgaagatgaatccgacaaaatgtgcttttggtgtgtcggctggtcagttcttgggatttcttgttcatgagagggggattgaaattacccaaagaagtatcagtgcgatcaagaaaattaagcctccggaggataaaacagaattgcaagagatgatcggcaagattaatttcgttagaaggtttatttctaatttgtctggaagattagagccttttacgccattattacgattaaaggccgatcagcagtttacttggggggcagagcagcaaaaagctagataatattaaggaatatttgagttctccttcagttttgatttctccacagaaagaagttccttttcggttatatttgtcggccggtgagaagtcaatcggctcagttttgatccaagagcttgaaggaaaagaaagggttgtgttttatttaagtcgtagactcttggatgcagagactagatattcttctgtggaaaagttatgtctgtgcctatatttttcatgtacgaggttaaggcattatctgttgtccaatgaatgcattgtcatatgtaaggccgatgtggttaagtacatgttgttggctccaattttgaaaggaagggttggaaaatggatattttccttaactgaattcgatcttcggtatgaatcaccgaaggcagtcaaagggcaagctatagccgatttcatagttgactatcgtgatgattcaatcggctcggttgagattgtgccatggactttattttttgatggatcgg

SEQ ID NO: 93524 - DNA, 4878 bp, Oryza sativa
tgtgcatcagtatttacaaaatccatctcaatcggcttctaggaaattaagatataaggcgttgaaatatactttagtggatgatgagctttattatcgaaagattgctggagtattgcttaagtgtttgagtgctgatcaggctaaagttgcaatcggcgaagttcatgaaagaatttgtggtactcatcaatcggctcataagatgaagtggttacttcggcgtgcggggtatttttggccgacgatgttagaagattgttttagatattacaaaggttgtcaagattgttagaaatttggtgcaattcagagaggcgccagcgtcggctatgaatcctatcattaaaccatggccgttcagaggatggagaattgatatgatcggcatgattaatccaccatcgagtaaaggacataagtttatattggtggcaactgattatttcaccaaatgggtagaggcgattcctttgaaaaaggctgattctggaggtgcaatacagtttgtcaaagaacatataatctaccgatttggtattcctcagactattacaactgatcaaggttcaatctttgtgtctgatgagtttgtttagtttgccaatagtatgggtatcaaattattgaattcttcaccgtattatgcacaagctaatgggcaagctgaggcatctaacaaaagtttgatcaagttaattaaaaggaaagtttctgattatcctcggcagtggcatactcgtttagctgaagcgttgtggtcttatcggatggcttgtcatggatcaatccaagttcctccttataagcttgtttatggacatgaagccgttttaccatgggaagttcgaatcggctcaagaagaacagagttgcaaaatgatttgacagccgaagagtactatactcttatggccgatgaacgggaggacttggttcagtcgcgattacgagcagttgctaaagttactagggataaggaatgtgttgctcggcattataataagaaagtggtacctaaagatttttcggaaggagaacttgtatggaaattgattttgccgattggtactcgtgatagtaaattcggcaagtggtcgccgaattgggaaggaccattccaaatccataaggttgtgtctaaaggagcatacatgttgcaaggacttgatggagaagtttatgggcgagcgcttaatggcaagtatttgaagaaatattacccaagtatttgggttaacgcataatcggctagtattgccgttacatgatagccggtgcgtttgcatcgccttgagatggccgatattgttatatcgcctttagttgttttattgtaatcggttgaggtttgccgatgtacaatggccgatattgttatatcgtccttagtggtttcatatttttatcaatgcttttgacattgtaaaactaggtgggcatatatatctatcacaatacagtgcaaaatttttgagcttctatcacaatacagtgcaaaatttttgagcaaagtgatattgcatattaatcggaatattttagccgattacaaaattatcgagataagtatcgcaggatagctgatatagctctctgcctaatttgttctacttcttctatggcttgggcatcttgagcatcggttctaggaatgaccttcagagatttggtcatatcagcaacattcttgatagccgattttaacttcgctttttgttcttcgatagaccatgggagatcggctaatttcttgttctctaaatccggttcagcattggattcttgaagttgtgctaagagttcgatcttgcgagcttcaagccggtcaatattggatttgatcgggccttcagataattgatcaagcttggatttttcttcatgaacaagttgccgattggcctggattgttgcttcgatgtatttgcgctcttgacgatcggctaatctgagcttggccttttccagcttaaattggtgttgctcaagataaaccgctggagtaaggatatcggctaactcatcggggatttgagcctggacctcatgaagccgagtcctaattgatccacagtcaactaccaagctgtctagtgatgatgtctctagccgatgagagatatcttcaagagttttcttcacatcatcagacaaaggagctagagccttgctagtagtgtcaacctctgtctcctcataaagataatctctaatatcaaaagagaaaagatcggctaagacctgcagtaatgatttgaagagagttagagatcaaataggcatagtcgatctgcatatgttagttataagaaatttactggaatagttggagcagttggttgaacttcttcttctatgtgatgactccctacagctgatggggttcgatggcttgatgcttgttgaataggaggggaaggaggctgaaaatagacaagtgttatataaaatcggctgaaattaattaatgaaagaagtaagattattgtaccggtggagctggtttagatgtcattggagtcgatttcttcttcacagcagccttccttttctgcaattaccaagtatgtgagcaatcggccataaagtgagatgattacaaaaatggttaaagaagggtgctttctcttgtaaaaggagttggagtagaaggagttggaggggtctgcttaggtgaagccgatggtgttctttcagtatcacttacttcggctacggcttgatcaacatcttctgcgatttcttcttcatccagagcttgttcaatggatggatctaggacaagcagatcatcagctggtttagctttcttttttattttcttctttggagctagagctgaagtatctacagccaatgatctggttttccttttcctaccagcatcgactggttctctgataagcccttgaagaagagctgaagtcttgggggcatcatagccgatgacaggaggagatggcccacgtccattaggaattaatcctggggcgtaggtgatatccctgccactgttgctttgacgaggaggagaggattatgttgtctacaaatcaaagaaaagattagttaagataaatcggctaggcagttattcaaatgaaatcaagtagagtcagagacttacttgagggacaccatctggaaagaggtcttgtcatgtacattgaagctggttggtggaatagatgcaacttccattcaccccaccatctatcaaagtttttgctcctgaacattgctagctctaggttttcaatgctgcccagagggggtcctggaaggttgagcagccgatccatcatcaaggttgatgaaatttcacctcggcattggatcttgtcagcaaagaataagccgattgggagttggcccattccaagctgtctagctgaactcattgggtgatagaattcgtaagaggcttggatgtttcttccttgatggatgccgactggaagaatgcatgggttgattgcagctgtgaagatttctctggatgtttgaaatctttcgtgattaatgtcttcaaatctgaaatctgatgggagttcaaggtctgctgaattttcatagggaaaccaaactcgagcgtctttttgaaagccttcatagaaactacagaaccaatctttgagcagttcggctgataactttgctccagcatcggccggtgtggatgcgtattctccatatgacatacatcggcgatgagtgcgttcttcgtcatcttctataattggctctaatattggaaattcagcttctgtgatggatggccgattaacaactttcatgactattagattcaaccaagtctgcagcagccaccatggtccacttgctccgactactgagccgccggctaacttagctgaagcattattcagcatttgatacaagtagccgaggaggattttgcctaaaggaaattgtttttttgcttccaaggcctcggctacgaactgccagttggttgtagggccacagcttgatccacaaaagaggaatttttccagccacatcagcagaaaggctacatgctctcgaggagtgacgggccctttacccatgtatgctgctacatagcctgaccaaccgcctatactcttggtcttgaaatcgtattggttcttcgtgtttaggctcatagggttagccgatgaggtgacatctagacccgtggtcataatgatatctatgagagttggggtcatcggcccttggttgaataagaaggcattgatagtgttggaccaaaagtaagaagcagctgccattagaggttcatctttggctgagtttgctatggttaggtcaagtgcttggctgattccgatttcgtcccagtgaactcttttgctagccgacatgcgcttgaaccatgtaatccaacttttctcgggtgaagttttctcaagggatggccaagatttgaaggtattcttccaatgattcagattagggttggctaatctaaaggggattctgttggtttcaccagtgataaaatcagtagggttaaggttgccgattgggccgagaaagtaatggttctcatgcgacaaactcggaatcgcaaccaggttggacagatgctacaaatgcaagtagggatggaggagaagaaaacaagataagacgaaagaaaatcaatctgctgcggaagaaagagatctagccggtgggggcttacctttacgtattcggccgatggcgcggcggatggattggcggaagtcgacattgccgcgggcggagatctggccggggacggaattgtcttgaaattgcctgtgcggtgaaggggatcgccagaggaaaaaggaagacgtggttcgcttcagcgatgaaaacggaggaaacggtgtgggg

SEQ ID NO: 93525 - DNA, 1448 bp, Oryza sativa
ttggcagcaatcagcatatcatcaacatataacagcaagtatataggtgatccattaacaaatttaatatacacacatctatcaaattcagaccttttaaagccatgtgacaacataaatgaatcaaaccttttataccattgacggggggactgtttcaaaccatataaggatctttttaacttgcaaacataatcctccttaccagctactatgaacccttctggctggtccatgtatatctcctcctcaagctctccatgtaaaaatgttgtcttcacatctaattgctcaagctcaagatcatgcatagcaacaatactgaagaatgtacgaattgaactatgctttacaactggagagaacacatcattataatcaacaccagcaatctgattgaaaccttttgctactaaccttgccttaaaccttggaggctcgctgggagataaaccctcctttctcttgaaaatccatttacaacggacaggcttcttctgttttggcaagtgcacaagctcccatgtgccattcttctcgagagactgcatctcctcctacatagctgagatccacttctcacgatttccagaaacaacagcttcagtgtatgtggctggctcaagagtattctccacctgttcagcacaactaaaagcataataaaccatatcacattcctcaataaggcggactggagctccacaactcctctttgttctgcgatgtgcaataggttcatcttgtggctgcaaaacaggaggtgagtgctgaacagtatcatgaacatcattatcaacaatttcagtttcctgatcatcacgtgctccacctgcacgttgacatattgctgctcctcatcagaaccacctggtatgacatctgtgggcaagctgtcattaaacataatagattcattaaaaacaacactcctgctcatgaaggtcttattagtttcaggattccataacttatatccttttactcctgaaccataaccaagaaacagacacttaatagctctaggctctaattttccattatcagcgtgagcataagcagtgcatccaaaaactctcaactgtgaatagccagcaggcataccagaccatacctcaatgggagttttcttattaagtgggatagaaggcgacctgttaatcaagtagcaggcggtgttagcaacctctgcccaaaaacgcttgttcatgcgagcgttggacagcatacaacgagccttggagatgatggttctgttcatgcgctcagccacaccattctgctgtggagtgtacgggatggtgtgatgccgaacgatgccttccttcctgcagtaatcatcaaaagcatccgaacaaaattcaccgccattgtcagtgcgaagtacttttacctccttttcagtttgcctttctatcataacattccactctttaaaaacagcaaaa

SEQ ID NO: 93526 - DNA, 1936 bp, Oryza sativa
gtttactttatttacttaccttttactttgattttctaactttattcaaattaatccaaaaacttgtgctattaattggataaatgtcttaactccctcctttcacttgtctttagatgtcgcgttacaagcctgagtacttgtttggtgttgagggatttgtctaggagatgcgtacgatgtcctttgccataggatttgggactgcccctttttatgcccagattcctcatgatcgtcacgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgctacagtgatcagttggccgacactgagtatcgctaccatcctcgccaaccacagggaagtgaccgtggcagctaccttgagactgagggaattgagaatgatgctaccacgaggcatttggttgagatgctgtgggctatggatgaaacccgtgcggagactgtgttagcagctcaagatcgtgaagaccggaatcgtggcaagatttgcaagttagaggacaaagtggatcgtttggagaaggaactagccgcattgaagggagaagcaccaccgcagaaggccaggattcgtcttaccgcaaggaagagagctctatttgtccctcgctaccaattggcgccaaaggtccgtgtggtggaaaaagaagttaccccagccctagcggatcctccggtcgtcaacataagtgatgatgaagtagaagaatccaagcgcacctattccaagattgagtggggagccactcaagatgatgaagacgagccggacgagccttcaatcaactccgttcattattgaattaagaaactagtcttcatgatacaatacatgcatccaatagaattagagaacatgagagtggagaatttaaaaatgtaataatttaatagagaaggggccatagttaattgactacatgcatgcatgccttatattatgaaacatctaaaaaaatggttgtgccttatattatggaatggagggagtatttgatattaggtccttccctaatatttttttttttttataatgagccgagagagtttgaacctggcaacaaagggcctgtttagttcgcgaaaaaaaaattttggatgtcacatcggatgtttgaccggatattggaaagaatttttggacacgaataaaaaaactaatttcataactcgtctggaaaccgcgagacgaatcttttgagcctaattaatccgtcattagcacatgtgggttactgtagcacttatggctaatcatggactaattaggcttaaaagattcgtctcgtgatttcctgcctaattgtgcaattagtttttttatttatctatatttaatacttcatgcatatgttcaaagattcgatgtgatgtttttggaaaaaaaatttggggaactaaacggggccaaaattaggcaggagcatgttaaatcatcccatgtcaaccaagttcaccacattgactcgtaccatttccttcccccattattcaatatgaaaaatgccatggaaataaagaaagaaagaaagaaagaaagatacaaagaggaatttgaccaatccccttacgaacgacgaacaccggagacagcaagagagaggccgccgagcagaagcacaaagagaccaaatgtcagcggcggactgatggcgccggcggcgagcatagttaccgcaaatgaggcagcggcgatcccgattacggccgaagcaaggttgccgccgcgagcatctgcgtccgcggctgcgtttgccgctccactgggaatatcaatcttaacctgcagggtcgatagcgtaattgaaacgtgtagaacttctcgcaaaaaaa

SEQ ID NO: 93527 - DNA, 982 bp, Oryza sativa
gccggcaaggtggattaggcgcgcaactatgcgggtctgacgacagtggggaggtgcggtggccgtcgcccgtgcggatccaacgacggccgtcccctcgtgtgtcgccggcagatctagttgtgggaacggcctcctcctctgtcacatcctgatttttgtttcaggttttataaattatttaataaattaataatataatttatattaaatgatctttaatttataagtgaagttaaatgtgggaaataaaatttcctaaatataaagcatggatggatttaatttttattaaattctccatgattaagtcaactctctgaaattttctcggatttttcggagctcaattcctaaatgatacaaagaacagttcagtaattatttgatcaataatgatctaattatatttgttaagagcttttcttgtttaaaaatccttaaattataaattgttgtttaaaaaggaattattagaaatgattttaaaagcctagaagagaagatctagttttaatttgttaaatctcaatataaaattgggttagataaaattttgttaaatactttgcttaattctataattcctagatttttctgggatttatttgagctaaggaagtatttttaataaatggaattgcatttcatgaataattttaattgaaaaaggtttttaaaagtctgttttggctttgggccgaaagtcggcccaaaacctctctcttccttctctctctcttctcggcccaagccggcccagtccgccgagccgccgctctctcccgctcgctgacaggtgggtcccacttgtcagattcgtcttcctcgcgccgccgcggccgcccgaaaccctagcgcgcaagcgccgccatctccttccaaatccggtcgatcctttcccgatccggtgaaatctttggaggggaaatgatcctctcgacctccttttccttttcccttttggaatcatcgcctaatt

SEQ ID NO: 93528 - DNA, 4630 bp, Oryza sativa
attccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagttgtcatatctcgtcgaaggtgtagatgttgacgttgagcatgaccatcttgtttccccttgcgcaatcctgccatggttagcagcaaacaagaaacatacacaagaatatacacgctcctatcaactattaggtactggcagctcaaatgtcacacacactcaagcttttaaccaagctcttacaagatcttaccaatgcaagtggaatggtgatgtacaccgactcaaccaagcagcccaatagaggttggatatatcgatgcctcggcaaacacttgctgtacggctgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttcttttttttctttccttttcttttctgttttttttttggtgcggctttttttttttttttttgcacctttctgcctttttttttcacttttttcttgattttttttaacaaaaattgactcaaggaccttaatgtaagattacagggactcaaacataaatataaaatttacagggactcaaatctaaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactaatttttaaccaatccaatctactatatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccttggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaagactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgatgaaaactacgatttggaagaaacgttgacgacccgactacaaccgtacaagacgttgcgttgcgccttagcgatcgatacacctctccgtgggttgttgatcttgccgttgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaacattaatctaacaaaacccaagaaaccctgaaggggtaactagctatatataggggtgggaggacgacctaggggtgcctagggtcgtgctccaccagcttggggcgcaccccacatgggccccacctgggccggggtcccaaatgaggttacaagcccataggcccattacaggtgtcacagcaccttgtttcttcagttgctgccgactgagatggaatttggcaatgaggcttgatgcattggaaagaggactccgagagctttccatcaagtactcacgggctgaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcacatcatcctccccttcttcacggaaaaccgtcctcggtttttccatatggtgttcttcatatagtccattcaaaataacctgtttcatccaatcaaaactagagaaactcgaaatagtgtgattagcaataacatgtttctctaaatccaaacaaatgaaaactctatgcaccaaatatattcctctatcattatatttgccaaagatatgaaaaatagcattagttagacatggcaaatcagacttagcaaataatttctccttcaaattatcgagctcacaaaaatcatcaaactgaacatagcccaaagtatttaaagaagatagcaatttacgttcctcaacttcattaacaatatgaacagcatgcttaaaatcagcacacaaagaaacactaggaatagcatgttcatccactagttgtggcatggatataagtgaagcattatcacacaactcttctttatcacaaggaacagcgagtaaatcaacttgtgacaaaggaattccagcatttggttccactaacggttgctctacttttgcatgaaaagtggacaaatttacttcgttaacaatgcactcaccttgattaatttcagtaccatttactttaccttggatgtcctctttagatgatggaggtgtctcgaacttgagtgtgaacaatggaattggtggctctttcatgtctctctcctccttttcgtgattacgcacttcctgcaaatagttagtaattggaggcaaagacatagcgtgtttctttttcatatcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgtagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatcttgcatatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacggctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctaatatatgaagttcagctcaaacataacagtattttctcttttctttctttcttctttcttcttttctttttttttctttccttttcttttctgtttttttttggtgcggcttttttttttttgcacctttctgcctttttttttcacttttttcttgattttttttaacaaaaattgactcaaggaccttaatgtaagattacagggactcaaacataaatataaaatttacagggactcaaatctaaaagtctaaacccaaaattaaaattatacaaaaaatggaatgctgaatttatgcccggtccgttttccaaacagatctcgaaaccgacaccaaac

SEQ ID NO: 93529 - DNA, 5305 bp, Oryza sativa
gaaaaggacttttagagcttttctttttataaaatcattttaactttgtttatttcttaataattattatttgtgctatgaaaattccactaaaatttatttacgcattttaggcttttaggaaatatacaaaaatcctccaagccttatttgacttttaactttgcacattttaattgttggaggctttcacacggattttaattattctaggcataatttcgaggatgtattttagagtcgttttgggacgcgacaaacctaccccccttaaacggaatctcgaccccgagattcggaagaactggcgaagagatcgggatgggctgccttcagctcgtcttcacgctcccaggtagcttcttcctcggcgtggttgctccattggaccttgcaaaaacggattacccggttcctggtcctgcgctccatggtgtccaggattttcactggcctctccacgtaggtcaagtcttcgcgaacttcaatttgctctgagtcggcctgctcggatggcactcgaagacatttcttgagttgcgacacatggaacacatcatgcacgttgcccaaggaggcgggcagctccaactggtaagcgacttctccgcgtcgggcaacgatacggaaaggacccacataccgaggtgcgagcttccctttcgtctgaaacctgtgtacacctcgcaatggcgtgacccgaaggtacacaaaatcgtccactgcgaattccaggttacggcgacggttatctgcataacttttctgccaggactgtgccacctttagattatcccgaatggttctgactttagcttcagcttctctcaggatatcagtcccgaacacttggctttccccaacttggtcccacaatagcgatgtccggcatttgcgtccatacaacgcttcatagggtgccatttgtatgctggcttggtagctgttattgtaggagaactcggcataggggagactcttatcccaggtcttcccgaaatctaggacacatgcgcgaagcatatcttctaggatctgattcagacgctcggtctgtccatctgtctgcgggtgatacgcggtgctgaaatttaatcgggtacccagctcttcttggagcttcttccaaaagtgagaggtgaattggcttcccctatcagatacaattttcttaggaacgccatggagactcacgatcctagcgaagtagagctcggctagtttgttccctccataggtggtcttcacaggaataaaccgagctactttggttagtcggtccacaactacccatatagaatcatatccaccttgggtttttggaagtccggtgatgaaatccatcccaatttcatcccatttccattctggtacttggagaggttggaggagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttccgttccatagggttccgtattcatcctctgtgaaaccagcggctttaccctgtttcatattcttgaggagtccacgcatgtccggatcattcttctgagcctcgcggatttgatcgagcaaggtaggcttggcctccaacgcagccaagaatccgcgaccaactatgcttaggttcagggcttccatctgttgattaagttcgggtggaatgccacggacgttaagagtgttgcaatggcttttttgacttagagcgtcgacgaccacgttggccttaccgggatgatagtggattcccacatcataatccttgatgagctctaaccatcttctctgccgaagattcagatccgactgggtgaagatgtatttcaaactcttatgatcagtatatatttcacagcgattcccaatgagataatgccgccagatttttagagcatgaaccaccgcggctaactccaaatcatgggtagggtagttgccttcatgaggccgtagctggcgtgaggcataggccaccacatgaccttcctgcatgagcacgcaccccaatccttggcgcgaagcgtcacaatacaccatgaagtccttgcgagtatccggcaagattaacactggcgaggaaaccagcttttctttgagagttttgaacgccttctcgcattgcgggctccacacaaatttatattttttcttcaacaactgtggtcatgggtcgagcgattttggagaagttctcgatgaacctccggtagtatcctgccaaacctaagaaactgcggatttgagtgactgtcttgggttgcttccaatcgggacggggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtataccagaatgatgtgaccatggctaccacggatgcaaccattgctcacatcatggatgaacaagaagatatcgagatcaagtactccaagtgctggaatccgattcggccacctactacactgctgacttcaaacggccaccgaatctgcatacgacctccgttttcggcctgtgagtacttgatggaaagctctcggagccctctttctaacggatccagcctcttctctgaattctatctcgtgtggccagaatcacaggaacaaggtgttgcatcacctataatgggcctatgggcttgtaacttcatttgggaccccggcccaggtggggcccatgtggggtgcgccccaagctggtggagcacgaccctatgcacccctaggtcgtcctcccacccctatatatagctagttaccccttcagggtttcttggggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcacagaatgtcatcaatgaaaaccacaacaaacttatccaagtattccatgaacactttgttcattaagttcatgaagaaggcaggagcattggttaaaccgaacgacatcaccgtgaattcatacagtccgtatcgtgtggtgaatgcggtcttcggaatatcttcttcacggatgcgcaactggtgatatccggaacgaagatcaatcttggagaataccgtggcacctttaagctgatcgaacagatcatcgatccggggaagagggtacttgtttttgatggtgactttattgagagctctgtagtcaacgcacatcctcttcgtcttgtctttcttctccacaaaaatcataggagcaccccaggggaaagtactcggccgtatataccccttttctttcaactcttccaactgtttcttaacttcggccagttcatttgctgccatacggtagggtcgtttgtacagaggagtggttcctggagcaagatctatccggaactcaatctctcgcttgggcggcatatcgggtagttcttccggaaacacgtctccgaactctctgacgatggggatttctgacagtcctatctgatgaagttctgaactactgacagaggttggaggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgagggaaaagggatcccctgaatttctatagggacggcaggactataatactttgctgtcataacccctccaggggtggtgatgaggagagggttcctaaacctttctacccccaactgatttctccccacgaatggcacagatataaacgagtgggaagctccagagtcgaacaaaatggtagcagggatggaatgaatgaggaacgtaccaacgatgacgtctggagtcgtcagcacgtcctcggccgtcacgtggttcacacgaccccgaatgacatccttaccaccgttgtttgagcggggaggcgcttggccttgctggcgcctcggctttgggcatttatccgcaaagtgcccaggctcgaagcagttgaagcacagacgctgcggaccttgaacgtccctgcggccttgaccagactgcgcggctggcgtaggaggacggggcgcacgggtcccttgctggctctgctgttgctgcggctgtgggacgcgcaccacgaattgaggtcggggcgcggagcgaggttgctgctgctgttgctgttgcgaggacgatccccctggatagggattggtgtagcggatcctttggttagctccctgttgattgcggaaattcgccaagcggcgcttgtgcgactccagttccttgtgcttggcttccaagcggatgctcttgtccaccagacgttggaaatccagatagtcaccggagactagacgcacggacagctcagggtccattcctgccaagaacttctcctgcttttcctcatcttcccgtacatcctccggggcgtaccgggccaggttgttgaactcatgcaaatactccatcacggagcggttgccttgcttcaactctcggaattcccttttcttaagggccatgactccggcgggcacatgggtcctccggaaagcggcggtgaagcgggcccaagtaataggctgcccctctggctgcgtagcctggaaatggtcccaccatagagatgcgggcccctgcagttggtgggcggcgaagatgactttctcctcatcgctgcactgcacggtgtctagctttttccccacggcatgcaaccaatccaacgcatccacggggttgttggagc

SEQ ID NO: 93530 - DNA, 622 bp, Oryza sativa
tgcaggagtatgatgatgtctttctagctgagatacccccaggattgccacccatgagagagatagagcatcaaattgatttgattccaggagcatcattgccaaaccgtgttgcttatcgaaccaacccagaggggactaaggaaattcagcggcatgttcaagaccttttggaccgcgggtatgtacgtcaaagccttagtccctgtgcagttcctgtaattttggttcctaagaaagatggttcttggcgaatgtgtgttgattgtagagccattaataatattactatccgatatcgtcatcctattcctaggttagatgacatgcttgatgagttgtgtggctctataattttcacaaagattgacttgcgtagtggctatcaccaaattagaatgaaacttggagatgaatggaaaacaacttttaaaactaaatttggtttgtatgagtggttagtaatgccttttggtttgactaatgcacctagtactttcatgcgcttaatgaatgaggttttaaggccttttattggacgatttgtggtagtgtactttgatgacatattgatttacagcaagtctttggatgaacacatggatcatttacgtgctgtttt

SEQ ID NO: 93531 - DNA, 923 bp, Oryza sativa
ggtaaatgatacgaatttttttgtatggctattttctggttataggaagataaaaactcaccgagcaacgaaagctctgataccacctgatgaaccctgagttcctctcaacactcaaggctgttgttggcccgatctttcggtgagttgtgataactacgatttgggagaaacgttgacgatccgactacaaacgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctatcaaaacccaagaaaccctgaaggggtacctaactatttatagaggtgggaggacgaccaagagggtccaagggtcgtgctccaccagattggggcgcaccccacatgggcctcacatgggccagggtcccaaacaaagttacaagcccattggcccaatacagcagatgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgattcatgatgtgagcaatggtcgtatccatagtagccatgatcacatcaaaacatcgcacccgtcggtgctcaatatgtgccaatattggcat

SEQ ID NO: 93532 - DNA, 712 bp, Oryza sativa
gttgaaagaaaaaaatcgtgttttggttgagatggctagaatgatgttggatgaatacaacactcctagaaaattttgggctgaggcgattaacactacatgttatatttcaaatcaagttttcttgagatcaaaacttggaaaaacttcttatgaacttttaattggtcatgaacccaaagtttcacatttgcgtgtttttggttgcaagtgctttgtcttgaaatctggaaatttggacaagtttgaggcacgttctaccgatggattgtttcttggctaccccgcacatactcgtggctatcgtgtacttattttggagactaacaaaatcgttgagacttgcgaagtttcttttgatgaggctagtccaggtactagacccgaatttgtaggtacactgtcacaggttcagggggaggatggtcgtatttttgaagatgagagcgactacgacgacgatgacgaggtcggctcggccggtcagaccgggcgccaggccggtcagaccgggcgccagcacacctccggtcagaccggctcaggaggagcggtcagaccggccaggttcgtcgggttcaggtactgatgatgctgatcgagatggacctccagagaattcaacttcgaccagtactgaaacagaacgtggatcaacttcagaagttgctgctcctttacacattcaatgacgacatccgccggaacaaat

SEQ ID NO: 93533 - DNA, 9507 bp, Oryza sativa
  unsure (1)..(9507): unsure at all n locations
agttcacagcaatctctcttcttcaactcctccgagaactccattgcatcctgtttctgacagtaactgggaagagaagtggaggaatgtgcacaaggacggaacaacccccaaggaggttgagaggggcaattcttttagtaaacaattaaagaaatctttgacccagaagcttggtttatctaggacagagtcagatccttctccagtgaaggtcctcagtgtgagtagtaatgatactcggaattcagtaagacgttgccttctgaatactttatcagatgatttggattgttctaatgaacttgccgggaaaactcaggaagacgaattccctatcatctcagttcacagggagcatcctctgagctctgcagagccttccaagttaaaggcagctggtgaaaatgtaactgtgagcgcatcatgtgtggcaaaactcagccctctaaaaaaatctgtggttgagccagctaatgagaacgcaacacaggggacaaagtgtgtaccagaagcttgttccagcggtgagaactctccagtgttctatgcagccagagccagtgctggtaatgaacctttgaatggccaggacacggattctgagagtagcagtgttacctcaaattcctttgctggtgaccatgatagggatgaaattctgaaagatgagccatccagctctaatgatgataacaaaaccatccaagattcagaagcagcatcttctgataaaagtccagaccgaaatggaacctctgagagggctgtcgtttctaatgaaagaaagccattcattagtaaattccagtggctcttgaagttgggaagaccttcggttgaaggcaacatggagaagagtagtggagagacatcagctgataaacaagacggggacacatcctgttctccttctgatgggaattcaaataactcccgtggtagcgtaaagttggcttctggtgataaaaaggtcatgggcagcctaaagaatcttggacaaaacatgcttgaaaatatccaggtactgtattcaatattatttttcatgtacttaaagtaagcctgaataaccttgtctttacaaaatgattaggtgattgagtcggcatttcagcaagaccgtggtcagcctggccctgtggagaacttctcaaacaacattcttggaggcaaaggacaggtcactgcaatggctgctctgacggagcttcgcaagatcagcaatctgctgagcgagatgtaacagtgtaagatgtatcgcccattctttcccagctttctagctcagctaaggcctggtagtaataagtcaggtacctaggtctttttcattcagcagtgcttggcactgcttgaatatgtatatatagattcgattcgattccattccattgagtaaatcatgtaagcattgtacaaggatcacccgtggatttacctggcgcgtgatgagggagtagttctctccggcattaggaagctatctaatgatggatgaaattttgtaagataaactttttaaggaagaataagcagaatatgttgcaatatgtgcgagctacaatgcagctggatgatttgttcgtcaggctgttctatgttcagttcatgtgcagtaccattcagaagcattgtatttggcaacaataagaaaaatcactgctgctctttctggcttccagtgcgatatccaggtttgcaatgttttagccattgtattattatgcagctggcatatctctgaaccagaaatgttcagcccaatgtatctgatgatgaatgaacattgatagtactatctagcaactactttctcggttcataatcttttcagggcattgcaccaaattgttcagagattttgttggcagctgtattatttattagctgggctcatgctgtccatgcatcctggcacaacccagagacagaaatgcagcaaatgctgatgtttctttcacgcatactttccatatggctatggtaggaagccaagaaagcgacgtacactgcttctgtagctgtagtgcacgactcaagcaaaatcttgcatgtttaatggcatataatggtgtctgctttctgcacgcattttccatccactttcttgatcatttctgtgtctcttcctgaacgatgttgtgaccgggacaggcagtttcgagtctcatttgtatacgcaatcatttagcactaccacttgacacagattaattagagaataactacatagcagcaattggttgtaatgtcaaagacgacaacaattctctgctgctcttattataaccgaggccctgttctttctcttcaagattacaaagattatatattatcacgaatacattttttaagttcctaaacgatacatctttttttaaaaaaaacactttcaatatataaattgttcaaaatattttttaaaaaaacttttcacctttttaatagttattaattcattcatctgtaccctacaacatcaccataaaattagataatctatcatctatttagaacagttaaacatgacgtgaaaggggtaaattcagaagaagcaggaaaacttgttaacaaacaaaacacacggtgtttcggtccacgggggatgcgatgagcgggtacggatggtgtgcggactggactgcaaaaacggctggatgctggcgaattccaccgtgtcggtgtcatcccacaacagcagcaggagcagcgtcagctggtccaactgtccaagaggaaactacccacagggtccaactgcccattccatgtggcagtgagcagagctgacccagccatcctgctcaccattcttatccactcaaacagctcctggccatgagttttttttttaagaagggtgcaacttagcacgcacactcacacaccataacacacgcacacacacgctaaaaataagattgaagaccactaggtgtctcagtgcacgcgcatacgtgtgtaccctatttctagtcgaaaataccccgaaggacagtccttaggaaagacggaaaaaaaacccgtcgaggtgaggtcccacgagtcgaactcgcgaccgccgttcgctccactgcgaatgtgccaaccgagccatgagtttgtgtctgatgaatgatgatgattcagtgctctgacagcgagcaaatcttgtctgaagaagagagagaaatgatgggcctttgcttcggtttgatggcctgaaaattcaagctaaaattttggcccatcatgaattcataatcctcatccatccctctgtatgggctggggagtttgaactaattctggcccatttatgagataggatgggaagttgggtcacttaacaaatcatacataagttgttctttttttccttccataaaggaaaatttgatgatgtggttatattgtggttgcacaaatgatcacattattactgctactgccaaggatctcttgaccatttaccacatgaagcatgatggggctagaaaaggttacaggacttccaggtttatcaacctctgaacatgtagaacttatggatgaaaattgggccaaaaatgatcaatggcaagatcaacaatcttctctgtggacaaaatcattaacagagatatacacacctaaagttaagagagggagaaaaactccagacaaagttggggcaacctattggtgtgcagcaaaacgagttgcttagccagcaaaaaagtaagttgatgagaaagaaaaatataacatatcaggctaatcatctggagtacagggtgtgttgttttttgttgaagctacctctgtcttgaatttctcccagacttctaaacccatggggtgccttactacataacgttttacgaaatgtttgtctgcagtggctaggagagtgctaagagctagtccagtagcaatcactcctttctccaacaaccaattgtacatcaaaaacctaagcttggttctctccacggtaaacgagaggaatgaagggaaaattaccagggtactcagaggatatcccatatcatttacaaggaaggatatcttggattcaaggacatggatcttctgattcagaacatgtggagccatagtgatcatctgcaccacatgttccgggtccaaaccggtcttgaccaagaagtcgtagcgatcttttagctcgtcacctttaccacgaaatgctttgagtcccctcgtcattcgttcggatccttccataaatcctaagttctgtaaaaatttcaccttctccttgaaggatgcttcatggagatcaactttcggtatgcggctgacctttgcccctaatgagaatttcatcaacagttgtggatcctccattaccatcctgcaaaggcgcttcttccctacactgagatgtgtcataatgctgtttggtttcttcaattggacggaaccaagtattgaaccgttagacaccacaaatttcttaatgtcctcttcactaacaccaatctcagctaagaagaatatgccccttcgcaggttcctcgtgaaattgtcgactgacaaatttgggaaattcagaaaaagatcaaccaattccttttttccaaacccagcttttagcatgacgaggactgccgagaacagcatctttcctgaaccactaaacaagaaatcgggattctgtctgaccaatttgccaataccttcattagtgaatcctaaatcactgaagaactgagggacttggaccatctttccccagttataagacttctttacagataagaatcggccaagccagtctctctgaattccaacatcatctagccagcgcagaatcttcaattccacatttggatcacggaccagtatgacagggctcgacatcactagcttgatcacactggtcttactcaacccttgatcctcaagggccttcagcttcgacgcaagaactccatggccaaaactaaacacttcggtagcatccctgtatatcctccctatcttggtgcgcgcgatgccatagttgcaaagcacccggaaattgtcgagcatcgtctcatcatcattgagaaacatgagatcacgaggcaacaatggctcatactcgcccggcgcgatgccgatactctcgaagaacggctcgaactcgttgatagggtggaagttgaacagccgcaccaacgccttgctgaccctctcatccctcatctccctcttcttcaccttcgacctgaagggcacctcctccccctcctccgtgggctccttcgccgcatccttcaccttctccagcagcttgctgatgaagatcggcgagcgcttgctcatgtgctcggcatcactgaagcaaatcccacgcgtgacatggaggtactccatgaatgccttctgcgcgatgcgggcgtcgcgcctcctccgcatctgcttgaccctccgatcatccacatcctcaatcccatccccgacgatcgccggagcggccgagaatggccgcagctgaatcctgtcaccaacctgactggcccagctccagctcgacgcacatggtgatgatgaatcatggacatgccaagaactgacagcagcagcagcagcatgacaatgtggggttctggatgagcccctggcaaggccattccatggaagccacctgtggcgagcggctggcactgaccggagcatggagattcagctgaatcccccaaaactttttggagaacaaactgtatgtatcactgtatcagtatcactgacgcaagaaaagaaatccacggcgaactgggcactccctccctcctagaaagaaagatttggattggatgaagagaactggatgaacaaacacactcactctcagaataatccgagcatggttgggcttgccgccaatctccactcggctacagtccagtagagcggagagcgaggtggaggtcgtgcttcggtggtggaaggagggctcgcggaagggaggcgcgctcgggggagccactcgccggcgccgccgccgcgagggggggaggaggaggaggagcagggaggggatgcgcgggtggacggcggcggcggctgtgttttgggggcgcggcgatgagagagccgtggccgttggatccaagcccagacggaggcgacggctctgagcggccgcgggaatttgggccgaaatttacttgggccccacgtgggcctttgaggccgaaagcacgtgtgctcaagtggttaggttaatctcgtaggtcttgttcggttaattcatgagagagcgattgaaggtgtggaattatttttcatcaatcccctccaattcttttcaatcctctctaaactaaggatgcgttcgttcattggagataggggagattgtcattcatttttcgtgcgcacgcttttcaaactactaaacggtgtgttttttgcaaaaaaaaattctatagaaaagttgcttaaaaaatcatattaatccatttttgaagtttaaaatagttaatactcaattaatcatatgctaatgacttacctcgttttacgtatctttctaatcttcccaattatctcttcctcaaacacagcctaaataaggcttactgcggcagatgcaccgcccagcttgggcgagcaattgcttgggctgcgcacgactgcaaacgagactgaatccatagacttcccagcggtcttatatgaggggaataagctcatctgagacgctcatctgagatcccctctccggtggggatcgaccagatgttggcgcgtcggcgcctgctctccaccgcgcgtcggctcaaaggtctggagcttcgggagttcgtgtggagcttgtcgatccggagggagctcttgttggggtgtgggttttggttggagtcaactgaattacgcgccaaatatgccctaaaatctactactcccaaatatgcagcaaatgtacttgtgccttgtttggctcaataatgtaatgtgatgagaaagaacaaaaacaatacggggacttggcgcaagataatcatgaattaacagtagtgtttcatatggctgtatacacccccgttggtgtatagaacccgggttttataaatttctattatctaaaaaacagtagtgtttccaccaactcagattacaagacttccacgcgagaaattggaaaacaaccttaaggtgcacccatgcacatactaattcttaatcgatcgcacacaatgcgatcgctcattattatcatggcctaatacggacgatcgattccacacagggcagcatgtagtgggcaacagggagctcaccaatgcggaattttatcccattccggtgatcatacgtcaagtcacgcgccatgtcgatcacttcttcgagcgacccatcacgcaggtcgcacttgtaaacgtaccagccatcaatggataggaaaacctgttctcgatcggccagagaaacgcagacggatacattgagctgtgttatgaaaatagatgcacaacggagacacgaattttacatggaaaacccttgcgggaaaaaaccacgggcgccgaccggcaatgatcactatagaggagatgattacaaacgtaggggaatcacaatgggaacgtcaccccttcccgtacggcttataagagtatatgtaggggaaatagaaagacacctaataggaattcctactaggaaactaatccgaatatattgtgggcccaaaattcggatcacatatttaacaatctccaccttgagacgaatttcctcttgtagcataaaaacatcaatcaccaaaaatacctcatgtaggtaaaatcaccgcgcgccaaatagtctctaggactatattgtaacaccaaccaagcttgagcaaagctcaaatttagtagcagaaactggctttgtcatcatatcagctgggttatcatgagtacttatcttgcataccttgacatcaccttcagcaatcacacatcgaataaagtgatatctcacatcaatgtgctttgttctctcatggaacatttgatcctttgtaagacatattgcactttgactatcacaaaatatattaatgcaagacgtaactccacaaagcttagtgtacaaacctctaagccaaatagcttctttacaagcttcagaaatagccatatactctgcttcagtagtaaataaggcaacagttgcttgcaaacttgccttccaactaacagcacatcctccaatagtgaaaacataacctgtgaacgatcttctcctatccaaatctccagcaaaatctgaatccacataaccaacaagtccatctatagatctcccaaacagcaaacaagcactagatgtaccacgtaggtatctgaaaatccattgaacagctttccaatgctctttgccaggattagccatgtatctactgacaacactcaatgcatgtgataagtcaggacgagaacataccatggcatacataagtgaaccaactgcctttgaataaggaactctagacatgtattcaacatcataatatgactgtggacataaatcaaagataatctgaaatgtgcagctaacggagtactcactggttttgcatcatgcatattgaaacgacgaagaactttttcactataacatttctgactaagatataacttgccagaatgtctttctctagtaatttccataccgagaattttcttcgctgcacccaaatccttcatctcaaattcactactcaattgtgccttcaactnttctatctctgatttatcttttgcagcaatcaacatatcatcgacataaagaagcaaatatatagctgaaccatcaacaactntaagataaacacagctatcataattggatcttctaaacttctgagaaagcatganagagtcaaatctcttataccactgtctaggtgactgcttcaacccttaaagagatttcttcaatctacagactaggttctcttttccaggaccaacaaaacctccgggtgctccatataaatgtcctcttctaactccccatgtgaaaatgcagtcttaccatccatttgctctagttcataatcatgcattgcaacaatactgagtaaagtacgaattgaactatgcttcacaacaggggaaaagatatcattgaaatcaatacctggaatctggctataacctttagcaactaaccttgctttgtaccttgcctcatcacttggagacataccttcctttcttttgaagatccacttgcaacggataggtttcttctcctttggcaacttcaccaattcccaagtatgattcttttcaagtgactccatctcatcatgcatagcagttatccatctattgcaaacatcagaaacaatagcctcagaatatgtagaaggttcggcattaccttcaatttcttctgctacactcaaagcataagcaactatgttcgcttcttcaatatatcttcgagaaggtttaatatttcttttgggcttatcttttgccataagacggtttggaggactgctgaacaatagaagaatctgaatcttcaata

SEQ ID NO: 93534 - DNA, 715 bp, Oryza sativa
cctgcagccccgcggcagtgccgcctcctcgccgacgcctgcgcgcgcgcgctcgccgccgtcacggggcaggttcgcgccgagctccgcttcgacgagcgcggcgccaagtggcgcgccatcgaggcgccgctccgcgagctccaccgcgccttccgcgacgccgaggcgtacgtcaggcagtgcctggacccccgcggcagctggtgggcgcgcgcccggccatggcgcacggcaccgagtgcgtggagcagcacctccacaatgtcctgtggtgcgtcgccgtcgcgctcgaggccatcgacgccgccggcgagatcgccggctccgacccggacgagctcgccagggggcggctggtgctcgccaggaagtacgacagggacatgctcgatcccaagctgttcgagcacgcgttcggcaagctatatctggtctcccaagagctcgttgcaaggatggacatggcgtggaaggaggacagatgggtgatatcgcaaatgttcgacgaaatgaaaggccctgcggcgtcgaaacctctgagcaaaaacgagcaccgcctcgccgagctcctcgccgcggcgatggggaagctgcacccggcatctgtccttcttggcagcgactacagcgtccggaggcggttcggcggcggctcaaggaggtgcattggatgggggagagctttgcgatgaacatttcatcggggacaccg

SEQ ID NO: 93535 - DNA, 730 bp, Oryza sativa
gcacttgttcatgatctcccccttgctccccaccggcatgggcagcttgctgagcttgagcagcgaggcggcgaagtcgtggtcccagagggcggcgttgtcggcgtactcgcggacgtggccgcgcgcctcgtcctgcgtcagcagctgccagtccgagttgaagttgaccaccttgtcgaggttgttgcggtagtaggtgttgtccagggcgctgaccggccgcagcttgccgacgaacgccggcatgaacctcgccacggtggcgaggtcctcgtcgcgggcgttgttcaccaccgcagggtcggcgccgccgccgcgggagcacctgtagttgagcaggttgcggtaggacggggtgatctggtcgggcggcgcggcgaggcgggcggtgaaggaggagcagtggccgtcgccgacggagtgcgcgccggagaggacgacgagctcctcgacggtgaagttcttgcgggcgaagttgtcgatgagctgccggatggtgaaggtgggatccgggagctccgcctgggcctcgtaggcggaggagacgacgccgtcgaggcggcccgcggggacgtcgaagcggacgcggccgttgctgaggatgctgctggcgtcgcgggcggcgaagatgaggatgtcggcgcaggagaccacgccggggcacctcctctcgagatcggccttgatctcctccaggatgtcgaatccttccagggggcgcaggaat

SEQ ID NO: 93536 - DNA, 1196 bp, Oryza sativa
agtccaggcgagattttatcccggcccaccccagtgttttcccctcgtcatcggccgggaaatattcagcttctctggtggcgaggaaaaaatcctctcgacgcagcgacgcaatgagagggggcgctgcggcggggaccgctgcacggcgcggcgcgactaccacgtgacggcaacggcacgctctctcctccggtggccaccttctccccggtgagttcattcccttcccatctcccctagcctcctcttccactgttagggtttcttgccctcgtgacctcccgctattgccgccgccaggagaagcacgagggcatggatctgttctttgtccctcacacggcgtctcgatctattcttctttctcccttgatttgctctgagcaatattcctaccctaggctgaagctctgatcatgtccttcctggatctgatcctctgtttgtagtgccctagtgagaatatgctgattctcctggtagttgagtagttgaaagaccacgttttctgattctcaatgtgagttgttttaaatttgtacataaaggttatgaaaatggtttattcttaaaattagttggcaggtaatagtaatgccacaaaaacatgcagtgcgtaataatattgaggcatcagaagtgaatgctgttcatttttcagaaatactagacaaatgttgttcatcagaagtgattccaacaagttgtctgctcttgtaatctcacccatacttgacagtgcccataatacaagtagatcaatgagccattccacatgccatattttctgaacaaagtacaaagttcaaattgaagtagtaagaaaaatgagtcatgtgcagctttagttcaggcctgtaaaaagctcttggcagtcggcagaatacaacttaaatctgaactattttggtacatggttcaaatggtctaaaaaataatttcctaggttggtccatttttagtagatcttgtagaaccatgtaatgaagaaattctggatgtaaaacatgatttttgcagctattgcttgcttaatctgcagactactgatttttgcttctactatagctactattgaatccagttttttgcttgctcaatcttatatgtgtcctaatttcattttgatatctgaagcactgctagcattagtctcatatgcatatccatgtttctagccctgctagctattg

SEQ ID NO: 93537 - DNA, 732 bp, Oryza sativa
cggttgcttttagtttctggatatttctctggccagtactcaaaaactggaaaagaaatgaatttttagaatggtgattttgtatggtttggtcttcttattttctacaacgtacttgattgttggactgtgaagattacggaagtggtttcacaaggctggaatggaaggttcattgttcagaatttggcgctgtgagatggaactgtgcactacataatataatcatacagttgctatgatactgaaaagctttgagatatactgagagaacaaaatggtttcagtgaaaaatgaagcaggagcatttgccacgtgttttcaaaaacacacagatgtcacaatgatttattgtgcaacttgccattcaagtccaatcttttccattgtgctgtgtgattagtcagctagtacaaaataacactacgagccatgaattgctagagttggataatcttgaaataatattgaatggtccagatttgtataatttgggatcttgggtacctcctaacttacccttcaaagtttcaagttactatcggtttctttcaattgacacaacaaaggtgtgttatcaggttttgtactttttttcaatttgttaattatgtgctcattttatgcatgaagtgaggctgaaatttatctatttggagcctgcgtaacatcttggaaagtccccagtggaaaagacctcctatttgtcagaccagatgcggtgttcaacgg

SEQ ID NO: 93538 - DNA, 9728 bp, Oryza sativa
agctacacatcatacacagaaaaacacaatattgcacaatctagagatgccgtagactcgaatagtcattttccatgtaaatatgatattataattaactcatgcgtaggctaatgtagcaatagggatatggacattgtcaaaagtggtttaaaagaaggttaattatgatgatatgtggtaactggagcacgacctaatttacggtgatcatccataacttaacattgacaattactcttaccgacaataaaaaaaggttcatgactaatgaaatactaccagatttgagtattgtactgcacaagctggtgtacttgcacgacacaaacttgttttcagataaatatcccatactgcaatacttttgaatacatatttttgtaaatggagatgtcattggagcggtccgaagaactatgatgacatggtaactcaagtacgacctaatttacagtgatcatccataacttaacattgacaatcaatcttacggtcttaccaacactaaaaaggctcatggtgaaatgaaatgctaccatatttgagtatttgacatgggacaccccataccaacttgtttttagggggaaaataaatatttaggactggttttgtctggggcttgaccttaacaatttttgctaatgttaaatttcggcatagcctcttttgacaatgtaatactattaaaaataccaaatatttgtaaggccaatttaggccacaaatgaaaccaacctgaatctcttttattaatatattcttattctatatcctttataaatgaatttccctaaaaaattagccccaatcctatatgcttaatccataaattattctaaccatcaactaaaaaaaccctaaaaaagtttattcttgcaattgctcatgataccctcttgtagctcataggtatattttttctaaagttcaatattgtcgacgagtgatactcgcggaccggatgagtagagtattggggtacgttggaacgagggtttacatagtacgacatcaaagcagacaaaaggcaaggattatactggttcagacccttatcaggtaatagccctagtccagtttatatgggattgatgatgatgagaacagattacaaagagagtagtcaaaacagatgataccgacgagatcgtagtcgagggtttcgacgagatctctcggcaagttggctccgcgtactccagcttcgtaagctttggtgggtgtgttggcgaagagattctgatccgaacctctcccaaggggtccccttttataccgtgagtcatcttgatccccaagaaaggttttgaggatatcggacctgggacggtctaacggaaactttatcccttacgagtagaactttataaatcacttgactcgtaaagatattttccttaatttgaagtaacttccatacgacatatatgtaaataatccgtatacgtaaaggtataccatattggtatatttcacaagtcgcaggatagaaggtatgccttatccgtaaccctgacaaatatccctcttactaactagaaataaaataattagttcaaactcccaaaatggtgctatctatatagacactatatatattaccatttgcaaaaaaaaaaagaagaagaagaagaagaagaaaaatattcccttcatttttatctagttgacgcgggttagttccattttgcactaaccaacatcaaattttttaaaaaggagggattgtatattatcacaatagtttttaatacatacatgggaaaggccaaaagtcgcataacaacaaaagggtaaatgtgcttttcatcgaagaaaaagaagttcaaaatctacccttagtccaaatgatcatgacaaacaaaataggacataatccctgcggttccataattcttgacgtccttaccaataacacagggcatcattttttcgcttatgcttatatttatcagccaaaatttgaattttcaaccttaaatttggagctgattttaaggatttttttttatcgaagtttatttttcagcttttgcttttagatcgctaagaacgcacatataaaaattttattcacatactacttttcgtttgcaaatatgccatttcgcttattccgagaataagtgaaacaatggctccaatagtctttaaaatatatctttgattatgtttttatcttaaatatatatacatatataataaataaatataattttacttttatcataatatttttgaaaaataaatatctctatgtatattgttctattatatttataaactaaatacttttaaattatttgtacttctaattaaatttataaaagtttcacctcgaccgaattatgaaaccgttgcgagtataagagaaaacacaatcttaacaaaacattaagatgaaaaggatgaaacttttcatcttaaaaaaccgtgcacaaaacacaatcctaataagtacttcattcgttttatattataagactttctaccatttcttttatttatatagatgttaatgaatttatacgtaatatgaaacggaatgaagtagtaaaacattcagatgaaaaagatgaaacttttcatctgaaaaaccgtgcaccaccagatgagcctctgctttcagatctcaccaaccaaccaaaaaaaaaaatctcctctcttcttatataaataaggaactctcccaaacccctcttctccgtcctcctcctcctcctccctcgccgtccgccgccgccgctcgcttcctcccctctcccacggtaagcccgcgccgccgctctctccctctcctccgtcacccttcccttcctccgaatcggccgagtctgtcagcgacggagaccgcgccgggatccgtgcccattcgcgtagtagcggcgagcgacggttttttttttttttgcctgcaaagtcggtcgctttcgtgtggcgtcgggtcggggagaatggatcgatctgttcgtcttgatcggatggattgatcgatcaatcgatcttggtgggatccgatctgaatgaggtttttgggttaggaaatggagtgaaagattggactttttttttgtcggtgtgttgcacggttcgtttaggattggatctgtgttttcttccgtggaaaatcttccatttttcactgcaagtgcacatttgtggcctcttcagtacttgtgtttctaaacccgaggggtttttggatctgacaccgaggtttagtccgtgttgtcatatgttttttctcaaatctgttacgatattctcctattataaatgcattacggtgtactagaccctgtgatctgtggagtacatgttaaggtcgtgcttccagtaccatcgcatctactgtcatttggttgccatctcgtattatttggttaggaatttgcaattgcctgcatgctaataaatgaattgttgtttgtatggcatgccaaacaagatccaactactttgctgctggtgtgagagggacagtgtctcccaccaattgtagttggtcttatgtacccaccactttgggctgggtcctactacatgctagtgctggttggtggtgtacctaacccatatactagtatcagtttagtctattcttttagcaccactggatctggtgatatagccccatgtataggaatcaggaagattagtagaacagaaaacacaaaagtatgctttaatagttggatggcatatacctttattcggatcaccgttccaaatgtgacgttagtatccgttagtggcatgctttttaatctaacaaggcgttcttcatcgtgtggttagcatatggatatgtgtaatcttgttagctaaatcataattttcgtatgtattcacatgacatttcgatgaatcaaactgatcgtagtacaattgtttctatagaaagatggcgtctcacattgttggatacccccgcatgggccccaagagggagctcaagtttgccctggagtctttctgggatgggaagagcagcgctgaggatttggagaaggttgcgaccgacctcagggccagcatctggaagcaaatggctgacgctgggatcaagtatatccccagcaacaccttctcgtactatgatcaggttcttgacacgaccgccatgcttggtgctgtcccagagcgctactcatggaccggtggagagattgggttcagcacctacttctcgatggctaggggaaatgccactgtccctgctatggagatgaccaagtggtttgacaccaactagtaagtactttgcttccatttaagatgtctgacagtaaacattttatttaatttttatattcaacattttagctaactggtgctgtttacctttacagccactttatcgtccctgaacttggtcccaacaccaagttctcctactcttcccacaaggctgtgaatgaatacaaggaggccaaggcggtaagataatagaattatatctttacatctctgtctgcttaatgattttttttctctgcctgactagatgtcgctagcacattgcttaatgtcatcaatatcctagttcataaagttatttattagtttattttgttgccttttgttatgatgctaattcaaacatcaagttttagtagtgatcaattgtttcttagttgtgcatttatataataattttgtttagaaaagaatctgatgtagattaagtgctggcttgtaaattatgttttggaagattgtcacttccacagattaatggcctgtaaatgacaagcccaccaagtcagttcgtttctttagtgctgtattaatacggccaaacaaattttggccccttgcttagaattttgaatgtagcactttcagattgactatgactagagttcactttaaaggttatgaaataatttttttgcactatatgttgttttcatcttttttcaaaaagctgcccatgttgatctgtggcaatattttttttttctaatttcacatattctttattggtgattggtgaatttacctgaaaagttctttgattaaatatgttatcttgttccagtttgtgaatagtggcactgctgtttcaagcatcaaattctgaattttgttgtagtcctgaaatgaaaatcacagtgccctatttattaagatgtaatctggttgccttaatgtctcctatgtaattgttcttcatgcagctcggcgttgacaccgtgccagtacttgttggaccagtttcatacttgttgctctccaagcctgccaagggtgtagagaagtcgttcgctcttctttcccttctcagcagcatccttcctgtctacaagtaagtgtacaaacaagtctataactactgctagcgctaaatcttcagttcataatttgatgcatgatgatttgtagggaggttattgctgagttgaaggcagctggtgctacatggattcagtttgatgagcccacacttgttcttgaccttgactctcaccaattggctgcattctctgcagcgtacacagaactcgagtcggcactttctggattgaatgtgcttattgagacatacttcgctgacattcctgctgaatcatacaagtatgtttatttcctctactatcgtatcattatcgaacctgcctttcctttatcattcttctttttatagtggcagaacactgaatactgccttttcactgcaggaccctcacatccctgaacagcgtgactgcttatggttttgaccttatccgtggttccaagactcttgaccttgtcaagagtgctggtttcccctctggcaagtacctctttgctggtgttgtggatggacgcaacatctgggctgatgatctcgccgcatctctcaccaccctcgagtctcttgaggctattgttggaaagggtaagcaattaagcatgaagttattatatatgttatattttaatgggcacaatttgcagtatccaataatatcctcaatttctgctcatccaacaatacctttcatttctgtagacaagcttgtggtctcgacttcctgctcactcatgcacaccgctgtggatcttgtaaatgagaccaagctcgatagcgagattaagtcatggcttgcttttgctgcccaaaaagtggttgaggtgaatgcccttgctaaggcattggctggacagaaggatgaggtatggtactcttttttgccctttatctattctcacctcttaattagagcctgagcatagtactcattactcaatagcatttgaagaaacttctgctcatttatacatttgtgaacaatattgtacaggcttactttgcagcaaacactgctgctcaggcctccaggaggtcatcacctcgtgtgacaaacgaggaagtccaaaaggctgtaagtaccttctgtttttaggctgcatgcttgattctattcaacataacttggcctgtttttcttaatatcatgttatattgcttgtgcaggctgctgctctgagggggtctgaccaccgccgtgctaccaatgttagcgctaggttggacgcacagcagaagaagctcaaccttccagtccttcctacaaccacaattggttcattcccacagactgtggagctcaggagagtccgccgtgagtacaaggctaaaaagtgcgtaacagtccacatcaacgcttcaccgttttcccccttttttttgtctatattgctaattacaattcctgctacaggatctctgaggatgagtacgtcagtgccatcaaggaggaaatcagcaaggttgttaagatccaggaagagcttgacattgatgtgcttgttcacggcgagcctgaggtcagtatcctcgtgtactacttgtgtttagtgtttattactagactttacacttggctgtttgagaaaacaatattattagatttattgactcattaacaaagtttggtttgttctgcattgaagtaagctaactggcatgtattttacagagaaacgatatggttgagtactttggtgagcagctttctggttttgcatttactgccaatggatgggtgcaatcctatggatcccggtgtgtcaagccaccaattatctatggtgatgtgagccgccccaacgccatgactgtgttctggtccaagatggcgcagagcatgacctctcgccccatgaagggaatgttgactggtcccgtcacaatccttaactggtcttttgtcaggaatgaccagccgaggtccgtgcctgttgttgatgatgcaatgctaattattcaggttgcgattgagctttctgttgaggctgacattttcacacttgctcaggtttgagacatgctaccagattgctcttgccatcaagaaggaggtcgaggaccttgaggctggtggtatacaggttggacctgttctataattttgttctcaagtgaatacgcaaaacatgatcatcttgcttacgtctttttaattgtcctttacaggtcatccaaatcgatgaggctgctttgagagaaggtctgcccctccgcaaggcggagcatgctttctacttggactgggctgttcactccttcagaatcacaaactgcggtgttcaggacaccacccaggtaatctttcttccatcagactgtcactgtaggctttcaatatcatcaccaatcttctgtaacttaaactgaacaactttctctcgacagattcacacccacatgtgctactctaacttcaacgacatcatccactccatcataaacatggacgccgatgtgatcaccatcgagaactcccggtccgacgagaagctgctctctgtcttccgcgagggtgtgaagtatggtgctggcattggtcctggtgtctacgacatccactcccccaggatcccgtccacggaggagattgcggaccgcatcaacaagatgcttgcggtgctcgacactaacattctctgggtgaaccctgactgcggtctcaagacccgcaagtacaccgaggtgaagcctgccctcaccaacatggttttggccgccaagctcatccgcacccagctcgctagcgcgaagtgaggatcgcctttgcagcaagttcccttcgattttgaggaggaatgccatcatagccatcttgtttttgaataatctgggtccagtggatccactgtctgtggttaggtttagtcagtctcttggggccaagatcactcatacccattttactttgaatgaatttggtggtttttgaggcagtctgtcggtgtatttgtattgtaaactgagtggaaatcagcagtgtttcatctacatctgagttgttgcggatcaaattacaaaattttcaaggagagttgatgttatgttctgccaagtacccaaggcttttgtctggttttcacccgagttgatagttttctgatgatttcttgctgtgttatcactttgcattcttttactcgtgcttatgtgctgttcatgatgatatataaatccaatcacttgaaagacttccatgttgggatttgaacacaaattggcttacttctgtaggcatattcaacaatagcaaactcttcatgttcattaggaaatgaaatggattgaaaatgtaacaaaagtatacttgcaattagtagtacattttggttattaatgtggtgtttcagtatacacatttgcaggtgttaatttacatgtaatcacattagcttaattacatatcattcacatttggcatctgtttggtcagagacacaagagtcaagagctcaaggtgcgccacacggatacgatgatcccgacgagcaccgccgccgccgccgccatgttcaccatcagcctcctctcctccgcctccctcctcccacctccgctcgccgtcgccgtcgccggcggccgctcctcctccgctgctgccgctccagctcgacccatttcttgcgcctccttctctctcttctcctctttcctcttctgcttcgaaagcggcgtagtcgccggtagccttggatcgccgccgtttgctgctggacttggcgcaggaagcggcggccgtggcgagtcttttgtgctcggcggcgacgaggatgtcggcttgccggcggcgggctttgctggttcaggggtgatagccggaggcggggtccaataccgctgtgacggttgctgcggcggcggcggcggcgatggcggcggtggctttggctttgttggttccggaggagtcactgccgttggagaccaataatcctctggcggcggtggcagcggcgatggcggcggcggcgagggctttggctcgagaacacgtggcatcttcaccggagctcgtggtggtggtggtggtggctgcggctttggctcgacaacggcaggggtgtcccccggagttcgtggtggtactgtaggcggcggcggcggcggagatggtggtggcaatgttggtggcggctgtggcttcggctgcacaacggggggcttcaccgacggtggacgtgtcggcggcggcggcggcggagatggtggttgcaatgatggtggcggctgtggcttcggctgcacaacggggggcttcaccgacggtggacgtggcggcgccggtggcggcggaggaggaggtggtggtggcaatgacggtggcggctggggtttcaccggaggtggacggtgcggcggctcaacgcgcgtacgagtacgaggaggcggcggcggcggcggcaccggcgacagagccggcggc

SEQ ID NO: 93539 - DNA, 1067 bp, Oryza sativa
atctgcatgctcaagacttataggggtgttcccttattattaccagctgatcatgatgctgctcgatattcaggctcaacctccacagttcatgttccgaagtaatttttgctgctcaacactaatgttctatctcgatgatcgtaaagcttctcgacaataatactccacccaatgatcttttttctatggtgaaaccacttaaccatgttctaatttatattatatcatccttttacaagattttccattctaatttttctcttattcctttctattaggtactattttcacacctctcaatttaggaggccctacccatacttgccaacattgtggtgctcgattctggtatgaggaacgcgtacgtgggtgtggacgaacagctttgcaaatttacaacaaatgctgtagaggagggagcatttatttgcctccatataggccaccaccagaacctttgctctctcgtttaactggacgagatcgtgttttgtccaaccacttctttgaaaacatcagacgatacaattctatgtttgctatgacatctatgggtgtaaatatcatcaactcaattaatgatggtcatggcccttacattttcaagattagtgggcagctatgccaccgaattggatcgcttattccaaagcatggtgcaagaccagaatattgtcaattatacatatttgacactgagaatgaaataagaaatagagtggctgttgcttcacatagagagatgagttttgaaccaaatgaggatattgttgcatctttgatgaccatgctcaatgcacacaacccagttgttcagctctttcgaactgctcgtgataggctgcatgatcagttagaggatcattactcagtgaagttatttgccacccccaatgaacatggtaatatctactcagccccagttgcatcagaggtggttggtttgatggttaatgatataggcactaccgagaaaggtcgtgacttaatagtagaggatcactcattgcagcttcaaagggtaaatgaaactcattgcaaatttatggcaatgcaatacccgc

SEQ ID NO: 93540 - DNA, 1798 bp, Oryza sativa
tgaaccatttacttctaatgcagggccacacaagattcaaggaattggagctggttttgttcctggggtcctggatgttgacctcatcaatgaaactgtacaagtatgttatgcttctgtattaagttgagctgtagaaagacatatatataatttagcaccatgttttttttctctcacttgatccatagctttacttttcttcattcgaatagtagtcggtactagatctatattattcatgatgtcttagcaaatatctgcttcttttaatctggtatgaacgtttggtgcattgaactgtttgacaggtttcaagtgatgaagctatcgagatggcaaaggctcttgcattgaaagaagggttgctggtaagatttgtgtttgatgttcatttctgtgctctattattaatctgtaggtacacaaattgcttttgttaagcctctctatgtacggatcattcggatggtacctttgctgaagtcatcagtgatgtaaataattgtaggttggaatatcttcaggtgcagctgcagcagcagctgttaggctcgctcagaggccggaaaatgaaggaaaactttttgttgtaagcgtttcatttttcttacctctgaatttctaatgccctgtggcttaaagctacttcgactgcacctgcatttgtttatccatttggtattttagtccaaatgtacagcagtacagatatactccaaatttacactccagtgacctagaggaaaagctaacgaatctgagttcttgttttgtcattgtggcatctataatttcaattcgcatagaacgaactgccgtcccaaaacaagcactatctccacatttgtcatgacccaaggccatgacgggataaacccatggacaacattgtcgatttgtttcatcatgctcatccccacactaacacctttccctcaatgtaggttgtcttcccaagctttggtgagcggtacctttcgtcggtgctcttccagtccatcaagaaggaagctgaaaacatggtggttgaatgaaatgcacaatatccgggaatccacaggaataaaagtttggtatctctgcttgtgtgattaaacatacattgtcctgccattttcaagttgttctgcttgtgtagcaatggggaacacagtgtgttagccttgtagtgttaaacagtttacattttatcttccctgtatatcagaaccctttacatgggcatttgtcagccagtgtgaatgaaataaagcatcatatgatttgtctcatgttttgggatctcgtctgaaccataatattcttataagagaacaaggccctgtttagttcacaccaaacttctcccaactttccatcacatcacatccaaaactttcttgctcacataaactcctaactttttttccaaactatcaacttttcctaaacttctccctaattttaggaactaaacacagcccaagtctcatgttttgggatctttctctgaaccacaaattctcataagagaacaagtctcatgttggatctttctctaaagtctgaaccataaatattctcacaagagagcagtagtgctctgaagaatgacatcaggcccaaataagggttgtaccagtttatgggccatgggccatgactgacagagaaaatacaaaatagtagtactgatgaacattgatgctcctagtccttgctgctgctgctaactggcttttgcaggaaaaaggagccaacatcagtcaaaaaggtgcaatgcaggctatgctcatgttccaggaactgttttggc

SEQ ID NO: 93541 - DNA, 8041 bp, Oryza sativa
aagacgaatggtcaaacatgtgagaaaaagtcaacatcgtcatctattaaaaaacggaggtagtactcgcctacagtggttagctttcagttctttccaccatgagatccactatagagaacatgaaaatgacacttctttcccgttgcattcttagagcaggtacaatagcaggctataagccagctataaccacatatcgagaagaaaagagaagagagagaagaaagcgggctacagatttgtagccggctgcaacacggacttcaatacgttataagtgtatgagaggtaggaccgggtattaatgatatagtatatttttatagataactattgtatgaatgggatattagattggctatagatgatttggagccaacagttggctatactattgaacttgctccccattactagctctaatttacctatagccaatctaatagccaattcatacaataattgcttactatactattaatatatggtctcacatatcatacacacattgcgtcttggagttcgtgctgcacctggccataaatctgtagccgctgctcttttatctcatcttttatctcgttaaaatatgtttatagctggctaatagcccgctattgtatctgctattaggggtcatttagattgcttcctcactttttgtgagaatgcggtgctaaagttgtgacgtgccatggttttttctggcactaaaacaggtggaaattaaataagaacaggtgatgtggtatggagttatgatgcatgactttacctactaaggtttaaatgatttccctattcactttcaaatcaagcgacatcaacaatttgccacttatgtcgagtatgtttagggcagggtgtgcacttatatgttttttaataaaaaaaattacttggaaacattgcgacaaacttttaaagcttgacgagttagaactgtggcttataaataaactatgaaggtatccacgcttatacgcgggcactttattaatgttgtttaaaatttgtattacgaatggttatatgtggttgacttttttttaaaagtatccgttaacactattatatctatcttcatcaataatttgtttaggatcttaatccgtggattgggggcgtgtgcagcagcattaccgggcatcatgggagggagcgacactactccgcccgttaagggaagtggaggcaaaggcagcggtggcggggaaggccggcggccacgctgctgccttgtcgcctgggcgccatcgtcgtcttcttcgcactaggaggagctgaggacgcgggcgtggttgtcgaggctagaactgagctgacgagacaagaagagtgttggtcggttttttccgagctcttcgtcaggggatcctatcgtgggcattaccagggagccgtcaccgtccagatttgcatcactccttgtttagcttctcaacctccaccacaccgcccgagggaaccacctagtcgccgcatgccatcccatgggcttcctctctgtgctcacgcgacaagctttttcgatgagaaaaaattcctctctaattaatttattatcatagtatgagcctctcctaccatttctcgtcaaaaaattaaaaagctttggtgatgaggttagcatggatccacaagctccgtgtggcgcagatctagcagcggcttgacatggatcaagccataacgctaagctcctttgtggctataggggaaatatgtaattgatgggggcggcgggcgtggagtgtgaacaacctcgacaatggtggcctctcctcaatccggtgttttcgggcgttgatctaatggggtggcgactcaagtaggagatcggggtgatatggtccccaacaacgagctcaatggagcactatttttttctccatgggtaccgacgggtgggcccactgtttttctcatgatgcatgccactgccatgttagccaatcttgtccaaaaccacccaaagagtgttgattgggggggggggggggtaattcgtccggtttgaaaagttagagatattaaatgtctggttttgtagtttaagcggggtaaattgtattatcgtaatagttcaagtgtaattccgacattttccgctatagaatgcacactaaggttgtgttttttcccctttttcccaactcacttccctcgttttccgcgtgcacgcttttcaaactgctaaacgacacattttttgtaaaaaaaaatttatatggaagttgctttaaaaaatcatattaatcctttttcaagttttttaggctaatacttaattaatctcactaaattgcgtgcttcgttttccgtgtcacaagcaaccttgcctcccgaatacagcctaatcattctcctgatacatcttaaggcccgtttagttccccaaaattttttcccaaaaatatcacatcgaatctttggacacatgcatgaagcattaaatatagataaaaagaaaaactaattacacagttatgggggaaatcgcaagatgaatcttttaagcctaattagtccgtgattagccataagtgctacagtatccccacatgtgctaatgacggcttaattagtctcaaaagattcgtctcgcggtttccaggcgagttctgaaattagttttttcattcgtgtccgaaaacctcttccgacatccggtcaaacgttcgatgtggcacccaaaaatttccttttccccaactaaacacacccttattaccaatgtatcccaaaagaaagtttaattgcatagttagttaaggttacaaagtcatgcagtatggtaggggcaatattttagaagcaccatacgtcatgctaatgtgagattattcttgaccgcttcaacttgattaaactgtttttgcatgaatatctctacataataaccatatgaaattcatgactttacctcgattttgtcaggagcacgtcaacggtggactggtgaccaactggacacacttatatatgaatctatacaaatgatagtactccctccgtctaaaaaaaaagacaaaccctggtttccgtgcccaatgtttgaccgtccgtcttatttaaaaaaattatgaaaaaaattaaaaagacaagtcacgcataaaatattaatcatgttttatcatctaacaacaatgaaaatacgaattataaaaaaattttatataagacggacagtcaaagtttgacatgaaaacccagaatttatcttctttttttggacggagggagtatgtgttattggaagcacgtgaggtatgaaaaaaacagcttgcgtttgttcgagattggcgtcactccttggagcctgatgcagcttctgacgatccactggaatccagattctgatttgtggtttttctattagcgatgaacttcacgtgctatttggaaactttactttggatgccatttggacattggcatcctcttctgagaccacagaaagtactgtacatggtttctcacttcagatctgatctagtgtcagcttacatataactcatcacctgaggagccgacagagctgaaagctgagtctgtgttttagttcagcgcaaagtttgaattttaaattggagatgatatgacagaaaaattgtgtgagtatgatagattgatgcgatgaaaaattactgaagtttagatccaaactttagatctaaacacagcctgaattgtgttccatctaagaaatcgagttgtgttgattgttttagtagagatttgcacgtttgattgcattgcagcttaagtgtgttcaggtgtgctaggatctaaaattctaaggaggctgtgattttgtcgttgttgatgatggacaaatttgaaactgtgggcgacaagttgaatgatgaactacagaacataggagctatgtattttttaagactaaatttcataaaaacactagatattaagttagactaaatttcataaaaccactagatattatgacttaagttatgcaaaatcacatgggttttgaaacctgacgcatacccaattatgatcctatagttttataaaaccacgccattaatcaacttggctttctttactagcaaaataaaaaaaatgtggttaacttgttatagaatagatcgatgaatccatatatttgagatatgattttagaacatatcatataattgcttaacagtatggttttgtgaaattctagagcgcaataatccaagagttatatatcacatgtcaaaacccgtgtggtgttgtgcaagttggattatgataccttgttacatgaaatttactctaaaaaataaagggaaaaagattgcctattgtattcccccaagtaacttatgtgcttcttggaaaaaacgatttgtatgttcagacaaaatcacagaagttctgagcatatacacccaagctacattttttaactgatagtgataacagggcataaatacaccttttacaatgtacagattacatggtacataaataatatgctactctgcaaaattactaacttaactaatatgtacacgatctgaaaatggctacaaaattccctgctgtcctccctgataacagggctcccagcagatcatttggcataatcaattgtagctggtcaggaaatattacctgagcgttatctcggaatcacctcaaagcattgataaataatccttcatgccacaaccacgcaaaacctttcgttcttgcatattaagcgaacattactcagaaatacaatggtattgactggtataatgatgcggtattgctgattcttaccattgattcccgagatcatttgttccgcccaaagtacaagctatcagaagcaaaaggggaagacctatttaactatcaagctccacaaccattgattggaattcttacattttcataacctttcagcgtatcttgggtaaaagattccaatgcttcaaatattggacctagacctgctttcagatctgttgcacttgactcttggatttgattcacggcttcctcatgcctagatctttgttcatccaatctcttatgcaatgcgtccaaagctacaatgcggctatcaactgctctgttattttcggcaacaggcaacaccgtcttatcagcttcatgatgtccagccaagccatgttccttttgaaaagatttgagcctctttgcataatctctagataaatagtcagctttcagcttctgttgctgctcttcgtcctgccgctcccgtaacatgtgcacattaacagcgaaagcctccattgcacctatgacagtaccttctggtatccttttcatgctttgacaccaatcattagctgtgatgaacacagctggagctccaagcctaccaggagaaaacggtgcgatcccatcaggtgtttcctccttttcctcaggaagccatttgactaaccagccattgagagtttcaatataagccttttgtgacaggatccaattgctgaaacaggaacaccagttcaaaagttccatttctagttcgagtgtaatcttggagttcctttctggcccattcttagggataagaacatgagatttagtttcgagtatggcatgaaattgcttccgatggcattcaagaatgaatttccacattctcacaagcctacatcagaacgacaacagtttacagtctgttcacagataaatcagctttgtgacaagtattggaagccgtgcagaggaaataaattgttatgaaggcaatatctatctcccaagaatataagctcagacacaaacagcaacaaagaaagacacatgagaggctacatttgctagcaagacaaatgtgctttccaaaagacaactggacttcctaaactaaagatatcctagcattaactaattttattagtgtgatagctattttgcttaaaaaaagtttaatgatatgatatacattatattgactagctaatttcaggacatgtttcaatggatcaaatgactatgaaaccattgcagcatgcagtagtgatattgcaacataaagaatgcaagataaactaaagaaaaaaaataagtacttaaaaaaaattctctgcaagaaaacaagggtaggcgggtgtaatgacacagtgactatttgatggttgatccctttgaagaatcacttgagtagaaaagtgtagaaatatacttttcatacccttgaataagtttaacaagatgtggatgtagctcatcgtctcgtagtatgtgaatcctcctagaaataactttggctgatctaattgtaatgttgattctggtgagcagtgtactaattgaggcccgtgtagaatcaattttatatggttctgcaccattgtcgtccaactctttcaggcgcttccattgtttgtcatatgtgatcctcaatttttcttcctcctgacaattaatttaaacaaactgtcaatgcgatgctcatgaaaaatgcaagtcacgagcaagtgtcactctatcattcagcagcaatttcttttttaatgagtaattcagcagcaaaataaattcaacaccacaataggacccttttaattatatcaagataagcagtgcattttgagaaaacaattttgacagatgaagaatattacataaaagtataggagaccattatcagccttgtgatttgtatgttttgagagtaacaagaatttatcaagacatttcttataactaaagtaccataccataatttccttatgaagcctcttctcccacacgtacaacctatccattactgaagaaagagtattaaactcaatatcactggcactaccaattctttgactcgaattatgatttcttccagatgcacttaatgctgtctgctccaaattctccacagggggctcagatacagaagaaaacaacaaggcaaaggcccccatcaaccgcgaaaataccactgcatcaagtataagtgacaaagtgtttaactgagtaagaactgtctctggagaaaatgtgaaaggaaggtgggcaagaaatcgtgtcaacagatcaatacaatcagaagaaagcacatacgctacacaagatctctttaatgtagtactatttgtcagtgctaacttattagttataagtggacttgatcttgcattggagtctgatgctgctagtattcagaattttcttgcagtgcaatatgtgcatagcaatcaaatgaaatgaaaagaaaagcatatactcacatctcacaattcttctccgaggccggtaccgcatacttccgacctcaaggatcctagcaacatcgtctccacaggcgaccacagagttgaactgctcctttatctcattcacaacatctgcaacatcccttgtgccgaagttcttcggcagcacatcttcagccactaccatggacgagtgctcctctgaggccaccttcttcaccatccttggatcatctccagccggcgccgcagttgctgctcctgctccggcattgccatcggcatgatcacattcacagctgcacacactctcctctccagaatcaagaaccgaagcactccccacactctcgatctcgcactccttgtgctccatcgacgccgtcttcgccttggcattcactgcatcggcattgtcaatccgggtggacgcggtgctctccaccgccttcctcgccttgatcgactccctcatcgactcctgctcggtctcctcctccagctccggtatcccctccctttccctcacctcgctcgagttggggctactcgtgaacgatccattggcatccttgtactgcggaagctgctggttgtagtcgtaggagtcaaacgggttgaagaagtcccagggcgagacctccggcattggcatcggcggcggcggcgccggtgccgccgccgccgccgcctcccgggcacgatcctcggccagccgttccccatccgggggcaccggaatgccgtacattgggttgctgtacccgtagtcgtacccgttgtaggagacattggcggcgaagttgccgtagccgtacggttcttggtacaccgtg

SEQ ID NO: 93542 - DNA, 6342 bp, Oryza sativa
cgggcgactgtttaagcgccggctctacttgcactctaaggtaagtttgagcaattccagtaattcattgccatgcactgccacttatgttaggagagagagtgcatggcactaggaggaaaatgattgtttaaagaataatgcttttattactatggtatgactgcagattggagtaagcaccgagctgtactactagacttgctctaagagcaggtacaatagcaggctataagccagctataaatatattttaaagagataaaggaagagagagaagagtagcggactataaatctgtagtcagttgtagcacggactccaaaacgtaatgtgtgtatgacagatgggattagatattaatattatagtaagcaactattgtatgaattagctattacatcgggtataaataatttggagctagtagtgggctgtactattaacttgctgccatcagacaatctgggaggatatctgcaagcagcgatttggtgatctctgcaaggcaccggagaccgcgtaccattggccatcagacaatcaggcgagtacttgttcatgtggagcatggagatccacaggattatatatttcaacatgtttgtttttgccgttttgcgtccatttcatcatggtcataagctcatggacggccatggctgctatttagttacccgatattgcttgtggccaacgaggaatgcatatttgaaaaggccacaatttctaacgcgataaaaaaaaaacctcctcaattacttacttactctactgatgctatgtaaggctttgttcagactaactgtatgactatatttttgataaattcagacctcatttgtgttagtgtgtataaatacttccatgcagtcttcatcttgaaaggtactacccgatcgagctgtgtctagcctgtgggcacaccccccaaggcaatctttttttaaggcccactgcaagttgtgaagcgatagatagcaacaccaaatataaacacgagcaattttcagatatttatgagcagtttttgggatcgattcaattgcatgccggaaacgtgtgctttgagaagagcttcccgcggaaaggcgccaaaatcgcccattcctcctgtgcggataagggcgttggccgttagtgcaggacactcatatatatgaggatcctccttacgagctaccactagaacggatacccttatcttaattaggcagtaagccccatctcaatcgggcacagcgtccgtcacagactagaagtcactgatgtgaagaattatctcaatcgggcaaacggccgtcgcgaatgaatatatctcaatcgggacctaagtaaaacccgtcacagatagctttgacccagacgaccagtcaaactatagcccgtcacagatgacctatctctatcgggtcacaactagcgcccgtcacagatgactactaacctttatcgggcctaaactagagcccgtcacagatgatactcatctcaatcgggcctaaactatagcccgtcacagatgactgatgacctcaatcgggcctaaaatagagcccgtcatagatgactactgacctcaatcgggcctaaactagagcccatcacagatgactgatgacctcaatcgggcctaaaatagagcccgtcacagatgactactgacctcaatcgggcctaaactagagcccgtcacagatgactactgatctcaatcgggcctaaactagagcccgtcacagatgacctcatttcaatcgggcatttagttatggcccatcacagatgactataatacacaaaaaaaaataaattttgttttttggctagcctcagacctttgctagccatgcccgctgcaaaaatgacagaaacaaacacagatatccaatatccctagctccccagcatcacccattcatatacatatgcattcacatacagagacatcaacatatttcacacaaccacacattcacagccatctcatatttcacatccattcacatatttcacatccattcaaatatttatcatgtttcacctgcaaaaccgagttaattggatcaaatatttatttagcaagtcttaacataaacatatgaaatatatacataaataaaaacatcacagttacatcatcacagttgcataataagtgttcatcattgcctaaacataaaagttcaacattgttcatcattttagtttaagcctaaacattcctttggggttaattatttcgcggaggatgaagctggctatctcctcgcgaacctcctcaaagctggtaggcagagacttggttattgtgccctacattgtcataattccagattagttgatcgatcatatataagtactaaaatgtagttagtctatcacaattgagaccaccgacctcaaactcaaccaaagtcttcaccttttctctatacagaaggcgcatgttgtggcacacatggaatccacactggtcacctatttgttgcttcactgggaagtcttttttgtggatgagggtgtcatgtcctgtcttcctgaggcctcctctttacacgtattgggcccacgcttcatctattgctagttgaattggggtccaatcatatgcgttcttatcaattctggagttcaggtagtgacatgtactccacttaggtgttatgaccagaaggatccaatgggcactgcggcattaatatagtgaaagttaattaagtactcaagaaatgtgtcatgctgttgtgtatatttagttaacacacttactattgattataggcgcacataatgtactccttgtctcggcgggaccacaaggtgtcgtagatgtagttgaccattccttgacggtcattctggagatttgtgacagtgaccacttgtggatcaaggaaggcaaattccggtgcatgcttctgacaccattgccaacttaacctacacacatgataaacgatcttgtaagcaagttaaaccgattgttattaccagattgagttgggcgacaatacatacaaggagtagcacttaaggaggcttgtgtccaccgctcggagcctgtagaggtcgaaaagatccttgaagtcgaccacgatataatttgttggaccgaggaatggcttttcatcgtgctctccaaggatatcggtagctttacttagcttcctggcgttagatttctccatgtagtataagtgaaggtccttgcaagcggtgcccattgcggcaagcacgtcatctccaaccaatggcatgcctagttggaactcctgtggagcgacatatttcttcttgacctctttgcccttagtctcttcctggcccttgcccagatctagcttccttggagctagaagcgaggcctgcacctctcctccccttcctctcccctttgcttcgggtttaacgagagtaattctctgaggggaagagtgtgccttcctgctcttcttcatcggtggggttcatgaatcgccttgctgtcggcctccgttcggtcctccccaaaatccgtgtcgtactgcaactacacatcgtaagattgtgcatgacgatcttgagcaggaggggctgaaggagcagaggcgggtctctttggtggacaaccgcctggtgcagtggttggcctcgctgtaaccctaatctcaatgagatccttgggccattggatgaaggtaccacgggcatttcctagtgagaggacctcgtcgttcggtggatacttcagagggaacagcttgtattcgggcttcaccgagtcgacttgaacttttgcacagtcggccctgagttgcgctccatgcactcttgtctctggggtcggcttgtacgcaagtccctcggttgctggaaccgtgaaggtcggcatcaccctaactgtgagggtgcagctcgttggttcctgcgatagattaatcaatttttttagaatattatatatcatatggattcgttaagtctttcatgtattgagtaagttcacggttaccgttatgtggtcgacggcgctgtcgaccgatgttggattttccgccaactcagttgatgcgcaactgctgcgtttttgggtgggacttcctaactcttcgtgcgcagcagcagcggcggcctgggggttctgttgctcttctcggatctcttgcctaatcttggccctcatcgactcgagcttttcgtcgaattcagatgtcagctcagctcttatcgacgcccggatcttggcttcaaggtgtgcatctttctccgccttgttggaagtctgcttcttgtactgccacgcgtagtctggaaatccatacttccagggaacagaagacccaacgccccgtgtccgtccacggtgttccttgttgcccaacgctttcatgaggaggtcgtcctcgcgtctttgagagcaggcctcttgcgaggtttgttgctcggcaaccaactccttctacattacaatttagtggggttaaataaacagcacgatgggaaacaatgcgaacatgtagtttgactagacacttactatagcttcgtatactcgttgatattctgcatttggcatgaagattgtgccatcatcattcttctggtacctggccctggcccagttcctagcccgagggtgtgggatatcaccaaagacgagcggtgtgcacgattcctccgcttcttcatcctcacgctgccattcctcttccttaccggcatatccgaaggtgccaagccggtgcggatgctggttcctggtctggagcaagcgatatgcctcgcttctagctctggactcggaggtcgacttcttcgcatggaattcctcccagacctgttccgtgatcgaaggaaatttctctcttggatctggattcgccgggttgtagacaaactcgccgactagcttagtcttgaagttcttccaagcattgcccataaccttgaaagcagcccgcctgagacggtcctcatgctccgcaggataatcaaagctctccttgaacgttagccaagcaatgtccttctctgcggccggcacgagcttgatgtcatcttgcagaatactgaatttctgcctccctatgaccccgcagatagacctaaatcggctcaatattttccttggagatgtcaacaaccctacggcatccaccgctgttatgcggaaccgttccttagggattttgttccctgtcctaggagtacgtgcccttgaggacccactagttgtcgttgacattggttcgccttgctgagacaccatctacttttttttctaaataacaaaaatgcacaattgaatgctacaatctattacaatgaatttaatgtcacttagaaaaataactgaaacatataaataaactgaattgcgcatctcacagtaataaaacgaaccacatttcatctatttactaaattcattaatgcaccatgtataaataaatgaaattgcacatctcacagtaataaaattaaccacatttcacaatagtttcattgatgcaccacatttcatctcaacataaataaaccacatttcatcccaacataaaaaaaccacatttcatcccaacataattcataaatgcaccacatttcatctatcactacaatcatctatcacaaaattcataaatgcaccacatttcatcccaacatcgacatgtctcactcatagttcaatcacatatcatccacatccacatttcaatgacatgtcattcacagttagcagagggcggcgcgatggaggactcacctgaggatggccggtggggctcggtggcggcggcggcgtcgggctgggtggagggtgtcgccggtcggtggaggcggcgttgggctcggtggaggcagcggtctcggtggcagcggcggctggctcggcaaaggaggagtttgcggcggcggcgccgggctcggtggagggcggcgccggtcggtggatatgccagtcgggtaggtcggcgccgggcgggcggcgtcgggctcggtgggggtcggcgacgtgcgtcggtgaggacgcgggcggcgacgacgagaaaggccgacaccggtccggtcggtgtagaggctcgagggaggacgacggcggtggcggcgggctcggtggcggcggcgccgggctcggtggagggcgtcgccggtcggtggaggcggcgggctcggtggcggcggcagcgggctcggtggcggcggtggaggtctcggtggcggtggcggcgaagtaggagttggcggcggcgctagggttctatggaggcgggaaactgtagtgggacttagaaaaattttcgatccgatctgagaaacccaagatatagtagagtgatgagtcatctcaatcgggct

SEQ ID NO: 93543 - DNA, 2858 bp, Oryza sativa
  unsure (1)..(2858): unsure at all n locations
agcccgattgagatagattaatctatatcgaccgtaaacgttggcccgtcaccgatgactcattttccatctttcatttgttgtgagtgcaaaatatatagctgctgtataataattcattttattagtcataatacattttcggatagtaaatgatttcaaatggaaatatggtcaacaacaaagttgtagagcctttcaagatctactggttttattttggtcatttttctatataatttttttcccaatagtttgaaattgattttgacaatatgataaatctaattaacagcatttgtaaatactaaatgatttcaaattgaaatatggtcaacaacagagttgatcctctcatcatgatctacaacttttattttggtcatttgcaataaaacaaaattaaccaaattaatgactacacatatcaagtctttgcaataaaacaaaatactttattcattacaatagataagtacaaatgcatcagtcacaaggttatgccttccgtatgatctgaacgagcatatgccacaggctcttggggatcatcgtcaaggtcaatgtgaggtcttacatgaagattatggttgtattcttcttcatcgacgatgttgtcaactcctacaattcggcgctttccatccctcacgatgtgcatcttcttgtttgaagggtcttttatgtagaatatctgctcgacctgtttcgcaagtacaaatggttcatcggcgtatcccaccttagatagatctactaaagtgaaaccttccttgtcggctttgacaccagtgcgtagattcacccaacggcagcgaaacaaaggaaccttgaacttgacgtagtttagctcccagatctcctcaatgcggccgtagtatgtgtttgacccaacttgatcctggaatgcatctatacggacgccgttgttttgcactgtgcttttgtcatcctgtttgacggtgtaaaatgtgtatccatttatatcgtatccatgccatgtgtctacgatccaagacggtcccatccccaacaactgtactatctcatttgggacatccgtggacattgtcacacgattcttgaaccattcgttgaaccgagaattatgttctctgttaatccatgcatcagatcgccccaaattctcatctcggattttcgctaagtactcctcaaagtatgggccaacttctgccatatgttggagcacagcgtaatgagcctgcgtgtacgacgcttgatcaggcctaattcttttccttccgattgtgccaacacctgacaaccttccctcgtgacgagatgtgggaacaccgataggattggcatcggacatgtaattgacacagaactcaatagcctcctcggtcgtgtaaccttcaatgatgctcccctcgggtttagctctgttacgaacgtacgacttcagaactcccatgtacctttcaaacggccacatttcccttagaaaagccgggccacatagttttgtttgcttcaccagatgaatagggagatgaaccattatatcaaagaaagacagtgggaaaaacatctccaggtgacagagggtattcacaatatcggtctgcagcccatctagatcttctggatctataaccttctgtccaattgcattgaagaaggcgcacagacgttggatcgtgtgacgcactttcggttatagaatgcctttgatagcaattggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatccttcgacagtgtgtggcaggctggagggaggtacactttacctgtctctgcatctcgtatggactgaagttcactatgaatattcatgtcctgtagatcaaggcgtgcgttcaacccgtcctttgtcttcccggaaatattcaacatcaggccaaccaaattctcacacacattcttttctacatgcatgagatcaatgcaataacggacatcaagatctttccagtaaggtagtcgccaaaatatggattttttcttccacatacccttctcctttgtcttgctacgttttcttttcttcccaaactcattgcttatgtccttgaccatattgtggacctcatctccggacaaatctttgggagcaggctgaagttctctcttaccgttaaaaattttcttctttcttctaaatgcgtgacgtagcgggagccacctccggtgacccatgtataccatctttcgtgattttttcagccaccggcttcgtgtatgttccttgcaatcggagcatgccttctttccttttatagtttgtctggaaagattaccgagtgcagtagtcattaatggtgcagaacaatagaactcttagcttgaagttctcctgaccatatgcatcctaagtttccacaccttctttccaaagaatctccagatcatcgataacaggctccaggaatacatcgatatcattgccgggttgccttggaccttggattaacaagcacaacataatatatttttgtttaaagcataaccatggtgggaggttatagttcgcaataagaactggccaagtgctgtgagtactactcatgtcaccgaaaggattcatgccatccgtgcatagacatatcctcatgtttcttaaggagtccgggcccnnnccaaagtctttggttttcgattgatattccttcattcaatcgaatccgctgggtgtctaagcataccgtctttccttctctcgcgggcgtgccaacgtactaacttc

SEQ ID NO: 93544 - DNA, 2191 bp, Oryza sativa
  unsure (1)..(2191): unsure at all n locations
gaaaggcatcccaataccctacaattatgatagaaatggtccaaatgaaaatcaatacctcgacatctcaaacttaaaagaaaaggcaaataaagtcatcaactttggtgaaacagcatttacttggcaccttaacaagattaccaatgcttgtcaggggtgtgagtggaatggtcatcactgcggatttagttcacaaaggggccaggcattctgccagcatcaaggtatccttcatctcatatttttttttcacaagggaattctacaagttatttcttctatttattgtattaataattatgttatggaattcataattatcaagctttttttaaacaattcctacaggatttttacctaaaggaagaccttgatgaaaactgtaatcgtcttggaaaagttctaataactagtacgaaaaaatgaaccaaaccagtggaaggacatgccaaattggaccttcctcaataaataaataaataaaccaaactttctctccatctccaggtttttagttatcttgacttgcgtattttagagcactggaattaatgcagatcactctaaccaaggtcatttcatgctaaatactatcatactaatttgggatgccactcttcttactcatcaaaattggacttaccgacttagacccttgggtgctaatacagtagtgctgactgacacaaaactgatctaaccattatgaattagaggttcctaacaaagttatagaaagttgttttcccttatctttgttattactaaactttgatgtaaactatttttttttcttccttccttcaggttcacaagtcatcctcattgcaggtaatgcagatattctgttcttcaaattctcgcctgtcagcaaccaagattttgtgtactcttgttccaataagagttgctttgttcctttttctttttgtttcaaaaagcagatattagctcacaccttgcttatcctaatggaacaaactaatttcatttaattttacacagctacatcctcagcagccacactagttgttcttttgctgatggtgggcacaacaatctatctttcactaaagacaagatataatgaagagatacatttgaaggtcgaaatgtttctcaagacatatggcacatcgaaacccacaaggtatagtttctctgaagttaagaagattacaagnnnnnnnnnnnnnnnnnnnnnnnnnnnngggtatggaaatgtatacaagggtgagctaccaaatggagtgcccgtggcagttaagatgctagaaaattccagaggcgacgggcaggaattcatcaatgaagttgcaaccattggaagaatccaccatgccaatgtgcttcgtcttttgggtttttgctcagaaggaacaagacgcactttaatttatgaattcatgccaaacgactcattggagaaatacatattctcacaaggtcctaacgtgtcacgggaattcctagtgcctgacaagatgctagatatctctttaggcattgcccgaggaatggagtacctacatcaagggtgcaatcaacgcattctacatttcgatatcaagcctcagaacattttgctagattacagcttcaatccaaagatttcagattttggacttgcgaaactgtgtgcaagggatcaaagcattgtcacactgactgcagcaagaggcacaatgggctacattgcaccagaactgtattctcggaactttggggtgatatcttacaagtcagatgtatacagtttcggtatgttggttttagaaatggtgagtggaagaaggaatctggacccaggtattgataaccaacatgaagtttattttctagaatggatttatgagaaagtattcactgggcagaacttattgattggtacggaaatgacacaggatgaaaaatacaaagtgaggaaactggcaattgtggcactatggtgcattcagtggaaccccaaaaacaggccatcaacgacccaggtggttaacatgctaacaggaaggttgcaggatctgcagatcccctcctttaaaccatttgttcccttccaaattcccctttgcaagcgaatctataccataaaaaaatgaagatatcaccacgggtggcacatgtttttttttttgggaatacgcgaggagcgcatttttgtattaagaggaataaaagttattta

SEQ ID NO: 93545 - DNA, 1800 bp, Oryza sativa
aagatcatttctccaccagtgaggggagtgatgcgacggtcgacggcgtggctctggaaaggctaggcgtccgaattcgcgcgcctaggcgtgctagatctgggagcggcaacgaccggggcgatggcttggcacgtcaacagtgacctccacaccaccggaggagaagatgtggcagggtttggcatctctttgctagatctggtcggctgacagtggcaacaagggcgacacacatggcggtcagaggcagccagctgcctcgccggtgcgcgcggtgggttggggcctacggtggcacccagcggcatcgacaagcggtgggttggttgacacagggcacccgtgcggcaaacagagctagtacgagacatgcattgttatgttggacagatcaactaaatcacagcacacacaggttacaaccttgcaatataatgaatatatatacacgcggcagtgaacttgcgattattaattcttaccagaaccggccagatagaaatatgtaagtaggtcttcatttaattattctttccacattctgatctccttctactgtgatgaagcaacgtatatagatcgatcgcgtggtaaggggaacacgcacttcatgagatcttgagctccctcggacttacttgaggaattcttgagctccctcttggacttgattgaattcgattgaaccccggatgatgtccggagtgatcttcctcgtgctgttgcagttccagtcaaccttctccttcgtaggagctgctgcatcggcggccttgaagcgaagtatggccgtgttattgatcccagcaatgtcgtcgggggagatcgtcaccaacgtcttcgtcttgttcaagttccacacaatcttctccagcttgggagctgcacgggctttgatcaacaaggccgtcttatcagagacatgatcaagcaggaggagcctcagctccccgaactccccctcctcgagggtgacctcgctttcgatgtatgatttgcgaagcagcctgaggcagcgcaagctcttcagcttgccgaggatccgcagaccgtcgtcgcgcagtagggtgtaacgtagagtgatcttggaaagcgcttggaacttttcgttgatccatgtagggagcttgtagcctctcttgtcgccgccatttcctcccttgaagaagcacttgaggttgaggtctaagctctcaagtttactgggagctaggatttcttcttgtgaatggtcaagagtcacgaacacgtcgtcgccggccatgtgctccgcagccggcggtggcggtggctccgtgatccagactgacagtgagcgcagggtatctctccgcttggagattgcttcaagcaaatgagtgatgttaccttggctgccgtcgaggacgactcccaacttcctcagctgctctagagacccaatccgtgcaaggtcggcttggccgtccttaatccggacatggcgcaatgtctccgtcttcttcccgatcctgtgaggtaccagcacggtggagcctgactcatttttcttgccttcgccaccgccgtcggtattgatgttgttgccggcaaggagatgcttcaggttgaggaggtagatgcgcctcatggcggtggccggcatctttttggtgtcccggatatcgagcgtctccagctgccacaagtcctccatcttcttgggcagactggaaacgtcggtgttccggaggctcagatacttgagggaggtcaccttgcagatactcttaggtggctcttctccaatctctggcagccccctagatctatcacgtt

SEQ ID NO: 93546 - DNA, 3423 bp, Oryza sativa
atatatatatatatatatatatatataaatataacccatgcatatatatgtttcaatacatatatatgcatacatatatatatgtatatatatatatattatattatattatatgtatatatggttcaggccatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagctaaggaccggtgaattgtgtttccgtcgtagtagaattcacccttgggatcaaggatttcttcgttgatgaatcccatgagttgttcttgaaccgctgcgataaattccttgtgtgtggtcaggttatccctcatgcgaataaactatatgaatgtatgaaattgattagtaattaaacaagaaatcgttacgtaataaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacctccgcctaagtctttctctccagttgccgcggaccaaatgacggaaccgaaaccaagccctacatgtagtttaaagatatgattcgtagtagaaataattaacataacaagaatttcttaattaacagagaaacttatgccagtacctgtctataagttcgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtacggcaacagtatgaacgtcttgtaatgctgcgccttcaggagatggacgagattgtcctctgtttcctgcggatattggtcgagcattgcaacgtttactctccgagggtcgatgaatccagtatcgaaaaccctccgccatcgggccctttgaatctccattctacaacgataaaagggagtattttattttatatagtctacttatatacaaggacctaattaattaaaggagacgtagtaattaagaattataattgaccgatatacttacaaagtccagcaactcataatagagacgtcgagggcgtccagctggtatacttcgtagattcccttgaaattgatccagagaatatcatctccttgcaagaagtccgggtccctgatcctcgctccgatcatctctctaccggtggcgctcatctccacgtacagctgatggaacttgtacatttgtgtgggtagggactgcaccagctcgggcttgacaagcggtttaccgagttcgtacatgtatttcaattccgccttttctattggttcaactcctagcaattgatccgtagttagaccggtgtcaataataaattcttctatcgtcatgtcttccccggtcaccaacggctcgatctcctggtttggttgctctccaagctgagggactggtttggactttccaaaagatgctttcttcagtgttcgctcatagtccgatagcttgatggcctccttgacaggtgcagacatacccctgaagaagttcctgacactggggtctataggaatcttcttttctggccttcgaggcttgaattgtctcttgacttctgatgcaacgtaagcgtcaagctcctcttgcgtgcaatcggaccccgggtccttgttcttagcggtgtcaactttcgccttcttcgttgcccttgtgtgggcaggcggtggagctggggggcccttgactttgaaggtgccggaagaggagcttgcggaggagtaggtgtaggagcacgaggaggagtcggtgcaggatcctgaggaggagtcgatgctggagcctgaggtggagacggtgctggcggagcatgaggaggagacggtataggatcctgaggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtaggctccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgttcatgctctgtgatcctacctgccccgttgaggcgcagctgctacggtttcctgacgggctcatcattgcaggaggaatggtcggctggggatcatgggaccgatgtgcggccatgcgttcatcaaccttccttgctacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctgaagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattgactgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagg

SEQ ID NO: 93547 - DNA, 623 bp, Oryza sativa
gcagcaatggcgaggagggcgccatggctcgccgggattggggccgtgccgttcttgatcgtcgtcgtggtggcggtggtgggcgccgccgtgccggcgatggggaggttcgtggtggagaagagcagcgtgagggtgctctcgccggagcacatccgggggcaccacgacgccgccatcggcaacttcggcgtgccggactacggcggcacgctcaccggcgtcgtcgtctaccccgacaagaaggccaccggctgcgccgagttcgacgccaagttcaagtccaagtctcgccgcccggtcatcctcctgctcgaccgtggaggtaggagattgatttcaaacttccaatgattgattcaattagtttgtgcttgttttgatttgcataagtatttttcaagaaatttgtgttccaaagtctgcaagtctgaactgaacaaacttgagaagtagtattagtttttgatgattatttggattttgagagtttggtttggtgatgatttgattccaatgttctaagtcatgccaatttttgttctgttaatgggttgtgtcaatccaatggttagctagtccactgattaaaaaaacaacaaaagaaatggttagcaagagag

SEQ ID NO: 93548 - DNA, 6613 bp, Oryza sativa
caagtccccctactctgctgaattaccagtgagaacatgagaacaggggagaggggaggcgaaagaaaagggagagaaggaagcgtaatagggcctaattctggatccgtcctaaatatatgattatataaacatgtttctttacttaaagaaaatgttttaccagtgttaaatatataggtcacatttgggtccttgaacgagtcaactttggaataaaggatcaagattttgatgttggtaatgttattcaatgctaaatgcttacagcaacaattaaagacactagcagaatattgccacgtgatcgggaacctttgcaaaagaaaagaaaaattaaaccccccctctgttatgtaagcatctcgtgtggatgctcaaatggttacttgatcaattgattgatgacgtttagagcaagtttaatagtatagccaattattagctctaatccatctataggcaatctaatagctcatttatataatagttatatactacactattaatatctggtcccatctatcatatacacactacgtcttagagtccgtgctacagctggctacaaacctgtagtccgctgctcttctttctccttatttatcttcttaaaatatatttgtagctgacttatagcctgctattgtacctgctcttgtaataacaaagcatcgagtgcctccataaccaatgatgacgtaagattagcagtcacgttcacataagcagagaatcagagatgacaagcagtaaaagggaaaattaaagcacgagttcaagtccctagcttatctgtttctcgtttgctgtcatcaaaaccaactctttcttctgcttctcagttaatctagtactaactacttttcttacaaaatcgaagtggtcataaagtgtagaacaacacataagcaaccaccgaaatggataaatcaaagatgacgtcatggcttacccgtcatcacagcggctttgtgtatcacgattcacgggcaacctttttctcctgcagtgtacagaggtcaaaatcgccgtcaggaacaaagcaaaacgtcactttgttcctcaaaatggttttgtgctgaaattaacagtggcatgcttcatccaacgtagtatttatttgtggagtgaatgctgattcgtcttgaattctgaagggtattaattcagatattcaactcagaaattattaacttgacgttttctatttcatcctactagtttacaactcggaaattatccaaagcaaccaacaactaaaaacggctagatgcattcacataactttgcaagaccgtctttaggggtcacttatgagaagaaataatccaaaggtgtctacatgatcaagatatcgctgacaagttgatcgatatctcgtggtaaggttaagaatatatagtgcgctccaaataggctattaatcaatctatcatgcttcaaaagaaactttacattcagtttaaaaagaacaaaaaaaaagaaactttgcgttgaagcccttgaaaaggtaatcaaccaaaaaaggtatgtatatttcccatcaaactataaaatcgtcgacaaaattgtatctttcatttgtaaagctcatggctggacatctagacttctctatcatttgtaccacctgtagtattatgtggcgctcgaatattctccacttctatttatttaattatttatttatatctcttccatttcttgtgtgctaagttgggttttagtcaactcaactactatttccttgactgttccatgaaaaatacaagagcttaaaactgtatagtacacttcttttttcacgagagcatgcttcctcgctttttcatcaacgttatactcactagtcaactactgcaccaactccgttgcatcacattccatgaagaccacaaaagcttatgtaagcatcccttcaatgttttccaatgttttgcggcacaaattcttcccaacaataatcacccaaaaaagaataaaattgtactataagtactcactttcctggcaaaacaatcatccaccaaaaagtaaaaaaaaaaggaagaagattgtgttgtcaacttcacagatagccaaacaaaggttgtacatgagattagctctcagccagatatttgcatagaagcagctagtgtcccagaggataaggggataggtaaacatccacattagagtgaagcttaaccataaactaaacaaaggctaaacaacaagctccatcaggaccaccaggcccactagaactctcaactctcaggtgtaaaatatgcgagaaaaaaagctgaaaagttgttctggtggtggtacggccttttgagagggaaaatccactgcaatccaaggctcacccagctgtcgaccagctgctcatgcatagatatgtgttgtgcactaatgatttgtgtaggatgggtttcaactttgtaaattctgtgatgattggttagggagaaagaaggttatgagatgaaggccaataatgggggcaccgtaccaaacgcagtagggcagcacagacaaagtactccaaactggacctggagctagcacacaattgacaattgcatgcgcatcatgaacagctgaacaattgccccccttggcgcacaagaatcttcggctagggagccaggcatgaatcatgattgctgcaatgaattaaaaatatggtagtagtaaaagagacagatgtcacatctaattttagctacttcctccgtttcattttagcatttatattgatgctaatgaatgtagatagatatatgtctagattcattaatattaatatgaatgtgataaatgctagaatgacttacattgtaaaacggagggagtatttattaatgaagaggtaacatgtataataaattacatctatgctaattctagtgcactaatcccaatagctttattttatttagttgtcaaacatgtctccccctttctctatttttaagtttgtgtgaaaaatgtctaactactctctctctctatctatactattctattcacctcatcaatgtgctattttaagccaagtgtttaggtgtgcatagtccttgctctgagacgccagcttctcttctcccttacacgaggctattaaccgagcgctgcagtgatttctaacagagtggcaggcacagaaaaagaattgcagaacagcagaaagcagtcacacttcagacttgtatcgaacaacattcttgtttctaacttccaatcgagggcctcgaggcatcggcacaggcataatcaggccagtcgattctgtactatcagttccaacccaatccacataaaggtcaatgcttagcaaaagaagtcagaacccacattcagaagtcagaacccacattcagacgtggtagatcgccagatagatagtggtgagtaagaaaaaacaacagtgcagacaaaattgtgttccagcgacgggactcgtaagaattccaaaacccactgggttctcatgattaacaacaatgtaaactatggctttacagcttccaagtatttttgtcttttcccttttttttttacctccacagacataccagcttacgctactgaaaggaaggtaaaagtaatagctaacccgacaacacaagcaagagtatgcccttccccgaccgaccaatttccagtacccacccccttgtgtggagaaccataatccatatgaaccaaccgctatacacaagacacccgaaccacacaaaagcaatgtacctaattgccataccctgaccttgctcttatcggacgaaccctgactgctgcctcataacaagttagcaggaccaaaccatgactcggataacttgactctccgattctggaaagccccctgaacagacagctacggtgcatttccatccaaatcgggcactgttcaaaaagaaaaaaataaagtcataagaactccaatgagtcaatgactgaccagttccgaccattagtaaatagaaagaaatttaccttcaccgaaaccgccaaactgaaacatttcattgtcagattcagattcacagttccaaccattagtgaatagaaatttacctttaccgaaactgccaaactgaaacatttcattgtcagattcagattcagatacagatggaataagaaagggctgttggtcatcctcctgcacccagtatgactcaagcacataaactgccttattatatatctcaacattgtcatggttctggagatcctcaattttgtccaagccatcagcttcatcaaccatcggcacaaatatgttcatattacaagcccccaagttcttcttagcctccccaaccctcaagatattatcaagggcctccaaacaagttaacactgttttggaatcttggtgaacaagtaaatcacaaagcggcttgatgcaaccctgactaacaagatacctggtaaacaaatgatgtgtcgttaagaagttgctaatttagttgcacagaaatgagcaaaagcacatataaataattgtcatcaagcttttcatactctatctgattgaatgtcccaccagatgtggcattagaaattgcccaaacagcctcctttttgacatcaaactcagcatgttgcaacagatgcaatagaggagcaattatgtttgaatcgatcacagcctacaagcaaatttctgaatgttactaatggataggtatacctttcaagatactacttagtgcttttcaaaaaatgaaggcttcccaacaaggggatatattctagagctgcaaatgacacgattactataagcatatttctcatgtttttttcattggtgaagctacaaacctgaatctgctctttagttccagctgtgatgttggagattgtccagcaagcttctctcttgacgcttttcttttgagttgttgtcaaaagattgaaaagacagggaagtgcttggggatgaccaacaatacactgtggtagggagaagaaacattaaggaaggataaaacaaaaactaattaatcagtagtagatgtgcataacatgacacaatatacaggcaaggctgctgcagtagtattaacattaatattgtaaactgagcactgcaaatataaacagaaaaatgtggacattatttcctagtaacagacaccgctactatgtgcaagcatatggatggcagggatgcatgtgttgggcaaactaacattaacctctcagtgtactgtacagatttctctactcaaaggactactactttgatcaaacatcagtagtaatggagtaacctagtgagaaggacttaaaagcagatttttcacagcagaattcaaccaaacaccaatgacatcattaccattaataaatgttcttgtatgcacaattgcactaaaatgttcttgtatgaacaaagagaattatgacatttaaaaaagaataaattccccatttaccattgcaatttaagcactcaggtttgcgagtatttatgataggtttgacaaggcaagcagtttgcaagggaaatatgattttctcaaatttcagggatgcacatcagcaatattaaagtctggaattaccagatgaaacattggatcatagtgaaaatgaacatgttacgaatttaaaaaatgaggatacaaccaaatgaaaaataaatgctcctctgtgctcagatagttaacaccaatttgagcatcagttttctcataaagaattttttaactatgtatctattggtataaattttatacaaaatcaaaatatgccttaaagcagtgcatggaggggctaataaccagaaggactagttcttacagcataacaaaaagagtagatgtagaaaacttacagatattttggcaaaattttcgcaaaaccacatatgtaaggcacaatattgcaacactagcaatttagaatgagagctataaaaacagaattttaagcatggtataccaaaactacagatttcatttcaaagtcccattaggacaacatcataagatctaactccttaattcagcaatttgaagtaaattgaatgctaaatctataatttcatgataccatgcttaaagtcagcactaaatctgtggttccatagtattgtggattaaatccgtagttttgcaaataattttgtccagtatctgcagttttggttaatttactctgacaggagaagtgacacagtagatagacaacaaatgtatcaggagatatggttaatacaattctaaggtaaaatgctatttaatcatgcaacacagagtatgatgtttttcataaaagttaacaagttaactgaaaatcagccaaaggttcaaatataaacacatctgaccatatatttcgtatgcagtttttgagaacttaagaatgaagtagttagcagctcaacaaagattcacaaaagataaaacccaagttagaaaagagaaaaaagaacctgggtctgcgcatcatccccagttacaatgttgccaaccgtgcggagagcaggaatgagcaccacaggtgaaggatggctgaatcaatatgtagttgttcatgtatcagtcctcgaatttagatctatgaaatgaaaaaaccgaacaaaaaagaaaacaaacttacc

SEQ ID NO: 93549 - DNA, 1795 bp, Oryza sativa
tgttaaacttccctatatgatcccacccatatgataggtataagaattcagatgttcaaacttagattatcaattgcttccatgcctgttcacggacatcctctcttggtgagctgaggagcttcacaaagatgggcacagcaccatgttcaataactgccattgtgttggctgctgttcctgaagcaatattggtgagagcccatgctgcctcaaactgaagccacagaaaaaagataagactcagagaccagctagtgattaacatagtaagtaataataatataaagtggcatgcctgcattgttaggtttgaggagcaacggtaatgtagttttcagttttccaacaagcaatcaatttgctttgctcactcgtggcttatactatgttcttagctgtaatggaactgttgatatgctgtaatagatacaaacctggagctgggggtactcctccctggtgaggaattccacaaagcgagggagcactccagatctaatcacctcatcaattggaggacaatggtctgaaacatttatttactcataaactatagcagctcacgggaatagttaacataaatttcaagtgcagcttcagcattgaaatcaaatagcatataaaattaaacaaagattcctgagccacaatgattaattgcagtaggagtttacaaaaccaagggagttttgctataattttgtttacgaaaatgctatacacacgacagatttgtaggactatcgtacaactagtcaacgccgtcatctgtgagcgtgagctgtttaacttagtgggctgtgattgttgggccttttaaaagcccaactccagccgaagctccatattccagcgtcgattcctcttctcgatattactctatacacagccgtgacttttcatcttctacatttgctttctcaccctaaaccctcattctaatcccctttgtctcctatccataccaatcagttaagattaatcagaaaaatttttttgcggcaaccacaacagagtattcaggttgaagctaacagaaggtattttaggctctgattttctaggccccatgaacaattctattaatcttttatctcaattcgtttttcaacatctcttgttttttcatgcttgcaaacatatacatggccatatttgatttttcaactgattttggccatgaatatggaaattgaagccgtggtgccttgcttttctatcaagtctggtcaatcattttttgcttgcatgttatggctttttttagaggacttgcatgttatggctgtgaaaatatattggtttcacatcctgaaggcctaaactaatctaacatctggagtgaatcattttaatagcaacctaagctatatcgatacatgtctcagccggactagcctctggcctcagtgtacagaaagcgcagtacgcaagcaaacaacaacgaggcccagtgacgcgtagtcatatctgacaccgtcattgctcgttttttccgccgtttcagtcgtacatgcgtcggacacatgcgtcgggcgtatagcaaagttgttttgtttaagcacagcttcagcaatgaaactaatcagcatgaacattggacaaaaattccatgagccacgatgattaattgcacaataataagtttacaaaaccagatagtttcgctacaattttgttttaagcgcaacctcagcaatgaagtcaatcagcatgaacattgaacaaaaattccatgagccacgatgatcgattgcagtacgattttacaaaagcatgatagtttcgctac

SEQ ID NO: 93550 - DNA, 2412 bp, Oryza sativa
ttttttccatcctctctttctcaggggtttttatctttggttaaaatcctattttgcatcatcaagcccaacccaatttaaaaagaaaattcccttgtaatttcctttttaaaaaaaggaattttgattttccagatttttttgtgtatccctattggcctggggattgtgtcatgtgttttcagagctttataaaaagatttaacactaaactctccatttttttgtcaaaatccattttaaggtgtctctccctcctggtaatattaccgtctcacataagttttttatattgatccagtctgcaagtctatctcctgtcaaatttcttctgaaagtaatagactcccaccctttgtttttaacagaagttaaggtcactccatttgcattggtaattctgtatagattaggatatctttcagccagagattgcttccctgtccatttatcctcccaaaccaaagtattacagccattccctaaggatatttcacagaaatgaagttttcttttatctccatcaatccatgccaaaaatgggaatctccctgcttgattttttgtgctgtaagtggtttcttttttagatatttttctcttaacaatttttgccataaagcatcagtattctccaacctccacagccatttccccagaagtgtcttgttcatagtttccaaatccgaaatacccaagccccccatgtctctaggtgaacacactattggccattgcaccaggtgatattttctaatcccctgatcttcctgccaaaggtatcttcttctaaagtaatcaatcttttctagcgccccttttggaattctatagaaagaaaacatatacagaggggtactgctcaagctagagttaattagagtaactcttccaccaatagactgaagtttcccttgccaacacccaactctcttttctattttagcttcagcttgtttccagtccttatttaagattcttttttgatcaatttgcagtaaaaaaatgcgaagagaaggattgcgaagcgctaatcggtgctaatctggcgctaattgcagtgttaatccgacttgtaatttacattgttagattagaggatccaacggttagaaacttctgggtacacttttctgggtggatgtaggaaagaaacaactggtactttttatattagtatagatgactttagccattggttgctggagcggacacaaaacgtagaacgggatttgagattagcattcacatcaatgaaagggcaccatcatggaaacctgaaaacaaactgaaacctctcatgcttactcggaaatctaaattgatcaaactcaaaatcaaagtaaattcaggaagacacaatgctgtcacaattcatcaaagatgtgtttcagcaaaaagaaccaagcgaaaagagaggagttgcatagaatgctatttaacagatcacacaatttaaccaaaaaggctctccagtggagatctgtgtagattgaatgaacaaaaaaatctgcatttatttaattgtcaaatacagcagcatttcttgagatgaagttattgcctctgctctgcctagtatgagctggttacaacttacaaggaacttgttacattttctatgtaccgaatgaaaataaactctatatatgagactacaccatcttctacgactacatctaagaatggcatcttcttcatctcctctggaagttgaacttcatgattgcaaaactgaacaggaaagcgaacatcacagtgaaaacaacatgcacaacggcaacaagccatagtaagtcatgatggaaaccatagtattccgtaatgaactgagccacggtttggtctttgccatcaagtttagtttggatatttccaaactgggaggcaaccaatccatacaatgtccatgcaacagggcaaatccaacagtaccacctccaccagacaggaattttctgaatttgcgagagttaaatgcatgagtcacattagaacaatatggtaatgaaatctaaatgaaaacaaaaccatacgcggcaggaaagtaacctacaggtcgaggtataagatatcctgaaaagaggttccatgcattgtagattgctggtgaaatgatagctgcaatgctctcgtttggtgtcaatcctactgccatcattccgaagaacgtgaaatacagcaatgtgaagtacatgaagaacaggtaccaaatgaacttagcaacagtccattcaaacccaatcattgagtagactagtacaccatataccagtgtctgaactaggatgtatggcaattcgatcgcaacctacaaaagagacaaggaagtgaagttagggttggagcccaaaagaacttatgacttttaagttttatgaacagtagtgaatagttcttttcattgaacta

SEQ ID NO: 93551 - DNA, 652 bp, Oryza sativa
cgtcgccgggtccttcacgtccgccgcctccagcccgacgtggtggagcccctgccgcgacttgatccgggcgcgctcctccgccgtcagcgcgtcccactccggcttccacgtgcacaccgtcgccggcccgtacgtctccgtcagcccgtacgagtggatcaccaggaacccctgctcctccatccggaacagcacctgcggcgacggcggcgcgccgccggtcatcaccgtcaccctcctcctcctcccgcccggctgccgccgccgctcgtccgccgtcgcgttcacgatcatgctcagcaccgtcggcgcgccgcccatgtgcgtcacgccgtgccgcgccacgctgtcgaagatggccgccgcggtcaccctgcggacgcacacgttcgtgccgccctgcgccgccacgccccacacctggcaccacccgttgcagtggaacatcggcacggtccacaggtacaccggcgtctccgccatggcgttcacgatcacggcggcgaggctgctcaggtacgcgccgcggtggctgtagatcacgcccttgggcctcgacgtcgtcccggaggtgtagttcagggcgatcggctcgttctcgtcggccggccaccggatcgcgaagtccggcgacgatccggcggcggcg

SEQ ID NO: 93552 - DNA, 1685 bp, Oryza sativa
cattcgttgaagcgagcaccatgttctctgttgatccaaatatctgatcgaccaatattgtcctgtcggaccttcgctaaatgctcctcaaagtatggggttacttcagccatatgttgcagcactgcgaaatgagcctgcgcgtaggaaacttgattgggaacaattctttttctgtcagttgtgctgacacctgccaaccttccttcgtggtgagacgtaggaaactttgataggatcagtctcggccatgtaatcgatataaaactcaatggcttcctcggtcgtgttaccttcaatgatgcttccccctggttttgctctgttctgaacgtacgacttcagaattcccatgtacctctcgaatggccacatttctctcataaaagctggcccacatatttttgtttgcttcactaggtgaacagtgagatcaccaatgatatcgaagaaagccagtggaaaataaatctccaagtgacatagggtactgccaatatcggcctgcaacccatctaggtcttctggatctataatcttctgaccgattgcattgaagaaggcacaaagccgttggatcgtgtgacggacttgtggtggtagaatgcctcttatagcaactggcaagatctgtgtgattagcacgtggcaatcgtgagacttcattccaaccagcttaagatcctccaatttaacgtacttacttattgtcgtgcaatagcccgaaggaactttaatatttgccagacatgatagcattgcaatcttctcatccttcgacaatgtgtggcaagctggtgggaggtacactcttcctgtcttctcatctgtaacagggtgaagttcactgcgaatgttcatctcctgtagatcgagacgcgcattcaacccgtcctttgtcttgccaggcatattcaataatagccccagcaagttatcgcacacattcttctccacgtgcatcagatcaatgcaatgacggacctcaagatcttcccaataaggtagctgccaaaatatggattttttcttccacatcctcttcttgtcctccttgctacgttttcttttcttctaaactcattagtaatgtccttcaccatgttttgtacctgatctccggacaaatccgcaggggcagacccaagttctttcttaccattgaaaattttcttctttcttctaaaggcgtgccttagggggagccatctcctatgacccatgtaaacgatctttcttgatttcttcagccatctactgcgtgtatgttccatacaatcagagcatgccttctttcctttcacggtttgtccagaaagattacccaacgcgggataatcattaatggtgcagaacaatagaactcgtagtgtgaagttctcctgaccagatgcatcccaagtttccacaccctctttccacagaatctcaaggtcatcgataacaggctccaagaacacatcgatgtcattgcctggttgtctcggaccttggattaacaagcacaacataatatatttccttttgaagcacaaccatggcgggaggttaaagttcgcaatgagaactggccaagtgctgtgagaactgctcatgtctccaaaaggattcatgccatccgtacacaaacatatcctcatgtttctagggtcggcagcaaagtctttgtgctttcgatcgatatt

SEQ ID NO: 93553 - DNA, 1670 bp, Oryza sativa
ttccgtaaagcccatttcactgttctgcaacactcttcattggtagctccttacatcgaggagcacttggctcaatgggtacacattctacacgagagcccaagacatgaagagcacgaaccaaaacagcgttgttcgtgtcgatgccatgggacacgatggaacaactggcacgtattacgatgccatcgaggatatatgggaacttgactatggtcctctcaaggttcctctgttctagtgccaatgggttaggttgactggtggaggcgtaatgattgatgacagtggtatgacaactgttgactttaacaaggttggatactcggacgaaccttttgtccttgccaatgatgtaacgcaagtcttttacatgaaggacatgtctagcaaagaaaagaagggcaaagggcttgacgagccgaagcgccacgtggttctgctaggcaaaagaaaaatcgtcggatttgaggacaagactgacgaggattacgatcagttggatgggaaaccccctttcatggtgacgattgaccctagcatcctcctatcaaatgaagacaccccttactcacgtagcgatcacaaggagggaacagtagtgaggagaaagtacgtgcggtcaaccgtcacctccaatgtattgccgtaattattatgtacacgatgtaaactattttggatgtactgattatccatataaatcaattgttgtatggcatatgttaattatgtatgattattagaatttttaacaattttaaatcatgcatatgctagttatatgcgataattagaatttttaaaagttttaaatcatgcatgtggcatttacatgtgttaattagagtttttaacaattttaaatcatgcatatgctaattatatatgattattagattttttattaagtttaaatcatggatgtggtatttacatatgttaattagaatttttaacaattttaaatatgcatatgctaattatatatgattattagaatttttaacaagtttaaatcatatatttgcttattacgtattatctacttaatttactacagacaacaataatttttcgaagtaattgtcattaatttttcgactttaaataattttaatgcattatttactattttagaaacacgtatttaatgaaattcaatattcagtgctattgtctatagtcccggttgtcaaccctaaccgggtttaaaaagaatttggaaatagcgggaaaatatctttagtccctggtggtctcaccaactaggactaaagatctacgggtatatatattcccgatgcgcgcccccgtcttcttcatcaacacttagaaggtttttccctgatctcggcttctccttcgccgccactgcctaaggcatccccgcgccgacgccgccgtcgtatctcgccgtcgtctcgcgggcgtcgtcgtcgcttcttctgtcgcgtatgccaccgctgcatatgtagggtgagagccgccaccgcctacctctctctctcgacctcgatctctctctctctccaaactaccgccgcctcgtttctgacgcagccgcagacgttgacgcggccgaccccgactacgcctcccgctgatgccgtccccgacctcgatgcggccgccacagctgaggacgtcgcgccggcactgtcgacgat

SEQ ID NO: 93554 - DNA, 7832 bp, Oryza sativa
ttatagttggttgttgaaaggatttaaaatagaccaagaagtctacccaatgtcagtgtcagttgtagtgagtcgtgcaacagaaggttatttttggaaagtaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcagtgaagcattgggtagtttccttgcagagagagtttagggtggtcaagtcaacaaattatgtgtatgaagtgaggtgcatgaagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtatgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcttgatgttcggagtcggtggtgcatgcgtcacatgggtgcaaatttctacaagcaattcaagaacaagcatcttatagagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttaatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgtcgtagttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctctgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgaccggatgagtgttttgtactaaaatttcattcttaattgtaggcggaccttctgcaccctgacgctgatgattactcggtccgacgctcccttgaggcgtacctaatgtggttgttcgggtgggtgatgttcactagcacccacgggcacgctgtggacttccggctggtccactacgcacggtccattgcggatgcttagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctgcgagagcaccgctaggactttcgtcgttgtgcacacgcgaccgggcttattggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtgacggacgcgtatcccacgcaccgtgaccgagactacttcgtgggggtacatcgaatttgtattagttcttacaattatttcatttatcttgcataatataggacaactactgaattttttatttccatcttgcataggctgatgccgcacaggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggtacctgtttcgcacggtactgctcagcccagaggtttcttaagttttgtttctgtttttgtacgaaaacatcaccccgtcgtaacttgatgttccatcctcgcaggacctcgtttgccttcgagcgcccctagctttggagcagtgcgacctacagcaccggtttcgcacggtacagttcagcccagagattagttcatttttgtttcagcttttgcacgaatatgtcaccatgttttaacggcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccggggtcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggactgactcacatactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctagatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaatcacgcccagagggcggtaggcgactacttccgtcaattttcaaaatggaaaattatttttgtaaaacttttaataaaaaaattataaataaaaaaaattcgcctattgcatcgggtctcatttttgtggactaggctgatgggcctattctcccaacggaaaataggaaataagttcatttcacgtactgtatttgaaccgtaatatcgaatataacctatctctcaacttgtaataccaaggtaaatattagtgtattacatctattttcaactgacatggcgtgagtcagcgtgtgacctacataggtccacacgtcagggacgcctctctctttcctctcttccttatctctctctcttccccctcaacacaattgcggtcacgatagagacgactgatggtgtcacccagcagcgcaagcggtggcgcctcattaagagaggtggaggttgagcacggctaggcatcaaattaatacaatacctaagtacctaacagagacaataaataaataattaattaccagtgtgtttcctgatcggaacaacataggaatgatacacaaattagcaagatgtagcatggacgggtaaagccctatgcaactatggtaggcgtgattcccatcgtcaaggtgagaggtggagacgaagctagcgagtaagccactcatgtcgacgattgagcccctgatgagacgattagctggatcttgaaggaacaatcatagatgcttgacgacaatgtgtccatggcaagggaaggcacttgcccactcaggcttggatataaaccgcgacgagcaaagcaaatcatccggatttacctgcgctgctcgcgctgctcatgtggcaggcaattaggcctgattcgacagagctgcccactcatttgccaccacagcctcctcatctgcctcaccgtccttgagttgctgttggagtgacaggccatcacggctagagtagaaggatgttgctcctcccttttgcagctaccgtggggtcagggattggggagctttcacaggaaacggggggcacctcgggctaaccatcgccgaataggagtcgtagaagctctgacaggagctctaggtgctgatggcgctccaacacctcatgtgcttagtcgtgtcttggatatttgttgagagaaaaatgattgagagagatggggagagaggaggggaggaaaatagaccactcgagttaaatttgacgagggattagatttacactcgatttaagttgtgagacgtcgtaaatgtgatactcaaactcgattcatcgaacttttttttccagaaaaatatacctacacacaaaaaattcgctcattttatcggaagaagaaaagagagagagagagagaaacagcgcgagacgcggatggaatggcaagggaggaaactggtggggtgggagtcgccacgacacgcggcgacgcacggctgtggtggccggtgacggtgagctgatcgactgcccctcccttccccttccccctccccctccgtcgcatcgcagctgcagctagctacacgaggagacctgctgctctgctcaatttcaacttgaattctgcttccgacgacgagacgagacgcaatcctcgctgcctccgccggatgtcggtggaccccgatgcttcccccctccgccggcactccgctgccgccgccctccctcgccgccgctagcacctcttcctgcttcctcccctccctcctccctat

SEQ ID NO: 93555 - DNA, 5418 bp, Oryza sativa
aataagcaggtaacctgttgatgacgcctaaacagttggtgcttggtgcctggtaaagaggaggaagaagaagaagaaagaagaggaaggggacaccacaccacaggtagcactcaaggagaggagaggagaggcgaggcataaggaggcagaaggaggaagaggcggcagcagcatcggcgggaggctggctccggcgcgagcacaagctggctaccccacgcttcttccaccacctcagcacctccgcggggcttgcagccgcgggggtctccgtctcctacccaccgcccctgccccccactccgcccagtgcggcgcccacggcgcccgacatgggcgccggcggcgccgccaagcagatcgtcgactcgctcctcgcccgcttcctcccgctcgcccgccgccgcatcgagaccgcgcaggcacaggtaactcctctcctctctcctctcgcctcgcctcgcccggaattccatcaccagattggggcctgcctcttccctccctcacggataaacaacgggatcgggacggactcacctccttccttcctagggttcaccccccttccagatcgcccttccggttccggctccacactctgatttgttttatttctttccttcaccctcttcatctcactggagccccaattcactcctcgaattggatcgattgcaggtgcaccacctcttccaaccgcttaggcctagggatttcccccataccctatgttcaaagtacaattgctctatgctgccgcttctatcagtgctccaaatcattgccatcccaccattgttattactgctacttccttctctatgaaactgcctcctcatgcgtgtccatttgaatttgatttgcttgtgctgcgacatgcccacattgttgaaaaatgctcaaaatcgtactccacctttgatggtctcgttactttcacatgtgtgctccacctataatactgggtcatgtttccaagagcacgatgatgtttctctcaatactacttagctcaactgcatggaggaacctttctacctagacattctcttgttttcttgaggcattattattttacctgccagatgaacaacttcaaaattgattactagcttatatcatcagggcaaatgttattactattacagaaaatacatctgacactaaatttctttatttttgaaaatgcataggatgggcaatacctccgtccatctgatccaagctatgagcaagtattggattcacttgccatggttgctaggcacacacctttgcctcttttggaagctcttcttcggtggagggaaaggtatgcttattcaccttgactttgaaagctctagccctatcccttaatgcttccccgaaatcattattgaacaatgcaaatatgcaatgagttctctgcactcccttatttattactgaactactgttcttcactgtcgcacagtgaatcaccaaaaggcgcacatgacgcatcaacgttccaaaagaaggtttgtcgttgattgcccttgccctctccttttcaagaaccacttcattttcgattgtaactaactattaagcagcatcagacaggcattcttgcacatataatttctctattatttcatagttgcaaatagttgccagcagggtatttgatccctgatctctcaaaacttttactcccatagtattttcatttgcgtactctcgtctaaaaatcctcatgtctgttttctgaccccttatccagcttgctgtcgagtgcatattctgttcagcctgcattcgttttgctgagtattgcccacaagagggaataacaggttgttataatattatattttgacttatttgcacggctactttctgatgggttggctaactagctgttttattttatctagagaaactttggattggcctggaaaattttgtatttgattggctaattaatgcagacaggtgaggcattactgccttttttttacttaggttttctcacatgataaataaaacacatccacgcctgtggtgcatcttaaatttgtttatctttggctttgcatatcatcaaaacagcacatcatgtgcaataaatatttgctttcttgtttctttcagcttgtgccaaattttgcgaaccttgtcattatgttagattttgtttcttgattgccaggaaaaaaagactttatattctttagaagttgagtttcttaccaacttctttactttctgcagggttgttagccaagtagagtatccctcgttggttgatttgcgaggtctcctcttagatcttgttgcccaacttttgggagctttatctcgtatcaggtatgctctatatttacatggaacatggataaggggtgtgtgcgaaggagggaggccatgtaaaaactgtcgcaatattatgtggcctttttttttcttgacaaggaaactgcaggggaggcccctgcagtttaattatatataatatattgaaggaaaggtttaaataaaagacatatgtgacctctttgtccatgttacttcaaattagggagggaaggaggccatgtaaaagctgctgcactgttatatgacctctttgtctatgttacttaaaattctgatgattcatacaggtttagttctgtgacggaaaggtttttcatggagcttaatagtcggcgtaatgatgcgcctctttctagaagtgattcactcagcattattaatgggatgcgctaccttaaattgggggtacgatacaaagatcgctttattattttaattttctgtgccagttcatagtgagttgacaagtatttaaagtgcatggcaatgacaatctgatttatcttggcatgctgtcttacaaaattccaaatgttctatcaggtagtatggtaccactaccatgcttcagttacaagtccactttcactggccaaaacatgctctgatattagcactttgatgaatctgaatcatccaaagtttttacttgtgtaccactgtacatagaatcccaaaagtaccttttgatttgcagaattttaattttgttaagaaaaacatatctacatacacaagaagtaacttaactgatactctattcactccatcatctttgaaccaatgtacataacaatgccattcagtttgaattgtagttattacatacttaagaatttactttttcaggtgaagacagagggtggactgaatgcctcggtttctttcattgcaaaagcaaatcctctaaatcgtcctcccaacaaaagaaagagtgaactgcaacatgctttgtgcaacatgctctcaagtatactggccccgcttgctgagggaggcaaacatcattggcctcctctgggtgtagaacctgcattgtcactttggtatgatgctgttgctcgaataagaggcgcgctcatgtattggatggataagcagagcaaacatattgcagtaagtcgaggatttgaaatttaatgttatacattttttggcatttgtacaaaatattgtatgccttgattattttttttgttattgaataactagcacatactttatttacttctttatttgttagcgagcatgagatattaatgatgctggactgggaattcggaaattgatctgtcaaattgagattctaatggaattttctgattttatgctttgtagttgaataaggcaataaacttcactttctatcttatcatcttggtgactgtattatttccttttttagacatcattaattactgatgccttgtgcaattttaatatttagtgctgaatcttcatcacaggttggatttccacttgtaactcttctactttgccttggtgattcccatacgttcaacactcacttttctcaacatatggagatcttgtataagtatctcaaggtgattttttgtgcgcacatttgatcatatcaaaggcctatcatatttcaccacctaatattcttttaaatgctgtactcattgtactgattgtaaaccatgatcctgatttctgaaacttatattcttcctttgtgctgcatgaagcctaatgatgcttaattgcttattacgcaggacaagaatcaccgatcaatggcattagattgtcttcacaggctagtgaaattttacttaaatgtttatgcagattaccagcctagaaatcacgtgtgggactgtttagatagtgtgacctctcaattgctgaccgttttgaagaagggcttgctgacacaagatgtccagcatgataaacttgttgagttttgtgtgaccttagctgagagcaactgggattttgcaatgaatcatatgatcctcgagttgttaaaaccagatagtttaagtgaagcaaaggttgttggtcttagggctttgcttgagatagttgtgtctccatctaacaaacaaattggattggatgtcttccaaggtaacacggttttatgaactgttccattctgtttaatcttaaatattttctgaaaatattgtaatcagtatttttactctttaatttcagaatatggtattgggcattatattccaaaagtaaagtcggcgattgagtcgattttacgatcttgtaacaaggcatatagcttagcccttcttacatcatcgaaagctactataggtatgctgctacttctcattgtacaaggaaatattcaaattattttctattacttttgtcaatttattttcattcatctttggaaactatcgatacttaaaattgtgtcacgtgatgcaaatactcattcaactttctattttcccctttatttcattatttctaacattggtattttcagataatgtaacaaaggataaatctcagggatcactcttcagatctgtgctgaaatgtataccatacttaatagaagaggtgggacgtaatgataaaatgaccgagattatacctcagcatggtataagtattgaccctggtgttcgtgaagaagcagtgcaagtgttgaacaggattgtacgatgcttgccgaatcgtcgctttgctgtattgaaaggaatggccaactttatcctaaaacttcctgatgagttccctcttttgattcaaacatcactgggacgattagtagagctcatgcgcttgtggagagtatgcctatctgaggaacttttggcaaaagacatgcaaaatgttaagcgttctagtctaggaggcgatgcactacagaggtctccttttcatagatccagggatgtatctgaattccgtgcctcggaaatggatgcagttggtcttgtctttctcagctctgctgatgttcaaataaggcttactgctttggagttattgcgatgtgttcgagcgctaaaaaatgaactcagggattactcggcaaatgaatggggtgacagcaaactg

SEQ ID NO: 93556 - DNA, 736 bp, Oryza sativa
ggaatgaacaagttctagaggtgcaaaatccctcgcctcagatgccttgtgaggctcgcgaagttgtttcgattgaccttacattatggcacttagaacctttgactaaagtgaattttggaattaaactcatgttagccaagcgtgtcatacaaccgaaattcacatgacagagtcgcgaatgccacacattggactcatcattcttgctaatatggatcacaacattattattattacacacgtcatccaaagaaaagcggaacaagcctccgctgtcatagccttttccaataaaagtttcatatttagataccacacatttattggattcaaacacaagtctaaaaccttctctacacagtagagaaccgctaactagattcttctttattgaagagacatgttgcacgttctttagctgcacggtctttcccgaagtaaacttcagatcgaccgtaccaacaccgtgaacaggcacaagtgacccatttcccattaacaaggagaaacctttccctacctcataagaagaaaacagggaaatatcagcacatacatgaatattagcaccagattcaacccaccaatcaggtgaatgaaaaacagagagaactgtaggtaataatttaccgtaccccgatgtttctctgccctcactaatgaccatggtggcagactttctgttttgggctcaagacagtccttggccaatgcccagacttgccacacacaa

SEQ ID NO: 93557 - DNA, 1232 bp, Oryza sativa
catttctggaaagcatgccgtcattaattgcagcatttgtcagaccccaccgagatagtgatgacttgtgtagtaatacttactctggtaactgtgaagatgaatactgtcatggttgttatggtatggtagataatgctggcaatgacagtgccaaatgcgtgctccttggaggtttatcagaagctaagaagttggaattgatagctggacctgaaatggtacacttacactaagatcttatcccctttgtgttatttgctgtccattatttctgtttccttccctatattcgtcatctggcattttaacattcttttgcatgattgctactgtcttggttcttaaatcatacattcactataaagattgaatgatcttctcgcctgtactttgtgcagcgtattttcagaagtgatttaagatggtgccctttgtttagcaagttgaagtctttgttactcaatgagtggtgtgttgctaataatttctgggcactagcttgtattctcgaacactcaccggttctactgaaactcactcttcaaatttccaaggtagaagtttttacagccacttcactattaatgttattgtgcatgatttgttgaagctgaaattcatctccctgctacaggaaacaaaacctatgataggggcagtagaaaattacagtgcattggtgaaaccagctgcaatatccaaacatcttaaggtagtgaaagtccactgtaaagaagttgatgaaggggtctgtgaaactgtgaagttcttgagtacattggatgtagtggttcttatcagaaggatggatcggtcgacaaatcgtaagataactgttggccctcttcattatttcaatatctctgaaatttctatttttttctctttgtgaatgaaataaagaatgactaaaattgcaaaaaagggaaaagacagagaaaggtacattttgatgtgataaagagaaaagcatgatccaatatattttgttgtcatgtatgatccatggaagtatacatagttttttcatgttgaactgagtaatataaatagaatcataatatgctgaattctaaatttgagctatatatgtcaaaaaaaaaaaaagtatttacttcaatagttttcacttcgtgttattggcacaggtttgaatgagtagttctgcacaacaacacaatttgttgacttgtgaaatagctctttattgtacatgctatctgacattg

SEQ ID NO: 93558 - DNA, 996 bp, Oryza sativa
cctattacctcgttggatgattataacagcagtgacccatcttgtgttgatatcttccaagaagatggcttagaaggtgaattcatcatagacattggccaaggtctggataatattgtcattactgatgtagatgagatcactgatcaacaagacctgtcaacaataaataatcggagtactgatatgagtgaagacaatgacctagtatctgaagatgaagaaagtgaagacgacaatgaatcaattcctgaaatgaatgattactattaccgtcaagaagaagctgatggtttctaagtttgctgtgtgtgtgtgtgtgtgtgtgtgtatatatatatatataggtattatgtgcgcttttgttcttttgttttatgacatttatttacagaagttatttatgagtaatatttttaaaatacacaggatgacactttcaaatacaagaagctcaagaagaagctgatcatcttccaatagtcctgcaatttcaaatgagaacgatgatcccaatttagatgaagtggaagatgaggtgaattttcacttgcaaggttgttcagaacttccacctattatccccaacatagaagaccgtccactgattgaacctgaagggaaaacgtgaggtttcatcatgcaatgtgttttctagaacatagctttatctctgctgtttaaacagaagttattttgcttttgtagacaatggcatgaaattccaaccttaggaaagggaagaaggccagcaagtgttctatcctgcctactaaagaagaactatcctggcatagtccaatataaaggcaagtcagtgattgctacaacttggaatcactacaaagcagacaaggactcaaatgggagaagcaaagctgatgtggttgaagaaggtttttgggtattattatatttcttctctatttgttactcctactatcttctcattactgttttaaacatatgcagacaatttcgttttaaaataatatg

SEQ ID NO: 93559 - DNA, 1063 bp, Oryza sativa
ccacatggaaaatgggaaacatttaatgggatggttgatgatagcgaggctatggctaagatcaagagaagatctacatcttcaacagctaacaagcgtcgtcgacaagaagaagatggccatgaaagagcaaggctgatcaaggatgctcgtatagcaaaggaatatgcacaccgagtgctggagtgtagtagtggccaagacagctacaccaacactataaaacttattcttgaggtgcaatctgtcatatacctattatttttattagcataattctaaagcattagtttttaattttgtgtgctaaatatttgaattgtagagtgttatccagcatactggaatgcctctacctgttgcaattccacatccaccgccgccgccgccaccacctacatacggagtttatcattctgcagatcaatctacggtgaatgtatgtggtcatgtttctattaatattgcagatgtgtcctagagatagattttttttaccttgcaatatccagtaatttcaatgtcattttagtggcgtttactatacatatgcaaccattcaagtgtagcagtgtcatatttatcaattgatactaatagtgtaatgtctcagtggtctttatgctcatcgtctagtttattctatacttactactgcaaatcaatgttttgttcaataccatttgttacaattacatgaaaaccattaaatttcatccattgtgctttcaaatttctgtgttggataggctcgtagcagtggctcagttgttggagctggagaagagaatcatgctgggactgcaactgttggagccggagaagagaatcatggtgggattgcagctagagaggagaataatggtggtattgcagttggcgaagataatccagaagaaactttggctagaatttctctaggcatgtttggagggcatattaatgcatctggcagtgcaggtggaaaatactctcctcctttggaagagcttggcccattttgattttagaatgtttggaagaattgcactgaagtgtgaaccttgatgcactcatgcaagtg

SEQ ID NO: 93560 - DNA, 1034 bp, Oryza sativa
atatgatcaattttggtctgaattcccactttggctggctggatacatatttgctgtagaggctggattgaattctattatagaaaaaagaattctcactaatatcagaagttatatatgattttacaaagatgtttgcaaaactgaaaattcatggaagctgtatctgatgaacatggaacacatcccctctgtaagtcacttccttctcttcaacacccaaaccccagatatgcccttgcagcttcagtaaaccctttgcatcatctccatggcctttcttggccatggcaccgcccttgccattgccattggcatgatcgccattgtcagcatgagccgcctccagacgaaccggaacacgccgatggcgcggctcagctgcttgacggcgttcctgatcgccggttcatcgccgtcgatcaggaacttggcggcgtggacggtgaccctcttcccccccttgccagagaggcgcttgccggcgtgcacctcgacgtcccggacattgccgtataggtagaagaggagcaaggtgtagaggcatttggacgaatggcctaggctcttggagagcttcttctgcaccaggcagtcttgccggcgagcctccttgaaggcgatgtccctctcgacgaagacgttgcgtatctggtagagcccctccttcatcgcggcgaccttgtcggcgtggccggcgagccgcgcgtcggcgtccaggctcttggctaggtcggtgaacatgtcgagcacctcttgccatgtcttcgccggcggcggcggcggagaatttgcaggtttgttgaaaggggtcgggcgcatccaggatggggacgacgaggtcgcctcgtcggcggtgtcggagaggaagtggacgcagcggcgccgatctggtcggccatctgggtcgccggggatgggtggcccagcgcggccatgtcggcgcgcaggtcgcggagcacctcctccagcgcgccgcgccagatgtggtgctgcgtcagctgcgggcagatgcgaggcgcacgctcttctca

SEQ ID NO: 93561 - DNA, 1643 bp, Oryza sativa
gcttattcatgaagatggtactgagcttcctgaattttgtgcaagcatatgaaagcaccagtctagtactaatcagacattgctccattgtttgacacagcaagctggacaaaggacaaatgggaaatgaaccaaatatcaaacctgataactttatttcaactaggctctgatctataaccttactgtgcttagtctcatcaaccaaaagtcttcgtggatggaaaatccttccccaatcaaattcgctaaatgtattcttgtttttggaacaggcattggacctatgtacagagctatgtctcttagcatgtcatccactttgtacagccctgggatgtgggatggttgtatgaatgccttcctcaccaaatcatcaaagtaatcagtcgcaacattctctatgctatttttcatacaattttcactgacgacgacacagttgttcatccaatagcttatcaattcctcccttgtgaaggtccagcgagggtatgtacccaacaccccaaagcagcgttgcaggtgtttgggaagaagcttacaacccagaataaatggagtaacaaacctgaactggatgcgacgaactgctgacagcgattcagaacaatgtaccagtcttctcattgaggttttctcgaagcagtccactcacaacttttgcagctaaagggctgcacaccctcaatgtcgcagcgatcttctttccaataacaagtaatttctggtattcttcagggtgtgcaccacccagggcattttccatgaacatgcagccgagatcttccattgccaggaaccctacaggtaagttttcatgctattgatcttagttgccagatgttggtacatagtggtaatgatggccttgcttcctgctctacttttcatgaacagtgtatcgagtatgtcattcattcccctggggtagctagaagcaccatcaagaacaagtagaaatctctccattcttagcctttctgatcacacttgaaagattaatggttacgttagaactcaaaccaagcttcttgcacaatgactttaccaaggccatggctggactagtatattctctgcaattcacccatataatcattgagaaatggctcctcaccttgcgatcgtcgcatacgagccgcgcaatcgtggttttacctactcctttgacaccccaaatgggaagcacacaaccatctggagaggatgatccattcttgtctatgtgaagcaagaattcgatggcctgtttcctctcatcgactctgccaactaccctgtcatggatcgaaacaaagatgataaccggtcgatgatgtaacactgcttggtcattctgcaagctgagaagctgagtgaacttggggatcccagaagctactgcttctagcttcttgacagtggcagaaactttcatggtggattccttggatggaatcagctgcgatgctgcgatcttgatgcgtttgaaggagttactagaatcgatgatggagctcaccttgctggacatatctctccagttgcgcagtgtctgatcgcctcgacatgcggcgtcctcaagctcgcgtagccagcgtagtagccatgaattggtgatggcacaccccttggctgcctccagagcggtgtgaatttcg

SEQ ID NO: 93562 - DNA, 3225 bp, Oryza sativa
ctattttaatatgtacggcttatagtgctatattgaaatatatttgttattcggtgccaaaacaaatatgtttgttattaggaaaattttgatatagaacattgtggcattttttcctctgtaaaattcaaataaaaatatagtttctttgtcacgggataatccgttttgttgataattagataaaaaacaatggtcctattactcatttaacgtaggggccttctctacagtactttggtaaaaattggagaggcaaaattttcgaagcactactgacctggccaagtggcaagccagtgttttatatcttcgattaaaattgttaaaattccatgtcatacctttcccttgaaaaaaaatcaatttttaatctatgaaaagttattaaattcttatctttttttattcaatttatcaaaaaatcagatatttccattatagtggtccccaaattgtttttggttttcacaatttggaacgagttttgaattttgcaaaaaaaaaagaattgcttacattcaacccatatttcttcacatttctattatttacattatttttttcaaaatttcagaagttcccattctactgttcccatgatttttttccctcaatttttgaaacaaaaataaccagtttgggcgtgcaagttggcacttggctaaaagtgtgatttttaaaaatcctataagcgtaatgcccatgcattatgtgagtgatgatctttgggagtgaagtctcctcgttcttgaaaatcatttgttacgttcctacaatacttcctatgatattaggatgaacccacatgtttctttgttgcggccagggctatcctgggcatgagcgagacagggcccaaaaaatttgggatccaaaattttatatattttaatccatactaatattttctgagttctgatatgtttcggattaatttctctctttctgtttcattgaatttactcctttggttcggtgataattatagctacactgaagaactatatacctcatgacagtgatgtgaacgtatcatctagaaaatacaatttcattttttccacttaattagtgagaagaactgaattggtgcagctatttttcttttacctagctagatcgtcatatgcgtgtgagctttttttcatagctttagctgtcatataaggcctcattttatatcttgtaccggacctccatatttttgggggacggccctggctgtggatgtgatgctatgagtccaccatacgcggtgacgaatccaaaagaaatagcagggttatgcacaaactagacaaggtgcaaactccttttcattacatatttagagattgaaaggatgagaagaagatttcttttcaagaatgactagaagtggaaaaaaaatcctaggctgttttcgtagtactgattttctttaacaaatacgaagtatttctctagtcctgctgcgtggtgcggtggaaaatggaaaggttgaacatgcaaattttggtattgttcggtgtttcaaaaccatgcatatagttcaccttctccacacagagagacgagcccttttaaatgatagcttctcattaaacaatatcagttgtttccactatttttacacagtaagttggattttacacgagctgaagctgttgaaacatacttatgcctctttcttttatacaaacatagccatgccttaacataatgtttaatttaatataacctttcttcagaatagaagggaaccaaatttaacatgacattttatccatggcggccacgatgtcatttgcaatatttttcgcatccatggcaataccggccaatcctctcctagcaaacccagcacaatacaacccattttcacctctccaatgatttggaaaataatttttagggaaaccatcgtctttaaacatgctttcaccattctgcaaccgataaaaaaggattatccttttgtaataatgaaacaaaatcatgcataatgcaacaaaatatattattgtgtaaacaaatagaattaaaaaagaagagagaagagtttaaagcaatatccatattctttgtacctttagccatgcattaactgtgcttttgtaacctgtcgcaaatacaatggcgtcaaatgaattttgcctcccaccatgaaattcaacactgtttgtatttatctttgatattccttggaacacctaatagagatatgaaaagaaatggtgtaaagtctgaacatcaattgaggctagaaacttcacaagcactaccaacttaattttgtatctaaagagtgtagatgcatgattactttgataactcctcctttgattaatcttgcagtgccaacatcaataacggcagaccggccagtttgtgacttgagtaagagaggacccattttaggcctcgtaataccatgttttgacaagtctcaaaataaaaatttgcagccatcacaagaagagaatccactgctgtcacatttagccctaaattttggaccattgtcatcccataccatattagttctttggtcattatgtgtatctgcatttagattgatatgtaaccattagataatcatcatattaggaaaaagtctctagcttgaaagttaggaacatggaacccaaaaaaccccaaaatttttttttggggggcttaatatttagagttaatcacatttttcatttatattatccacatgtgtatgtggtacaaaagacaaagataaagggctacatgaataaatacaacttatgaatcgacaactgaattaatgtattctattattacttttatagcaaacatgaaacataggtatgaatgcatcatgaaatgtaatgcaagataagtaaatatatatgatgtacataccgggctacgaacaactatagaggtgtgggctccatgcgtgacaagatcataagcgatctccatgccagaattcccggcaccgaccacaagcacattcttcccggtataggctctcccagacttgtaagccgacgagtgaatggcttctccctcaaacctagtgagaccaggaactggtggaatgcttgccgctctgttctcgccagtgccacgacaaggaactgtgcggtgagccttgtcacaacactagtgtccgtgtcccgtgctagcacagcccaacggttcttacatccatcatatattgctgactcgatagcagtgtggtaccttggtcgtatcccaaactgg

SEQ ID NO: 93563 - DNA, 1066 bp, Oryza sativa
tatataggttgtaattaattatatgttcatattaacaataataatttagtttccttacaagaaaataataatttgactaatttgtcgatcgatgatcgaagcttaattactgttatgatgccaatatctacgatcatatcgaaagcttaattacggagtttcttaagacattattactgatcaacagaaggagatctcgcataattggagttgacaacactcaagagataaattaagagcaacctcagaaagagagaatatatataacagagagaaaagctcaacaatttgtatcatgagcagctaattaattaatcgattcacctcatataggaaattgaattttttaaaaaaacttatttggcaaagttgtaaggggggtttcattcatcctctccttaatcactagtggccatgcatgcatgtccctagctacccttttttcctgatctagtgcatgcatgcaattaagatgcgacgcctaattaattacgattgatcattaattaacaacaatattaatctcagcttcttctctaacaacatatccattggataacactatcgatccatctccggctcgccgccgccggcgacggcggctacacgccgacgccgaggaagtcgaagtacggcacgcccttccgcttgtcgccgccgccgtcgacgtcgccgtggttctcatggccgccggcatccatcagttccagcgtctctctcatgggagtggagaagaaggtgatggtggacacaggctgcgccgccgccgccatggacgtcgtcgccggcagcagcgtaccatagctcgtaccgttaaacgacttgatcaagaacggcgccgccgccggagaagaagaagacgacgacgacctgttgatcatgccgaagccgaagcatagcgagctattgcgcgcgcctgatgacgcaccgccgccgctgaagtcgagctggctggcgtagaagaagaacggcgcggggtgggccgcggcggcggcggcgcgggcgagaaggcggaagcgctcgcgggacgcgcgggcgcgaacgacgtgccagtggttcttgacgg

SEQ ID NO: 93564 - DNA, 575 bp, Oryza sativa
aaccatgcatagtgcacacttctccacataaagagacaagccgttgtaaacaatagcttcccattaaactagttttacaaataaagttggattttgcacaagcacaagctctccaaacatagccatgccttaacataatgtctaagataatgtaacgcttattcacaataaaagataatataatttaacaagacacttgatccatggtggccactatgtgatctgcaatattcttagcatccatggcaatgccggccaatcctctccttgcaaacccagcacaatatagtccattttcacctttccaatgatttggaaagaatttcttagggaaaccatcatctttaaacatgctttcaccattctgcagcagataaaaaaggattatcctttttgtaataatggaaaaaatatattatgcgctacaacaacatatcattatatatgtaattaaagagaaatgaaaaaaaaaagaaatcccttctttctatatacagttgatacctactagctataaaactgctttaagaattagccacgtcatcccaattagctgaaactgttagatcttaaat

SEQ ID NO: 93565 - DNA, 968 bp, Oryza sativa
tcagcccgcagtggcacgagcggctcgagttcgccgtgcacgacccggccgccatgcacgccgaggcgctcgacgtctcgctctaccacgaccgccgcttcaacccttccggcggcggcggcggcggtggcgggaagaaccacttcctcggccgcgtgcgcatctacgggtcgcagttctcgcggcgaggggaggaggggatcgtgtacttcccgctcgagaagcggagcttgctcagctggatccgcggcgaggttggcctcaagatttactactacgacgaggcgccgccgccgccggaggataggccgccggagggtggtggtggtgacaacgcgccgccgcctgaggtcccgcctgaggcgcccagggacctcccggacatccccgcgccgaccgaggccgccgtcgaggtgcagcagccgccggtgcatccccctgtcatcatcgtggaagaggcgccgccgccgatgcatcacccgatgatgccgccgatgcacggcccgcacggcccgatgatgccgccggcggtgcacgggccgcacgggccaatggcgccgccgatgcatcagcatcagcatccgcagccgcagccggagccggagcctgaaccggagccggacggcggcgaggcggggtacccgcccgaggtgcgcaagacgcggatggccacggagcgcgtccgcatcgcgcgccacctgagcggcgggttggggccggagtactacgccacctcgccgcgcgtcatctccgggcggttcgtgtccaccggcgacgccgtcgagccggtgcagtcgtcgtacgacctggtggagccgatgcgctacctgttcgtccgcgtcgtgaaggtgcgcggcatccgcgcctgcgaggggccgtacgtgaagatccaggccggcccgcacacgctccggtcgcgccccggccgcgacgtttccggcaccggcaacccggagtggaaccaggtg

SEQ ID NO: 93566 - DNA, 3254 bp, Oryza sativa
gttatgttcttttaaaaaaataaagaagaagtctgatactaattgctatcatgataatgacgggatggtaaaggtccactttgccttgggtgcctcagccatgagtcatctgatattctttccctcaaacaccatccaaaaacactgaacaggtagtactgatgccctgctactgaagagcctctctgaagtatttctagaatcctaaatagtactactctttggtgaaaaatactttcttttttgggggcaaaactctacaaaattgaaggcacaaaattggtttatatttgtaaatgagcaattttacggtccttgagaagataccatgaggtactaaaaatttagtataaaatttggtacctcataaaatctagatattaagaggtataaaatttacaataaaaaaagtggtaccttatagtatcttatcaagaactgtaaaattgttcatttgtgaatatacccaaaaaaatgtgaattcattcactccaatgcccccggtatgattaatgccatgaataatctagcaacacaattacaccaaggtatacctgtgtgatacatgcaaaccacaccttttattttgcaagattatgcgaaattacataggtaaatgcaaaccatatttctgacctgtgtaatttattactactatatgtaacttccttatagaatgaaattgtgtgttagaagtagattgttcatttcaagtatgcttatggtatccgttattctgacttgtcaaaatggcatcatctccttagagaaaagcttatttcctttgttaaaggttaacatcaaagcggttctatcatatggtccatggcttattcctcatgcatttatgcatcaacgaaatcaccaaagttttcatgatatcataaaggtcaagtgaagtccatgcactcaagtgaccagaaatttttggacctgcctaagatcagcaaatctagtgaagccatgctgttgacatgtgagattaaggtcactctccaaagtccattctactccttttcttcctttcttgacacaaccattaatctcgtgctctgcttttgtccatggcttgttgtgttcctaacttattgttcttggccacttggttccattcagagaggagtagtttgcactcacaaagtgaagtgacaatcttctttgaagggttaggacatgatcacctgttaagtgagattctgtcttgacttgtgagcagagcaaagcagcaggagcagagcttcacttgatttgcctcctctctggtgaagcagagatgaactccccaaattatcatttcaaaagtggcaaatcaccacttcaactatatatataataatgttcaaattgtggtgtatacatgcttatgaataaagtcgaattttcttctttatttttcttctatccaccgattttctccctatatcgcacgctcgttattacaccagaacgaaaaccgattgagctcagagcatcctgtcggagaggctgggcagccgccggaagaagttgacggccgccggcggcatggggtcccggaacatcgggtggcggaggtagtagaacccgccggcgacggccaccatcttggacggcatggcgtacagcgcgacggcgacggcgaggcagacgccgacgaagatccggctggcgcgcgggtccctccagctcaccagcgcctgcaccctctccccctgcgccgcgacgtcgcccatgacgcgctgcacccgccccgccagcgtccgcagcctctcgtagcgcgcccggagcacctccggcggcggcacggcgtcgaactcctcctccaggtcgtcggcctccaccgtgtcggcctgcgacagccgcgcgtccatgccggcggggccgcgcggccggaaccggtagtaccagacgccgatgaggaagacgtagagcgacgccgtgggcacggccagctccgggtaccagacgaggacgaggtagaggacgtgaacgagcacggtggtgggcgggctgcgccaccgctgcacgctgtcgagccaccgcgcgagcccgacggcccaggcgagcacccccatgatgcggaaccagttcgccttggcgcgccgcacgctccacgtgtgcgcgtccacgtcgagcatgtggcgcaccacctcccgccccagcggcggctcggaccgctccagccacgcggcgacgacgcgcacggcggcggcgcgcagcgcctcatgctgcgcgacgccgatcgggcggaggtagtgcatccgcggcagcagcggcgaggtgtaggtggcccaggtgtccggcaggtgcgccggcgacgtgaaccgcacggcgagctgcacctcccccatcttcttagccccgaccggagcagcacgagcagcgggtacgacgccgtgtacgcccggttgctctccagcgtggacacgcgcacccgcaccttcccgatccggtagtcctgccgctgctcgtccccggcgccggcgaaggcgaacatccgccagttgtcgaacaccgccaccgtgagcaccgtgcacgggtcgtacacctgccacgtgtactgctcgttccaccgcgggttgaggctgtccgtgacggtgcgcgtccgcacccacttcttgccgtacttggccacgcagtaggcgtccgtcgaccccttggcgccgcccttcgtcttcatcggcagcagcccgcacgccccgatgatgcccagctccagcacgcccaccggcggcctccacagctgcttcgccgtcggccggtagtcgctgcacacgtgcgccgcctcgtcgagcacgtggtaccctccttccaggcacagacggaggtgaagccggccggagtagaaccccggcgggccgccgccgggaccaatgccgatgtcggaggtgccaccctcgaggctgaaccacctcgacgcgacgagttgccgctcgtggagacgctgctcgacggagttgacggggatggtggcgtgtccgagcagcgccggctccttgatcatggagcggtcctcgacgaggacgacgaggctctcgtcgagcggctcggacacgacgaacatgaggtcctcctcccacgcgaacgccgagccgctgctcctgctcgccaccgaccgccgcgtcctcgccgactggaacccgacctggatcttgacgcgcacgtcgaacggcagccccggcggcggcgccggcacgcgcaggtcctgcgcctcgatcaccgacgcgcgcaggtaccagagcttgggcgactggtacaccttggagcgcgtgtac

SEQ ID NO: 93567 - DNA, 624 bp, Oryza sativa
aatcacgtgacggcccaggacgtgctgacaactccagacgtcatcgttggtacgttcctcgttcattccatccctgctacaattttgttcgactctggagcttcccactcgtttatatctgtgccattcgtggggagaaatcagttgggggtagaaaggcttagaaaccctctgcttatcaccacccctggaggggttatgacagcaaagtactatagccctgccgtccctatagaaattcaggggattccttttccctcggatctgattcttctagacacaaagaacttggatgtgatccttgggatgaattggttggcccaattccaaggggtagtggattgcgcgagacgcactgtcactctgtaccgaggaccagaacaaccggttgttttctttgcacctccaacctcttgtcagaaggttcagaacttcatcagatagaactgtcagaaacccccatagtcagagagttcgcgagacgtgtttccggaagaactacctggtatgccgcccaagcgagagattgagttccggatagatcttgctccaggaaccactcctctgtacaagcgaccctaccgtatggcagcaaatgaactggccgaagttaagaaacagttg

SEQ ID NO: 93568 - DNA, 617 bp, Oryza sativa
aactagccctgagcaactaaatgtctttaaatgctgtttactgcaaccctaacccctctatgttataattcctttgtactcccttgcatttattctgcatttgtgggtgtgtcttgttgagtacggtggttgtactcagtcttgctaaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattctatttacgcttccgcttgttaaactctgaattgtatcaacttttggtgtaccttgcctcctgggacaaggattaatgcacgcacgtcaggaacacccgttgggttatttccggtcgtgacacctgcgtaccattactgggttagcgagccactcggggtggaggacttccctgatgaagccagctttgagaagtttgtcgaattcttctcgtatggcttgttttcgctcgggtgcgaatctctgtagtttttgtttaactggcttgccatcgggtcgcaccatcaatttgtgctcaatcacctctctaggatttc

SEQ ID NO: 93569 - DNA, 3872 bp, Oryza sativa
ggcgcgcccgcgccccgatggtcaccgccggcgaccaccggcgcggcggagcggcgcccgagagagaggagggaagggggaagcgaaagggcggtcctcggctcaccccgggacgacgacgacgacgagaacggcggccggagcggaggaagacggcggcgcgggtcgggatgacgatgacgacggtgctccggcggtcggcgggcgaagcggagcggcggacggggtcggcaaccactcggcgaagccgatggaggtgtcgccgagtaaggaggaagtccggagcggcggcggcggcggaacggagctcggcggcgatggcggagagagcggagcacggcgcgagcacgaatccgacggcgagagcgagcggcgagcggcggaaacggaagagcggagctcgggcaacgattttatagcgtcggaagggagagaaggcggccggggaggaaggaaaccggccgcggagatttcggccgccatagatgcgccggcgacgaatgcgggattaaaatcggacgaatccgagggagagagagaggggaaaacgggggaaacgggagagggaatcgcggggaatgattcccccctcattaaggcgcgcggggacggcgggatgcggcgcaatccgcggcggcgacggcgctagggcacgggctcggcggcgggcgcggcggaagaaagccgatgacaggtgggccccacccgtcagcgagagtggcgggcgggcccgcctgtcagcggcgcgcacgcgcgcggggagccgatgggccgcgggggaggagagagagagagggagggagaagtgggccgagccggcccaagagggaagggggggggggaaaaagaacttcttttagggttttctttttataaaacctttttactttgtttatttcttttctattattatttgtgctctgaaaattccactaaaatttatttaagcattttaggcttttaggaaacatacaaaaatcctccaagcctcatttgacttttatctttgcacattttaattgttggaggctttctcatgaattttaattattctttgcacaattttgaggatgaattttagagtcgatttgggacgcgacagcagggtcaatgggaagtggaggatgtgcgttgacttcaccgatctcaacaaggcgtgccccaaggaccatttccctctccctcgaaaagaccaattggtggattaaacgacaggatgcgagttgttaagctttcttgacgcttacttcggctaccaccagatcagcatggcaaaagaggacgaggagaaaacaacgttcatcacgcccttcggtgtattctgctatatcaagatgccattcggattgataagcgcagggaacacatatcagcgtggaatccaaggggcacttggcaatcagcttggacaaaatatcaaagcctacgcagatgacatcgtcgtcaaaacaaagatgggcgattcactaatcgacgacctaatggaaacgttcgacaacctccgcagatatcgaatgaagcttaacccggagaagtgcacgttcagagtaccatcaggaaagctactcggcatccttgtctcaggatgagggatggaggccaaccctgagaagatcaaggcaatcgagaacatgaagtcgcccacaagattcaaggaggttcagctgtgttaacgaccaaatttggtaagatatgaaccaggttcgacattggaatcaaggcagattcggcaaagagatagatccgaagaacagagtatgcatcggctgcgaaggcatcggctggaatgtgcatcggctgagacggatcggtcagaggatggctgataccgccgatagagccggtatagccgattccgatggaaatagctccgaggctgtttctagaatcgattgacgtgcttcacaaggattgccacgatggagataaagctctcagaaaggcaattgtatctattaattaggatattttatgtaatttccttagagatatgtttgggtaaaagtctgccgcaaagacttatggtatcttagagtttgttagagataagagtcgtgtccggcaaggacatgttttgtatctcgggtataaatatgacccgaacccaatgtaatcaacaacaacgttcaacaacactttcggcgcatcgccaccctttttactttcgttctttttcaacgagttcttgcttttgagttgagctgcatcgattcgatcttcaactagaggtaaacttgtcatggcggtttgcgttctcgggattagtgcttctatctttataacactctaatcttgtttatgtgatccgtcgagttatcatatacgctttgtaatctctactaattgctctatataactcgtcatcggttgattcttattgttagaaagtagtcgatagagttatgttttgttattaatttagattatatggtgtatctaccatctcttagagattttcatcatcttgcctagatcttatacttatctttatgcttaatgctgcatcggttgagttcgatctattaagtaatatctataattatgatatctggcttgttttatgatcatcgaaagagatagcatcggggtttcagccgatcttacctgatttagctattttatatctcatatgcttaattgatatgctagatccgccctttatattaagatcttattgctttaaagtatattaggcttcttgtttaatatattttgcctgttttaatatcttagtataaagtagtatcagaggattagccgatacacgctagatctatctgatcggctatgctataaacgtttatataaccatcgctttaatgtatatttcaacttaaatgatttaatactatctcggcatgatgaccgatctatcccaatcacttagtttaaatatacatcgaagaaaggattatatgtcactaatatctacagccgatcgagtagatttagttttatcttatttattcatggctgtcgatcgatcccaatatgacatcggttggatgataaatgatatgtcatcagcaactagccgatcggctatcatttatggatttaatcgtggttttctgatctttatttcttgttgattgcaggatcaaatcaactagcacactcacgaacctaaaggcaagattttggacctgcactgaagttaagcagatcttccgggccagtttgtgttttcgcatcaaaaagcagttgacaggatgcatggcttcgctaagccgcttcgtcgtaaggatgggagaacgaggacaagctttctttgccctgctcaagaagcaggacaaattcgagtggacccaagaggtagagaacgcgttcatcgcgctcaaacgctacttatcaaacccccctatactcgttgttcctcaaattaatgaagaattattcctatatattgctgctacgccttattctgtgagtacggttatcatcgtagagagggaaaaagtacaacaccctgtgtactatgtcagcgaggccctccatgacgcaaaaactagatatctacagatacagaaactgctctacgccgtggtcatgacatcaagaaagctacgccactacttccaagctgtcgcgaccgggaaaattgccttttcccgaacgctagtgtattaatccccgtcccaggaaaagccggggtacaccacacaaacatgatataaaagacacatctttattatatcgacaatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaggattgag

SEQ ID NO: 93570 - DNA, 543 bp, Oryza sativa
gggttcctccaaatatccctctcacggtacagccccttcttattagggtcatgggaagatcaagctgggtcttcaaatgggctactctgtctgcggcttttgggccgtgaacagcttccccaccttgtactatgtcacaattccttctctttgcttcctcaatggcatctccctctttcctgaggtaagtttccatatgctttaacgtttgttcagacatttgtacgcacttggcttaaagtttaacacaagatttacatctgcaattaactcagaaaactagcccctggttcataccctttgcgtacgttatggtggccgcatactcctgcagcttagcagagtcactgcaatgtggtgacagtgcagtggagtggtggaatgcacagaggatgtggctcattagaaggatcacctcatacctcctggcaaccatcgacacattccgcagaatattgggcatctctgagtctggattcaacctgacagtgaaggtcactgacttgcaggccttggagaggtacaagaaggggatgatggaat

SEQ ID NO: 93571 - DNA, 3387 bp, Oryza sativa
  unsure (1)..(3387): unsure at all n locations
aacaccagcctcagcaagggttccctgcttcaacaatgctggtatggactcaagtcgggaaatcgtcttcccggttaaaccacgacgccgatctccacggnnttttcccccccctcccaaatgaccggaaacgagaacgcagtggctacaaaccaaggcgactccatgtcgaaaaatccacccgtcgaaacggaaaacagatcatcgacgacatccaagctcgggaaggattctgatatggccaaaccttgtccttccgacatgaaccacgagccggcaaagatgacttccgaagccacaaggtcttggtgtcctatccaccacaccaagaaacacaccctgcaagattgttgggttttcctcaacgtccgtgctgaaattcgcgcctacaaagaacgtggaattcaacgtacttctccaactcgggatgtctattgtcctattcacaagacaaagaatcacgacctctcgagttgcaaagttttcctcggccccatgaaagctccgtttccttaagtcatacgtccccgtcagggataacggcaaggaataaggagcgactccagcctcagatcgattcgttggggtaatcgatatcgatcctcacgaaccatcggtcttacatcttctcgaagactatgggtcatcgacaacgagcgtgccgcgggaggtattggctatcgatgacgttggcacgtcaatgcaagccaacgcagaagcggcgaatcaatcgactactccagcccaacacatcagggccgttcaagctatactgagggaaactccttacgatcccgttctgaacgatgacctcgagcgttggacagaacgactacgggaatcggtgaccaacctcagtaacgcgtttgaagaagccgctaccgcagcgcaccaagatcagccgccaactggcgacgccaatggtgaagatccggaacggagggaatcacctcaacgagccactcctccacctcgcggcgctggcgatctccgagatcaaatcaacggccgccgagaagcacgacgcatacgagacaatgtaaatcactctcggcgtcatgtctcttcacggcgccatgataacggaaatcgaggagaccgctcaaacgaggaccaggatcacgacaaccaccacgatcgcaacgatcgcgaacgacgggggccagacaatgctggtcatggccgccgccgtaacgacgacgataatggagatcggtgccgagacaacagcgagagacaacgacaggattctcgagatccaggctgtcatcctcgtaatcatgcgtcggaaccaagcgacccatcgtcatcatcatcatctgcgtcctcctcatcgtcagacagacatccacgaaggacacacgaccgccgacaacccaccgcccccaacgctgggtgtagggctttcggtcgttccctacgtgatgtccgatggcctgagagattccgacccggagcaattgaaaagtatgatgggagcaccgacctagaagaattccttcaagtctactccacagtactctatgctgccggagcagacgacaacgcgctagcaaactatttaccaactgcgttgaagggttctgcacgttcatggctgatgcatcttcctccctactcaatctcttcgtgggcagacctgtggcaacaattcgtcgccaatttccaaggaacgtataagcgccacgcgatcgaagacgacctacacgcgttgacacagaactcaggtgaatcattgagggaatatgtttgacgcttcaacgaatgcagaaacacaatccctgaaatcaccgacgcttctgtaatccgcgccttcaaatccggtgtcagagatcgttatactacccaggaattggcgacaagacgcatcacaaccactcggaggttattcgagatcgttgagcgatgcgcccatatggacgatgcgctaagacgcaagaacgacaagccaaagaccgggggagagaagaaatcagccacagacgcatctgagtcaagcaagaagaaaaatcgcaaaaatgggaaaaggaaagctcaagcggaagcctcgcagcagaatgcgcgaaccctcccaagcgcctagacccacaaggcagcgacacaaagaaatcttggtgccccatacacaagacggacggacattctctagaagattgccttgttttcaaaaaatcgctcgagaaggcatggcatttgaaaaaggcaagcgagtacgcgttgtcgagaagaacgaagagacggctcctcatgaatcggattctgcgtattcagactccgacctccacgtctcacacattttcggcggctccacaacgtactccttcaagcgagaatacaagaaagtggaacgtgaagtctgttcgacatggcggggggctgcacccaagatgaagtggtccgagtagaaaatagagttctcggaagaaggccaccccaagaccgccgttatcccacgacgatatccgatcgtggtcgaacccactattcggaacatcaaggtagcgcgagttctcatcgatggtggcagctcgatcaatcttcttttcgccagtactctagacgcaatgggaattccgcaaagtgagttgacaccaactgatcaacccttccatggaattactccccaatcatcatccagacctttgggcaagattacgttgcatgtgactttcggccaggccaacaacttccgaacagagcagatcaccttcgatgtcgctgaattcgatacaacttacaacgccatcatcgggagaactgcacttacgaagttcatggctgcatctcactacgcatatcaagtgctcaagatgccgggaccgaagggaacaatcactattcagcggaacgcaaagctggcggtgcagtgcgacaagcggagcctcgacatagtcgagcaaacgcccagcccacccgccacgactgagccaccaaagaaagtgagcaagacaaataaaacgccgaaaccggacggcgccatcaagatcgttccactctccagtgccaatcccgacaagactgtcaagatcggggtgacactaaacgagaaataggaactcgcgcttatcaccttcctccgcgacaatgccgacgtgttcgcttggcagccgtccgacatgccgggggtccccagggaggtgattgagcacaaactaatggtgcgacccgatgccaagccagtaagcaaagaatgcggagatttgcaccagaccggaaacaagccatacgagaagagctcgacaaacttctcaaagctgggttcatcaaaaaagtactttatgcagagtggttagccaatcaagtcatggtgcggaaggcccacggaaaaatgaagaatgtgtgtggatttcacggacctcaacaaggcgtgtcccaaggatcactttc

SEQ ID NO: 93572 - DNA, 3538 bp, Oryza sativa
caatcgagaacatgaagtcgcccacgagactcaaggaggtacaaaagctaaccggatgcatggcagcactaagcagattcgtcgctaggatgggagaacgaggacaacctttcttcgctctattgaagaaacaagacaaatttatatggacactggaagccgaagaggcatttattgcactcaagcgctacctatcaaacccccctgtacttgctgctccccaacttaatgaagaattattcctctatattgccgccacgccatattccgttagcactgtcattgttgtcgagagagagaaagtacagcgaccagtttattacgtcagcgaagctctccatgacgcaaagacaagatacccacagatccaaaaactgctttacacagtcatcatgacatcaaggaagctgcgccactactttcaagctcacagagtcacagttgtatcctccttcccccttggagaagttgtgagaaacaaagacgttgtcggccgcattgcgaaatgggtagtgagctaagccaatttgatgtccactttgtgccgcggacagccatcaaatcccaggtactcgccgacttcgttgccgattggactatgccagacaacaaatcagacaaccaaggtgacaacgaaacatggacaatggcgttcgatggcgcactcaacagccaaggagcaggggcaggatttatcttgacgtctccctccggagatcaattcaagcacgcaatccacctcaacttcagggcgaccaataacactgcagaatacgaaggactactcgccgggatacgagctgtagccgcacttggggccaagcgactaatcgtcaaaggggactccgagctagtcgcgaaccagtgcacaaagactataaatgctctaacccccgagttatccaagtatctcgcagaagtcaggaagttagagaagagattcgatgggatcgaggtccgacacgtctatcgcaaggacaacgtcgagccagacgacctagcacgatgcccgtccagacgagaaccgctcgaacccagcacctttctcgatatcttgacgaagccatcggtgaaagaagttagcggcgaagttagcccgaacacccccgacatcagctcggaggtcaccgaggcagaacgcgccgttgctgatatcgaaaccacagacgactggcacatcccattaatcaaattcatcagcagtgaggagttgccagaggacgatacagaggccgagaaaataacccgtaaagcaaagatctactgtatggtcggtaacgatttatacaaaaaagctctaaacggggtacttctcaaatgcgtctctaccgacgacggcagacacctcctcctcgacatacatgaaggcatatatgggtcacacgccgccagtcggacattggtcggcaaatcttttcgacaaggctttttctggccaaccgcccttaaagatgcatgcgatatggtccagcgatgtgaagcctgtcaattccagagtaaacacacaaagctacccgcgcaagcgctccagactatccctctgacttggccgttctcgtgctgggggctagatatacttgggccattcccacgaggacagggtggctacagattcctatttgtggcgatcgacaaattcaccaaatggatagaagcagtgcccatgggggaaatcaaggccgacaacgccatcaaattcatcacagggatattctgcagatacggactaccgcaccgcatcataaccgacaacggctcccaattcatcagcgctgacttccaagattactgcatcgggttgggagtcaaaatatgtttcgcctcggtctctcaccctcaaagcaatggacaagtcgaaagagcaaacgacatagtactacaagggatgaaaaccagcgtctacgacaggctcatgtcacaagacaaaaagtgggttgaagaactcccatcagtactatgggccgtacgcaccacaccgacaacgtccaataaggaaacacccttcttcctcgtgtacggctccgaggccatgctccccggcgagctacgacatcagagtacacgagtacagaagtattccgacgagaaccaggaggaacaccgagacaacgatgtaaatcttctcgagaagcatcgtgagcgagttgtcgtccgagcagccagttatcaacagtccctccgccgttatcatgagaagcgcatccgagcacgcatactttcgatcggcgactatgtcctccgacgagttcaaacccaagcagggcgaaacaaactctcaccaaaatgggaaggaccttacacgatcacacaagtcttgcggtcaggggcattcaaaatcgcagacggcgacggtcgcgaattagcaaattcttagaacattgaccaactacgtaaattctatgtattagtcaataccactgtacctgtaagtacccttacagtatcaataaagcctatttctaggtcccatatcacaatcaaagtgttttcacccgatgatcccttactctgatgacacctagcgttgaaacctgtccttatgtccctttacgccgtctcgacaaggcctccgaggaacctaagggatcttcggctggggacgcccagagccgataaagccttgtcagatcctgtagagaaaaaagaccatgtaagatctggtcgtgtaagagttctcgccgtgcgtattaaccaaactgtgaaatcggaaatcaactttccaacctcatggctgggggctaggatcagagcttattcaaccaaggcaggtcaagggtccaagagccttatcctccgagaaaattcctccgacgacaaggctgggggctagagagagtgtacgactcaaacggctgaccaaagtcgttaactgagaacacactcttacacacgacatctagagtaagatacatttgtttaaggaatatttctttattcacaaaatgattcttacagtttttacataaattttccactacattacatctttccctgtcacgtcccaaaacgaccctaaaatatatcctctaaattatgcctagaataattaaaatccgtgtgaaagcctccaacaattaaaatgtgcaaagttaaaagtcaaataaggcttagaggatttttctatatttcctaaaagcctaaaatacgtaaataaattttagtggaattctcagagcacaaataataattattaagaaataaacaaagttaaaatgattttataaaaagaaaaaccctaaaattcctcctctctaatgggccgaattcggcccatctccctccccctctctctctctctcctctcccccgcggcctattcggcctccctccccgcgcgcgcgctactgacgggctggcccgcccgccaccctcgctgacgggtggggcccacccgtcatccccttcctcccgccgttcccgccgcctcccccgcgccctagcgctgccgccgccgcgaatcctgctgcctcccgccgtccccgcgtgcaataaagttggggaaatcactccccgtgatcccctttccctttccccccaa

SEQ ID NO: 93573 - DNA, 742 bp, Oryza sativa
atcaaatctcttgctgagaagctgacaattgggtactccgggaagcgcaatggctgaccaatgacattgaacagtgttgccctgttgccagagcccttgaatggtgtctttccaaacagaagttcatacaagaatatcccgaaggtccaccaatcgacagcgctaccatggccctcgcctttgatgatctctggggccaagtactcatgtgttccaacaaatgacattgaacgagcatcgctgggctccgctatgagctccggccaagggctgatctgggtcgcaatttcaggcttcggtttgcgatctttcttggatttggagaagaatcgagggccaaagcaggttgtaggggctgcacatgatggctgaatcacgcaggatggctcgacgcatgctggctggacacagtaaccttggctgttcttcctgagtgcttcagcgtccgggttggatgattttattagtgttggactcaccgcgcaacggagtgagaggtcaaagtcagatagcatgatgtgcccatcctcccgaacgaggacgttttctggcttgagatcacggtatatgatgccgagcatgtgcaggtactctaatgccaagaggatttctgctacatagaatctgtaatatgacagcaatgcagcattttattagtaaggctcctaagacagtagaaggcaaaaggtcataaattatagtaagctagacttgccatttgtcactactgatttcacatgaa

SEQ ID NO: 93574 - DNA, 1518 bp, Oryza sativa
ttcttctccccaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaatttgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcagcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacaacgctgttttggttcgtgctcttcatgtcttgggctctcgtgtag

SEQ ID NO: 93575 - DNA, 1036 bp, Oryza sativa
aaatcgtttgccgattcggggtgccgaaggagttcatcactgacaatggcaaggagtttgactctgaaaaattcaaagaaatgtgcgagggactaaaatttgcaaatcaagttcgcctcggtcgcgcacccacagtcgaatggggcggccgagcgagcaaatggaaaaatcctcgaggcactaaagaagagacttgagggggcggcaaagggtaaatggccagacgagatgttatccattctttgggcccttcaaatgacccccacaaggccaactaagttccgccctttcatgctcctttacggagatgaggcgatgacgccggcagaactaggggctaactcaccaagggtgatgttttccggcggcgaaaatggacgtgaagtgtcactcgaactcttggaagaggtgagggtcgaagcactagaacacatgcgcaagtacgcggaaggcacttcggcaacttataacaggaaggtttgaccgacagagctcagcccggccatctcgtactaaggaagaaggcaaaacctgtggcggtcgagaaactagaatctaagtttgaaggagcatatttgatcaaacacagatcttgaacaggttcttttcggctggcaacattggagggcgaagagttcgaccattcctggaacgctgcttcccttagacgattctaagtgtaatatgagtggaacccaatttgccaattgtaaatatgtatatattatataagccgttcggcacaaaaagcaaaaaaaagagaggaaaatgaaaaaagaaaaaaaaaactagacgtagggttattatccaccagtataaaatctgtgtcttccatttttctttttgtgaatgatgtcttcgtggaaaaaccccaaagcaaatgcctgatcagcgaatgcaccaggggggcgaaactaatcggtcgaagcatagctcaccgaacgtcgaaaccacgacagctcgaattttgaaaatgcaagtcaaaacactgttgtactcggcatacccaaaggccacgatgcttggtagcacgcct

SEQ ID NO: 93576 - DNA, 892 bp, Oryza sativa
atgttcgaagctgaaggaagaacctacatccatgcatgtcagaaagtggcaaggatcgccatagaagaactccgcgatcgctccagtgatcagttggccgacactgagtatcgctaccatcctcgtcaaccacagggaagtgatcgtgcaagctaccttgagactgaaggaattgagaatgatgctaccacaaagcatttggtggagatgctgtgggctatggatgaaagtcgtgcggagactgtgttagcagctcaagatcgtgaagactggaatcgtggtaagatttgcaaattagaggacaaggtggatcgtttggagaaggaactagccgcgttaaagggagaagcaccaccgcagaaggccaggattcgtcttacagcaaggaagagagctctttttgtccctcgctaccaattggcgccaaaggtccgtgtggtgaagaaagaagttaccctagccctagcggatcctccggtcatcatcataagtgatgatgaagaagaagaatccaagcgcacccattccaaggtcgagtggggagcaactcaagatgatgaagacgagccgaacgagccttcaatcaactccgatgcccggaagaactagagtgacatgtctacccgttgtcttagatcgttgtgttagtttgcttgttttaagtttggttgtgtgtgtttcgcatgtaatttacatcagtggtgggatgtaagtgcatgcgtttgtttgcttttgagtgttaggaagttggtgagtttagtggtgtgagagtcttcagttttgtaataatgaaactcagttaagatcaataaaagttaaagtaattttctgtcctaagtagtttcccccggtttctcttcttgtgccctgtccatgccagatggtgaacact

SEQ ID NO: 93577 - DNA, 938 bp, Oryza sativa
caatccactactccttggaattgagccaaccaattcatcccggggatcacatccaagttcttggtgtctagaagaattagatccgagggaaaaggaatcccctggatttctataggaacggcagagctataatactttgctgtcataacccctccaggggtggtgataagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcatgtcctcggccgtcacgtggttcacacgacaccgaatgacgtccttaccaccgttgttggagcggggaggcgcttggccttgctgtcgcctcggcttcgggcatttatccgcaaagtgcccgggctcgaagcaattgaagcacagacgctgcggacctgaagcgtccctgcggccttgaccaggttgtacagttggcgtaggaggacggggcgcacgagtcccttgctgactctgctgttgctgcggctgtgggacgcgcaccacgaattgaggtcggggcgcggagcgaggttgctgctgctgttgttgctgctgcgaggaggatccccctggatagggattggtgtagcggaccctttggttagcaccctgctgattgcggaaattcgccaagcgacgcttgtgcgactccagttccttgtgtttggctccaagcggatgctcttgtccaccagacgttgaaaatccggatagtccccggagactagacggacggacagctcagggtccattcctgccaggaacttctcttgcttcttctcatcttcccgcacattctccagagcgtaacgggccaggttgttgaactcgtgcaaatactccatcacggagcgg

SEQ ID NO: 93578 - DNA, 1705 bp, Oryza sativa
agaattgacgatttgtgtgagcaacttaaaggtgctaccggtttctctaaatagatcttcgatcagggatcaacagttaaggattaaagaggaagatatacctaagacagcttttaccactaggtatgggttgtttgaatatactgttatgtctttaggacttaccaatgcccctacaatcttcatgaacttgatgaacaaggtgttcatggaatacctggataagttcgtggttgtctttattgatgacattctcatatattcccgaactaaagaagagcatgaagaacatcttcgtcttgcattagagaagctgcgagaacatcaactgtatgccaagtttagcaagtgtgaattttggttgtctgaagtgaagttccttggacacgtcatctcagcaggaggagttgccgtcgatcctagtaacgtggaattcataaccaactggaaacaaccgaagacagtttctgagattcgcagtttcctaggtctcacaggatattaccggcgattcatagagaatttctccaagattgccaagcccatgacacgactgcttcaaaaagatgtaaagtataagtggtcagaagaatgtgagcagagttttcaagagttgaagaatcgcttaatatcagctcctattttgattttacctgatccaaagaagggtttccaagtgtattgcgatgcatccaaacttgggttaggttgtgttctgatgcaagatgggaaggtggttgcctatgcatctcatcagttacgtccgcatgagaagaactaccctgctcatgatcttgagttagccgcagtggttcatgtgtgaagattggcgtcattatcttttcggtactcgtacagaggtatataccgatcataagagtttaaagtatatctttactcagccagatctgaacatgagacaacggagatggttggaattaattaaggattatgacatgggaattcattatcacccaggaaaggctaatgttgtagcagacgctcttagcaggaaaggctattgcaatactacggaaggacgacagttgccattggagttatgcaaggaatttgaaaggttgaatttaggaattgtcagtagaggtttcgtcgcagccttagaagcaaagcccactctaattgatcaagttagagaggcccaaattaatgaccctgatattcaagaaatcaagaagaatatgagaagaggaaaagctatcggtttcttggaggatgagcaaggaactgtatggttgggtgagagaatctgtgtcccagacaacaaagatttaaatgatgcaattctgaaagaagctcatgatactttatactccattcaccctggtagtactaagatgtacaaggatctcaaggaaagattttggtgggcaagtatgaagcgtgaaatcgcagagtacgtagcagtatgtgatgtttgtcagcgagttaaggcagaacatcagaaacccgccggtttgttgcaacctttgaagattcctgaatggaaatgggaagaaatcggtatggattttatcactggtttacccagaacgtcatcaggccatgattctatttgggtgatagtcacagacttaccaaaagggctcatttcatcccaataaagacaacctatttccgaaagtcggtaaccgaattgtatatggcaaggattgtgtgtttgcatggggtccctaaaaaaatagtg

SEQ ID NO: 93579 - DNA, 733 bp, Oryza sativa
cacggcgctagggcgctacggacgacgagaggcgaaggcgagggtggcgacttttttatgatacaccggggaaccttttaaaggggctaggaggcggcggcaaaggcccacggcggccggcgacgagatggaaagatcggggttcgaaggaaagaggccgatccgaatcgaactcgattccacgaacttccaaaacgaattagccgatgtttccaaaggggaaaaggtagaggagatcccgaggatcatttcccctctatcaatttcaccggaaacggaaaggaacggccgaatttggaaaggaacggcggcggcgcgaaactagggtttcgggcggcggcggccggaggtagacgacaggcctgacaggtgggccccacctgtcagcgagcgcgggcggctacggactgggccggactgggccgaagagagagagaagggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaaaaatagatcttctcttctaggcttttaaaataaattctaaaaattccatttaaacaacaatttatatattttaaattttcagggtg

SEQ ID NO: 93580 - DNA, 714 bp, Oryza sativa
tgtggaattggattcacccctccccctctattcaaaaccctcaaaatggttttatgttgggctcggggtgcatggttttgatagtagccccccggccatataaggaccggtcttcgggcttctgttgcaaagcactaccgtacttccacatgtctagtgggtaaggcttagtttgtggctcagtctggttataaacaaaagtacacggatggagatggacgaagtcgggggtcgatggacattctctagggcaaatgaaggctacacgagctgcggctcggtagtcgagatgtcatggcacagggccggtgtcctgctgctaggggctcagtcctgcctgcctgtcccgggggttccgcccgtaggtggggttgggtcggtactcttgtttatggctaggatgggttggaaactatatcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgtttttaattcttaaaacctgcttaacaactaaaatgtggaatggttggcctgggttggcttgggacgagctgggacccagggtcaggttgccagttcggtctgaatcatcgtaggccttgggttaaggcaggttc

SEQ ID NO: 93581 - DNA, 2227 bp, Oryza sativa
gaagtcgggggtcgatggacattctccagggcaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtttatggctaggatgggttggaaactatatcatgtcttccgtccgtataccgtggtggtatgtggcacgtggtcacacgtgaggaagatgtgtcttgtgggtaaagatgtacacctctgatcagagtataatctattcgaatagccgcgccctcggttatgggcaagccgagcaatgtacccaagttagtgtttttaattcttaaaacttgcttaacaactaaaatgtggaatggttggcctgggttggcttgggacgagctgggacccagggtcaggttgccagttcggtctgaatcatcgtaggccttgggttaaggcaggttcgtgtgggttcacggccttggttaataatattgtattgctctaggaccgtgtttacaaagtagctttgagcaactaagtgacttttaatgctggttactgcaaaccctaaccccctatattataacccccttgtactcccttgcatttattctgcacttatgggtgtgtcttgttaagtacggtggttgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgtgtgtgctgggccttcgccgcccatgtaataaagtaactatttacgcttccgcttgataaactctgaaatgtatcaacttttggtgtaccttgccgcctgggataaggaataatacacgcacgtaaggaacgcccgttgggttatttccggtcgtgacaagttggtatcagagcccccttgaccctaggacgagctttagatcccaagccttagcaatattttcgaaataaaaatcctttcttatttgtgaaaatcctctagtctctctctgtcctgctgcttcatttatcgtcaaaatctgatctttaaaatgttgcttttctcttttgtttttgtttgtagatggccggcagcatcaaccgtcgtggtctggacctgactggtttcgttttggagctgcggggcatgtgcgttgtcttggggtatccgcatggagtggactaccagggcaagcaactcccggagcaggagggtgacgatgcagagccccacgctgcttggaaggtcaccgcagcgatcctcactggctcacccgagaggacttcgttggcagtcactgcgggtggagattccttctccgccgcttgccagaacgccgcactcctcgccatcggcactcttcaccagcgctacccggacgagttgcagcactcgccctaccgctaccaccctcgtcgcggaggagcccgcgactacgccaccttccgggatgctagctcggaggatgacgctaccatcatgcacctggcgcgcatggtggaggcgtacgacgcggcccgtatcgacttccaccagatggtgcgccgcgggttggtcgagaacaacatgaagatcctggagctgcgtcaggagaatctgcagctgaagaaggacctagacgcagtggaggcgcagctgtgtcagctcaagatctcccagggagaggtctgtcgccccaagcgccgtcgcgtctgccgcagcctgaagatcacctcccgcaagagtacctccaggcccgagcttgtccgtcagtccttggcatggacctgtttcgtcgagacccctcgtgccgagcctgcgcccgtggttcctcaggaggagggagcctctggcgttggcagcacagaggatgcgctgctgctcaccttccgccctggcccgtcgcagaagtagacgagcagttagtaggcttgcgcgtgtgttcttctcgtttgtttttctgctagagtcgtgtggggcatggttataccggtgtgtggtataactgtgtcggagcctgtctttattttattggcttaagcaacctgaaccttaacgaacccattttatatcagtaataaattcaagaattatggtagtcgtgggtggttagttttaatagtctgttctctcccttggctggttctgtatgggatatttcagatggtg

SEQ ID NO: 93582 - DNA, 617 bp, Oryza sativa
ggttcttcattcgcatgggaggtttcagctgtacaacaagatgcctgttccaccatttcatggtccaagtactgttcgctgctaccattgccatcttctaggtaaaacaaaggatactgatttggtgtctcttggatgaaacaggacgattttagactcaaatcagtacttgatgctaccatgtgatctccatgaaaatgtgtaggcacattcaaggtggcatatgagtcattgttaactaagcactttgaaagatggtgaggacctctgttctcatcttgattattgcaggaaattttcatgctcgacatctcatcccacaatgccttgccaggaccaaggaaggactcacaacgaaatgcatcattatagctttcatctccaatgtctggccttactccacttccaatcctattcaatgtattcttgaaaaatccataaatttcatcaggaataagttctggttgtaacaagagaacttgaccaagcttctgagcaccatacgaaaaagcagtccgaatacgattaaagctggctgccaaaagtaaaatgtctacataaattagtagaagtgaaataatgtacagaaaacccctactatgtgcaagttcaaccgc

SEQ ID NO: 93583 - DNA, 8199 bp, Oryza sativa
ttttttttccccttcacaccggattgttgccaacttctcttactgcggtttgctaattgctcccaacttgcgaaacagatgtttcacctgcatctccgcatcaccaaagtaaagctcaaaataagttgagcactgagcagcattaggctaagcatgaatcgatgaacaatataattcaactagttgtcaatcgtagtgatggaaaatcgataggcctttgtgttggacaatttgaactacagagcaaatgaaaggcaatggaagaaaatggaaactgcatggagtactatgttaatcaagtcaatggtatagaccttaaacttcacgagctaacaataatatttttatcaagggaaattcgacagataaaaaagtagccagaagaacgaaaacaagaaaagaaggtaacattacatcctgcttcttttttaggaaaaaaaacattttcaaatacaatatttatttcttaccgatacaaattgataatctcggggttacagatttgattagaatatatacttgctataaacaagtaggaactttcttacacctcaagtgataaccttacaagactaacaataaaataaaaatttgatcgcaaaacacagaaatcgcaaaagatgtgctcttcaggtattctacgctagacatggcttcctgcatctatcctcaagcagcagaatctacaacttctgccggtggggactagggagaaaggaatgcatcgaatagcctaggtatttcagtatctgatcccttttgcaacctcaaagaaatgggcaacattttcctcaggagtgcctaccttaatgccatgaccaaggttcaatacatgcccactattaccagctttctgcacagtgtcaaaaatccgcttgcttatgaactcttttgacccaaaaagaacgccagggtcaacattcccttgaaccgctatgttagatcccaatcttttcctcccctcagccatatcaaccgtccagtccaagctaacaacatcaacacctgtcagtggaagcctctccagcagtccaccagatccacttgcatatagtatcagaggcaattcaggatgtgtttctttgacactatccacaatctgcttcagataaggcaagctaaactcctcaaaatcaactgggctgagttctgtagcccatgagtcaaaaatttggacagcttgtgctccgttgtcagcttggtatttaatgtagttagccatggacgtagtaaatttctgtagcaaattatgcagaatctacaataatatagatattaagggcaaatttgcccacatgaacagataaatgaatggaaattaatctaaatatgactcccaaaatttcgatcataccaaacaataagcaagccaacaatgatagtgaacctcatatgcatcacgttaacaaaatataataacgccatttcatcatttgcaatactttatcagacaaagtcaagtataatattttaaaatccatgctaattacctaggactgtcagcaggctgcataaccttttttttttcagggaaggttgattaatattcagtattctatgtgctcacaatcagcgccattataaaagaagcaacaggcagttgtctataatggaagagaactcatgtactctttttatcagcaataggattgtgtcaatacctctggttctgagaaggccattttcttaatctttgaaaagttttttgatgaacctccttcaacacaataggatgccaatgtaaagggagctccaacaaagcccaacacggcagcttcattgttaacctgaggaaggaaacagtgggtgtcactccaatgaaataattagtacacaaaacaaagcacaaaaaatgatcatagattctagttaactatatatttgcagaattctgcaagtttaactaaataacttagtatacaattgtgctcgcaagcaactgttcactttgcatacacaggccaccaaatccaacagtagtacaatgggagtgttttgaaaaagcattgcaacgtcaactgctgatgtcatccctctccagcacaacctccccaaattgtagttcatatctcataaaacaaatatggaagaacactattgccatagaggcatggaatttcatctgtgctatacgatctgcactctccaatctccagaatatatcagccctgaatctaaaagtcagtaatggactaattgtttgatgctaaacaaggatcagaataatttatagtttttcaataaaatgccaaattccaagtaacagtggagccatgaagccaatccaaaagaatggaaatgagcttccaagttttagtgattacatttccatcttttaattaatctaaaatattgacttgacaaactccaagtaatgccattttgagaaaacagcacaaaaaatcagcattataaggtaattgatcaattagagtgtaacagttcaaagattgtaggctgacaaaggaagtgaaaataaatgatcagctactttttatgatgtaatgctctccaataggccatctatttccaatctccgaagttggattctgaaagtcaatactaacctcttcccgcaaaatgtttaaagcctgcccaacatatgggacccactcctctggaacaaattctctgacctcattcacagcagctgctgttctcaagggatcaaatatcactggaccttttcctttcacaatgtcaaaaggtatgttcatcccaggaagcggtgtaaggatatctgagaacaggataacctggcaaaatcaaattaaaaacaacagcatcagaggagatagcatcaataacagagcattagatattataggcaaacaacatctcaaatccacgtaagcttcttttctcattttttttcatgcaaaagcttcttagatagccacaaaagaggaattacaaacaacatacagaaagggccaaaatctgcagcttactccatcgggcttgaaaaccttccatggttgtagagagatctcaacaacaaggtcaacattttctgatctttcacggaatgaaggatgtcgctcgcagagcaattgatagctctgttaaaaaaaagaacggcaagaagttggtaaggaaaaagggtcctgattgtaaggattgttgcaacacgaaaataaagtattacttcaaagaatgggcatttgtcacgattcaaacaactggagcttgctattaagtattgtataccatggaataaactgtttcatgtttaccgatgcctgcattaatgttctattgattcatttgttttctgtaaacttaccccactttaatgaatccgacgactgtacaagaaaaagagaaaattgtgcataagggaggttccagtaataggatagtttatgagtggtcactaagtttgaaaaaaaaatcaggaagttgatgtttgtcaatttctagcagttaccgagatatggtccacatcttacttgaaacgcgataacaattgcaagcaaattggaacatcttcctctagttgcacatttggatgcaaattactctgcaatgcaggagaaaaaaaacgaattagagtaaacctgccttcatgtacctcccggcctgcctcatgagccagaccggcggtctctcgaccttcctccccttgatcgcgctcaccagcagcggctcctccgccgtcccgaccgccgccgtctccgccataacctctgaaaaacacaaccaccccccggaacgagaccatccccaaacccatcaccaatcaaactccgcctcaatctggtgtaaacaaacaaacgatacagtggatttacggcaggcgctgacctccgacggcgctgcagcggacggcgggcggcgggcggcgcgcgcgcgcggacctccccgagaggtaggccggctgcagcgagagcggcgggcacgcggtcgccattgcaggagggatccgagctgcttctgctgctgctgtgctgccggattggggtgggcagcgtctcggcgagagacgacctggcaaagcaaagctaaatggaaatcggaaatggatgggtaggtggggcccacttggatttcaggatcaggtgagccgcggccgcagatgtgcggacgagatcgacgatggttatgggccctcgtggtccccgcatcggcccacgtatggactgggccgaggaatttctcatgcaggccgccaggccggcgaatttctcagaaatttggcaaaaattgagcactttctcgtcggatgcggtcgaatttacagcaaaaggatgaccaaacatgtaaacctacacagcagctttgagttgagcacctactgtacttctgtatcacacaattcagacgaggaaaaaaaaggaaaagaaaagaaaagaaaaggaagtaattaaacacgttgttttgggtgaccatatcatagcacgtagaccatgccgacctcgagcagcgacgccggcgggacgcggagggcgacgtcggggccgcggcagttgcggcggaggaagttgtagccgacgtcgacggcgagcctcttgagcagcgacgacccgggcttgcactgcacgtgggagtggcccaggatgaaggccgtgccggcgtccctcgccgccgccagcgcctccagctcctccgccacctgcttgttgtccgccgcctccgggctcgccacgtggctgtcgatgaagaaccgcacctgcttcgcccgcccgccgccgccgccggggctcccgtcgtcgtcgccgccgccgcttcgtcggcgcgtcgtcgtcgtctccacggacgccgccgacgagtgctggacgctgtcctggatgtcgtagctggcgtggctgctcccgatcacggcgagccgcgtcccccgctcctcctccggttcgtgatcgccgccgccgccgctcgcgtcgctgcaccggtacgaggcgtcgagcttgatgaaggtggcgaggctctcgacgagctccgtctcgaacgagtccacgtcctggtgcacgtcgcggtagccgtagcgcacgatgcaccggtaggagcggtggcccggcgggccgacgcggccgatgaggtagcgctcggcggggaacacgtacggcaccggcaccgacttgacgcagacgaacaccagcacctggtggaacgccgggaggttggtgacgaagcgggagaagttggccggcacgccggaggtgaggtcggtgtagacgaggccgatgccggggacgcgcaccatgccgagcttgtcgccgagggcgagcagccactccagggtgaccttgttgtgcaggtcgaactcgtacttcttgatggtggtgtagtgccacaccagcatgacggccatgaggaagagcgccagcaggatgggcagccacgcgccctccaggaacttgatgagcgacgccgagaagtagagcgcctccacggagccgaagaagaggaggaagcacagcgccagcaccggcggcctgcgccagcacagcatgatcaccagggacgtcaggcaggtggtcaccagcatcactgtgatcacagccaaccctgcaggaaaaacaaacttgtcacagtaatctgataccccttttttttttataataccagtatgtatttctgttctttttctggatgacaatgttgcagtgtgcagtgttgcatttgctctgcagctaaaaagggttgcatgatttgcactgcaaattttctacagctaaaagagtagagacccaaaaaagcaactaaaaatatggtatttttgtgcataacaccctagctgtcaagtgatcaattcagaaatatttcaaaagaattcaaggaatttcagtcaaataattactctagccatcagattgtaaaattttgatgcatgggactttcactagtgctggtattgacaacaagtatgaaactacaaagtaattgtgagtagttttttcttaccagaggcgttccccatgtgctttgtgtctctaaatccaacagtcacagcaatgcagaggatcatgagcaaccaattaatctcagggatatatatttggccatgaattttatcagacgtgtgtacgactttcactcgagggaaacaacttaaggactggctctggttgatgattgagaatgttccgctgatgatcgcttggcttccgaccactgaagctaaaatcgccagtacaagcacaggccatctcaccttatctgtagtttgattataaatatatgcaagtttattttttttccaaaggaatagaatgttctaacattaaagttgttaacactagttccatcatagcttacaagtatcatgatctgcaaagccaagatatacctggaactgcgatgtaaaatccaacttgggagttcgagtaaaagtcatgatgctttgataagtaagccgcttgacccatgtatgccagaatgagagcggggtacactaaagaagtgaaagcaagctgtgataaattaaatgattagcagtttagtgcataaggttactacagaatgtgttatggagagattttcttgcaggatcaccaaattacctggatcgcactatatgagaagtgtccaagatcagcaaacattgcttccgatcctgcatcgtcagtcgagctagatagttagctgaatttcctttattcaacatttcaaaggaaagacaacttattttcttttcaaaaagaaaaaaagaaataaacttctaaattatgtttacattatacaactcagatttttagaagcatattgtagctcacctgtcatgcagagtaaaatcccaccaagtgacatccaaccatattttcttgtcttttttaagaacttgaacatgtaacagggatttagagcttggtagacatgaggattccaatgtataatattataaagtccaagagcactcatacagattagccaggctagaactatcggggcaaagagaaatccaacccgatgagtaccgtaatgctgcagagcaaacaggaatgctaatatgacgcaggtaatcggaataacagcatctgcatgacaaggggatcaattatcagggccaaacaggaggtttgaactggaaaaagaaggccaaatgtcattgcagaataaatagaagtgtttttggcccaacagcaggatactggcttccatttgtcaataagaacttgtgattcagtagttggttttgttatgatctagatgctggccattttatcaacattctcggctcgatattaagttgctgtcagctgagcttaccaaacgggcatagaaaagaccaagtttctaaaatttggtagcttgtggtcactcagtcacctcggtacctcaactatagagactttctatctactaaagcgtggatgtacacagtacaccactcattaaattagagtcattttgaactcgaatttgagggcctcaggtaactgctagaaactagagttgctcatatgttttttaagcttttgcacttcacctaaaaaattagatatgaatatacaagcatgtaacacatacagtttttatgtatataggctcgagaactaagcaaataatgttccttgctttagagtagctacattgtccgtatgaacttaaatgagctgagcctagtgccaacatgcttttctctgccaccaataaacttaatcggggacatgggaactagattaatcctttttgcttgcaatcagtgtcttttgttgatcataaactaaatccaaacatctagcaacgatagggaaaatgactttttacaagaaaataacttggaaacttacattcacggtggtctttggacaaggagaattcaagacctgaaactgccgagaacactgagagatatgaaagattgaggggaaagtgagcatccggtcatcaaatctgtggaaaacagacaagcagccctaagaaaagaagctgaggataccggatatagctggcgtgagaacaccgtccccaatcaccatgcatgtaccaatcaaaaccatgatcagcagggcggtatgcagcttcttgtgcttctcaagccagaccttgatgcaggacttatcggttctctcagaagagcattccaatttgtaagtggaaagctcctcatcagcaatttgcctattaggaagaaggctcacattggcatgccggcaaattagcgagtacagagcaaaagttcctcctgcaagaacgcgaaacttgcaaacttaaacgcttcgcgagcaaagcaagcacaattggtcatgcctacta

SEQ ID NO: 93584 - DNA, 3983 bp, Oryza sativa
tggcgtcgccgtccggttgcagggcggtagcggggcccaccacggccgccgcggcggtgcccccgaacttgttgcggtggtccaacccaaacgggcgcaacttgccttggcggcgccccgcgaaccccccgtcgggaaccggaaccggccccggcgaagaacaaagggcgtaccccggtgtgggtgtcgaagtggatgctgcagcagacgcgggtacccgtggtggtcgactactactcccggtggatggcccgctggcccaccgtggacagcctcgccgccgccacgcaggaggtgagattagggaaagatctctcctccactatcgctggaaaaaaaatgcaatgtttgatgaggtgtgtgcgagagtggtaatgaagttgtggatttgtggttgccgccgattgttgcaggaggtgaacgagatgtgggcggggctcgggtattaccggagggctcgatttctgctcgaggtgagtagcgagttgattgatcacgaattcatggtcgaaacgacggggattgggatgaggttcacttgttcagtgcgttctgtggagcgcccatgaaccgtttgatgttttgtccaaaggagagattttatttggaacccgttttgtgtctgacagaggaggggattattgctactagttcgtgatgtctgctgcattgttttcgctggcaatctcatgtgaagttatcagttcatctggtgaagatttggctagtttgggtggaagaactgacaagaacattagcagaaatgttttttccttgaaagatgaaatgaatgaataagtgcctatgcatctatgtgcatggtgctgagcaactaatagaaatgttgctacggagcaaagcattattctgggcatgcatttttggttcaatttctttatagctcaataatatttaaccttttgttgcaaagtagggagcaaaacaaattgttgaaaaaggcgagttcccttgcacagcatcaacactccgtgaagttcgtggcattggggattacacagcaggagccattgcttccatagccttcaatgaggttgtgctccacataatttatatctgattcaaatcaccatgggtgtgatcctttacatactcacatgattatgtaactttcttgctaatgtaggttgtccctgttgtggacggaaatgttgttcgagttattagcaggttttatgctattcctgataacccaaaggagtcctcaacggtgaagagattctggtaggcaactacctctgttgatcacctataagacataggccatggcttgcactaaaatagcactgagtttggtaattcatctcactgcattatcattattttgcacagcactggcattatactgatatacaatttcaatcgaaatgtgtatgttcatacaaccaatttgcattacaatttacaagctcaatttgcagttctgtgatccccatccaagtgcaaatgttatctgtatatggctgtatttcgaactgtcctatcgtaccactttccatacagctctttctgaattagaagctttatactgaaatagaacttccaaattgtatggcctttgaacatcatttccttgatcacaggcagctcactggtgaactggttgacccttcaaggccaggagacttcaaccaagcaatgatggaactaggagcaacactctgcagcaagacgaagcctggttgctctcagtgccctgtctctagccactgccaagcgctcgcactttccagccaaaatgcttcagtcaaagttacagacttcccacgagtagtcccaaaagccaaaccacggtctgattttgctgctgtctgtgttgttcaaatttcacaaggctttggtgaaggtatagcagaggcagagggcaaagataatctttttctactgatcaagaggccagaagagggccttctcgctgggctctgggagttcccatctgttcttgtgaacgaagggaagactgatacgctgaataggagaaaagagatggacaaatatttgaagcagcttcttagcatagatgttacaaggagatccagtgtgatcctcagggaagatgttggccaacatgttcacattttctcacacattcggctgacgatgtttgttgagctgatgattttgaacctcaaaggtaatcatttgttgtccatactagcagttattcatttctgtttagctacattctattattaatttccacatgtagttgcctaatttctttactgtagatgatggggaggaattatgcaaggagggacaagatagcaccaaactgagattgattaacgaaaatgcagtccagtcgatgggattgacatcaggaatccggaaggtacgcacaaattcaatgtggtaaaaatatttttcctcagagttgattaaatttttagatgaattttcacttcaggtgtacaacatggtcaaggtcttcaaggagaaaaggctgaaagagcagagccaagtgccgacgaggaaaaggagtagacggctgaaataacagtttttcaagagattatagtgcaaatgctagtaatataactgagaagcaactagttaaccactgaatgctgatattatcttgtagtagtatgtaattgtgctgctcactcaatttggcagcatactgctgtattttggcaaagctgaccagaagttggcagtgttatctaaacacctactagcagtcgctgctgaaaaactcaacccattttggttgatcaggctaagttctgaatattcctagtctaatttattgctcagccattttgcacattaagacttgacaaccctttttttaacctgacattaattatatcaagaagatttctataccgctgatatttacatggtactatgatttgattttctgacactacaaattgtgcttcgattatttggcaccttggatccactaagaacctaagatggttttacgtgtcattgttactagcgtaacatgttgtgcattcgcatggctttaacctctctttttattgtttatgtattgttgatagtaagtagctgaaattttttataacaattaacaatgtaaatgaagaattacgttaagcgaagttgaaaagtcaatgatagagtgaaattagcagcttgtttagtgagaatacaaaccgatttttttattacatacatgaaaaacgtgcacgcacacatcactacattcattttttgagaactcacgtcactagcacaccttctaacgtacgctcatcgatgctgttgtgttttcatcgtactcaccattgaatggccccccatattatccctttatattttgttggcatacatcgtgtaggtaaattttaagctaataagtttattttgatcatccaattaaaagtaagaattacgaccaaatgaaatcagcaaaataagttgtattatcccctaaagaaataaagttgtactacatataaataatgttaactaggaatggtgagtgcaatgcagatttgatggcaagcgcaatagtgttgtgttatagtaatatttgttgtaccatttcgcaatttagcattaatatacttttttttggcagaatgacttgaatttaaggttaggcttggttggctggttgtcctttcgacctgtttaacatgttcaataacgcggaggcgtagtgtgctagagtacaacccaacaccccagcggaatgaaccggtgactggaggcgattaccgattagggttgcctctcaagtttctactataattgatttcctctcatccacccatataaaaagcacggtagcatagagataaagaaaatcaaatgagcctaatctgggttaatttatatgttaatctgaatttgaaagatgcgtctatcacttaaataaaagaattatagtagccatttgaatatagtctaccaaagttgtttgtaagtaattttatgcatagtttagtataattttaggtaaactaaaaggtaggatatttaaa

SEQ ID NO: 93585 - DNA, 1316 bp, Oryza sativa
cctaaaatcccttatattatgggacagagggagtacataactagctagcaacgggtttttgtatatggaccataatttctatattactcaacttgtctggcaatcatatatttgtggtcgaatctcaatgtagaattatttatagattttggtgaatataaagatggttttttagtttgttgggcgaaggtaggttggtagtaaccaccaaagaacatataacatgggtgagaaaaaggctaacattcaaaatttcaagtcatatctacacatggttgttttcggtggacagattctttgattcattcattttttaaaagaccaagcccaggtatatatatcaaataaatagtagttgggtatgttaattaacaaatactttaattttgggaaaggtcatgtagcctagtggttacaagagcctagcaccttaggtcctaggttcgactcctcgtgggagcgaattttccagaatttaacggctttgtgctttcagtggtagatgacatacccgtcgacagtgaggtgcttaattcgtcaatctccaacatggatttgccggcttagtcttcgaagatgctcatagggtagggtttgcgtgcgtgcgatcataggggtgagtgtgcgtgcattgtgagtatctacgttgtactgtgtaattctaaaaaaaatacttcaattctaaaatttaagatgtattggctttttaaatggcaaatttatattttaaccattgaatttttctataacatattattagctactaatgaatcaatatcatataaaaatattttcaaatacgaatctgatgataactatgtgcatgacactaaagactgatatttttagtttaattattagtaaaaggtttcaaataaatattgactttactgaccaaggacacctcataaatttagccatgcatatagtccggaccaagttatacatgatagtttagattaaactagggttcgtgttagctagataaaataattattaatttagaatatcagattttattgtattatgacaaatatttaaaagagatcgactagctaagtataatttgggatttgccggctcagtcttcgaagatacttagaggggtagggtttgcgtgcgtgcgatcataagggtgagtatgcgtgtgttgtgagtatctgcgtgtactgtgtaattctaaaaaatactttaattctaaaatttaagatgtattggctttttaaatggcaaatttatatcttaaccattgaatttttctataacatattattagctactaacgaatcaatatcatgtaaaaatattttcaaata

SEQ ID NO: 93586 - DNA, 4636 bp, Oryza sativa
tttgcgtgcgtgcgtcataagggtgagtgtgcgtatgttatgagtttctgcggtttactgtgtaattctaaaaaaaatacttcaaatctaaaatttaagatgtattggctttttaaatggcaaatttatatcttaaccattgaatttttctataacatattattagctactaacgaatcaatatcatgtaaaaatattttcaaatacgaatctgatgatacctacgtgcatgacactaaagactgatatttttagtttaattattagtaaaatgtttcaaattaatattgactttactgacaaggacgcctcataaatctagccatgtatatagtccggaccaagttatacatgatagtttagattaaattaagagttcgtgttgttaggaaacgataggcgaacaaacgagaaaaaacaatagatcaatcataaaagacacgagatttaacgtggaaaaccctcccaaaacaagagagaaaaaaccacgggcgccagccagcaaaatatcttcactatatctgaggtgaggttacatcgccgcacggcggcttacaagaggtatatatagggtggaaccctaaaagggatgacgagaagatggcctttattaagtgcaaatgaatttggatcacaactcaacaaactccaccttgagacaaattccttcttgtagcatgaattaatccttcaccctgaatacaacaaagacaaaaaaacactttcggcgccaaatagcctctcgggctaaaccactataccaactaagcttgagcaaagctcaaacttagcaacaggaacatgctttgtcatcatattagcaggattatcatgagtacttatcttgcatacctttagcttaccttgcgcgactacatcgcgaacataatggtacttgatatcaatgtgctttgtcctctcatgaaacatcttatctttggtgaggcatatagcactttgactgtcacaaaacaagttaatgcaagaatcaactccacaaagctcagcaaacaatcctttcaaccaaactgattctttacatgcttcagcaatagccatgtattctgcttcagtggtagactgggcaacaacagactgcaatgttgccttccaactcacagcacaactcccaatggtaaacacataacctatgagtgaccttctcttatccaaatctgcagcaaaatcagaatccacatatccaacaagccccttatcagtcctgccaaacttcaagcaagcatcagctgtgcctctgaggtacctgaaaatccactgaatagctttccagtgttctttaccaggattagccaggtatctactaaccaaactcatagcatgagataaatctggacaggagcaaaccatggcatacatcaaagaaccaacagcacagaatatggaagtctagacatgtattctacatcctcatcagtactagcacattgtaaagctgataatttaaaatgaggtgcaataggagtactaacaggctttgcatcatgcatgttaaaacgctgaagaaccttcttaatgtagctttgctgactaagaaataacaaaccagaatttctgtctctagtgatttccatacctagaattttcttagtagcaccaagatccttcatatcaaactcactactcaattgtttcttcaatgtagtgatttgttccttgctcttggcagcaatcagcatatcatcaacatgtaacagcaagtatataggtgatccattaataaatttaatatacacacagctatcaaattcagacctcttaaagccatgtgacaacataaatgaatcaaaccttttataccattgacgaggagactgtttcaaaccatccaaagatcttttcaacttgcaaacataatcctccttaccaggtacaatgaacccttctggctggtccatgtatatcttcacctcaagctctccatgtaaaaatgttgtcttcacatctaactgctcaagctcaagatcatgcatagcaacaatactgaagaatgtgcgaattgaactatgctttacaactggagagaacacatcattataatcaacaccagcaatttgactgaaaccttttgctactaacgttgccttaaacctcggaggctcgctaggagataaaccctcctttctcttgaagatccatttacaacgaacaggcttcttctgttttggcaagtgcacaagctcccatgtgccattcttctcaagaggctgcatctccccctgcatagctgagatccacttctcacgatctccagaaacaacagcttcagtgtatgtggctagctcaagagtattctccacctgttcagcacaactaaaagcataataaactatatcacattcctcaataaggcggactagagctccacaactcctctttgttctgcgatgggcaataggttcatcttgtggctgcaaaacaagaggtgagtgctgaacaatatcattaacatcattaccaacaatttcagtttcctgatcatccatgtgctccacctgcacgctaacatattactgctcctcatctgaaccacctggtatgacatctgtgggcaagctgtcattaaacataacagattcattgaaaacaacactcctgctcatgaaggtcttgttggtttcaggattccataacttatatccttttactcctgaaccataaccaagaaatagacacttaatagctctaggctctaattttccattatcaacatgagcataagcagtgcatccaaaaactctcaactgtgaataatcagcaggcataccagaccatacctcaatgggagttttcttattaagtgggatagaaggcgacttgttgatcaagtagcaggcggtgttagcagcctctgcccaaaaacgcttgttcatgcgagcgttggacagcatgcaacgagccttggagatgatggttctgttcatgcgctcagctacaccattctgctgtggagtgtacgggatggtgtgatgcctaacgatgccttccttctgcagtaatcatcaaaagcatccgaacaaaattcaccaccattgtcagtgcgaagtacttttacctccttttcagtttgcctttctatcataactttccactccttaaaagtagcaaatgtatcatctttatgtttcaggaaataaggccacacttttgtagagtaatcatcaataatggtaagcatataacgagcaccaccaagagagggcttacgagaaggcccccacaaatcagcatgtacataatcaagtatacctttggtgcgatgaactgaggtattgaattttaccctcttgtgcttaccaaaaacacagtgctcacagaacttcatgttaccctgagtgtagccatccagcaggttccttttcatcaattctgccataccaagttcactcatatgtccaagacgcatgtgccacaggttagtcttactaggttcatctttagaaacagcagcagcggtaacagaaccatgtaatgtacttcctctaaggacatataagtttgcagaattcatatcactaatcatgtaaacaagagaacctttcgatacctttacaactccacctaaaccggagtatttgtatccttctgcatcaagtgtgctgagagagatgagatttctcgccatccctggtatgtatctcacatctttcagtgtgcgtgtcatgccatcatgagtcttgatctgaacggagccaatgcccacgatctcatgtgggttatcatctcccatgcgcacaacatctccattctgcacagacttgtaagaactaaaccaatctctgttaatgcagatatgaaacgaacatgcagtatcaagtatccattcatcatgactagcaacacaaccagcaaaaacaacaagacaatctcctgaatcagagttttcagcactggtaacaacagaggccttaccatcagatttccttttctccttattctgcaacttccaacattcttcaatgaagtgatttttctttttgcaatacttacagaactttttacctctggacttagaacggcctctactctaactcttgtcacgatcattgctgtcgttgtaggttctctgctcagatctgcctctgacctgcaatgcttcgcccttagaggacgacggatcagactgaaccatacctttcatcttctccctattttggagcgcctcataaacttccgctagggttagttcatcacggcttaacagtatggtgtcacgaaaatttgcatatgaactaggcagtgagcataacagtaaaagacctaaatcttcatcatcaaactgtacctccatcgacactaggtcggcaacgatctccttgaagaccgatatgtggttcaacacagaaccactctcctgcaacttgtgtgagaataacttcatcttgatatgcatcttactggttagatctttagacatgcagatcgattccagtttgagccaaagttcttcagcagtcttttcctgcaacacttcttgcaaaatatcattagatagaagaagttggatcagcgacagagccttacgatctttctgcttctcctcagcggtccactcagtcgttttcttcttcccgaggctttccggcgcctcatcaagatccgaagtttgcgccagaac

SEQ ID NO: 93587 - DNA, 3327 bp, Oryza sativa
tgctgtttgtgttgttcaaatcaatgataatctctttctattgatcaaaaaggcaaaaaaaggccctgttcgttggcttttggaagtccccatttgtttttgtgaccaaaaaaaaaactgatgtgctcaatagaagaaaagaaatggccaaatatttgaagcaggtccttagcataaatgttaaaaggagatccagtgtgatcctcaggtaagatgttggccaacatgttcacattttctctcacattcgcctgacgatgtttgttgagctgatgattttgaacctcaaaggtaatcatttgttgtccatactagcagttattcatttttgtttagctacactctattattcattcaggcaaaattgcctaatttcttcactgtagatgatggggataaattatgcatggagggacaagataacagcaaactgagattcattgacgaaaatgcagtcgactcaataggattgatatcagggatccggaaggtacgcacaaattcaatgtggtaaaaatatttcctcagagtttggttaaaattgtaagatgaatgctcacttcaggtgtacaacatggtcaaggccttcaaggagaagaggccgaaagagcagagccaagtaccatcgaggaaaaggagtagacggctgaagtagcaaatcttcagaactaaatgcagaagtaacataactgcagaagcaactagtcaataactgaatgctgatattatcttgtaactgtactgtgtatttgtgctgctcactcaactaaattggccgcatattgctgcattttggcaaagctgaccgtgagttagtagtttatcttaggtggaggggagcacgggaaaaaaagagaagggagaaaaaaaaatccatatcatcgtctacgtggcgtgtcacgtagataagaccacggtcaaacggggatttagatcggaatgattcaataaaccaaatttaggggtcctgatgtatgctttgcaagttcgtggaactaagtgaaatctcataacaagtttaaggatcgctggtgtattttactctttaactgaacccctggtagtcactgctgaaaaagtaaacccattttcgttcatgaatatccggttcctcgtccaatttactcggccatttttgcacattaagacttgacaactttttttaacctgacatgatatgaagaaaattatatccattacgctgatacttacatggtactaagatttgatttttattttttacaatacaaactgtgctttgattatttgacatcccaggttgtgtttggatatacaagttcccatcttctactttttggttttgtgtgcgcatttcctaaattgctactccctctgtcccaaaatataggtatttttatacatcgatacggtcttcgagatgctactttaatcaataatatctataaaagcaagatttttaaataaaaagagttgcatattataattatttgttcaatgataaatctagtaacatcaaatttacatgattgatcttttttatttctttgctattaatagtcaaaattttaaaattttgacttgataaaatgcttatattttaggagggagggagtaaacgatgtgtttttttttaaaaaaaaatctatatgaaagctattttggaaaattatattaatccagttttcatgtagaaggaataagtcaaaaaccactaggttcgaacacaccctagaaactaagatgttttcacgtgtcatgagtgtagatcatcgaattttacccaaattcgaataacaataccaccaaattttacatctccgttgtgtaccacaaggtggacgcaattcaacgtcaaagggagagactaggcaaacaaattgtccccaccagccgggaactcccacacaccgagggtccgtggccaccgtggtgcgcgcgccgccgccggcgatcggagatcggcgaccggcgaccgatgcgggggaggggaaggaacgtcgagagggacgtactcgtcgccgccaccacgcagcaggtaatttggggggagttgaggtgagcgagagatgtgtgcgaccatgacttggcaccatgacgcgtgtatgtgaccctctcgtttgctgcttgctgcaggtggggaatgagatgcgggctgcgcttggatacgacctgatgaccagagaaatcgttcctagaggtgtgttagtaggggagattgatcggttgtgctcaggatgctggggtttggtaattagtatccattctacactaattttgctttggcaaatcttcactgtgactgtgcaggcaacctgttcgacgttttgcctacgagagccttcagagtacgatccagtgtttacacatgaatgctatcctgcgatgtgatgatgaccaaagctaatcttcggaacagctagggtcagtggctagtactgatccttttttttatgattcttttgaaaattaactggctcattcatgatcgtaagtgatggttactctgatatggctgttatggtgatattagcagcaagagtgtgcaaaaacatgctaactactcaaagtgcataccacccaaggctgatgttggtatatgttaacatcagtacatcacccaaaccactataaaatgtaacaaatgacaaaatacagttctgtttgtttccctaccaatgttttcagtgatttatggcgagaaatttggtaatgaaatacccagtcatacatatatcctttatgagaatgattttttcaagacatgattacaagaaccaaatgcactagataactgtcaattacagatcaattttatttagtatggtgtctgcattattgttctaatccaaaagttcataacttaaattacaaaaactggctgtctcaatactgctatagttgtatacatacacaaagtaccctcagtgttgctttctcatctggcttccccacacaatcaggatcatcattgcaaaagaaatgaaaaatcccgatgcagtgaagaggagaagtacaacatctatggatttctctaaagtgtatggcatcgcaattggctcttttgggttgttacattgtctagataacggtggtccacacaaacctgtgtttccaagaaaagagttgttggaaaatgtggaaaactgatatgagtttggaattcttccaaccagcatgttgtatgacaaattcagtgttgaaaggaagttgagtgatgctaactcctcggggatctccccagagaactcattcgaggagaggtccagtgactcaagtggattcaatctgccaaactgagttggaattgatcctgtaagggcattgtgagacctgttgagcccatga

SEQ ID NO: 93588 - DNA, 9310 bp, Oryza sativa
ttagccagcaccaccagctccctttcatcgcatgcccagttttagcattgtctgtttattaatatttatttttgcaccctctccaaagaaaattatgtttttgattgcttcatgacggttgaattctgttttcattccgacacagatgatctaattgttgatccaaggaattttgagtggctgagagaagctaattgtccagttgtaagtgttagcactttattgttgtgcagaagcagaactgcgtaatctacctgatgacttctgtgttgatttgtcctgcttgcttctgattgatgaaattggctgatggaataatatttggaaaaatcaacctaggattttacaaggaacctatgtttagtagttttattattctcttttcagtattcaccagaattccttgaggaatgtatgtttggattctgtacattcctaacaccaacagaattcaaggaataatagaaaaaaaaaaggaaacatgggacataacaggcaatcgaagatgcagacttcttcaattgagtagatttttgttatctttttcatcagaaagtaactgcatttctatcttattatgctttgtgaaatatgtttaaatttgtcatacattcatgtgttattctcatactaaaccaattttgtcatgcatttattttttttaattctcttaacccaataatttcatagacctttgaattagctttatcaactatggtatagtacgtggaccattgatggatattacatttcaggtagctgatgtaacgcatgctctacaacagcctgctggaaaaaaggtatatttaccaattgcaatgcacttctgctggtttaggcaagattcctagtttaatggccgactttggtgctactcaaatcctatattgaccaacaaaggaatcaacattatggggatgtccatattttaacaactatctatagcttatatctgatgtaaatttgcaacaactcgtgttcatagttttttgaacaccatgttaccggcccttcctcaaatatctatgtatttgtgcaacgtagacggttgtgaaattgtgcatatttggcttcttttgtaagcttgatggtggaggtgttgcatgtgggggcttacgagaactaataccatgcatcgcaaggacttctgttgctgtctcagttgatggtattttcatggaggtaaaacctaacaggaagctataatgttgccttttgtttcttacattgctttcccagtgacactccacaaataatgatgatattgtactcttgggacttaatttgatatataatcctacaacaggtacatgatgatcccttgaacgcaccttgtgatggcccaactcaatgggtaaacttctacatgtttgtcaagaaagttcatccatgcaatattttctttagtatgttgcaacattcacgctgatcttggtacgctcacttgttataatattgtctattgtgtttttgttagccactgcgcaatttggaggagctattataggagctgattgcaattgctgtaagttacaccgacattcaaattttttcgaacacaaatatttaggctaaaggtctttattgttctttctttgaagcgagtcaccaagggaaagaagccactcaagatcgatctcacccccttcaaagaataatctggtccagttggtaggaaataatgggcacacttgcttggttgatagttttgaccagcatatatttacctgtttggatgaattgctcgttgtatgtcatacattcgtttatcggtgactgttgtctgtattgtactgcctatacaataaagatcattgttttacccaaaatatgcttccctgcttttacatatatactagaaaaatgcacgtccattacaacgggaaaaagtgtatgataaagtacagtagatggctaactttcatttgagcaagttgggccgaggaaattggcaacagcaacagactatctggtcaatttatagccgctagctcgacttcatacaatatgatttcttgagtatatgtactccaagactggtatttatagcaagttcagcagtattccttaagtaggagggcgactcgtgtcttcatcatgatgctatcgtgcagtttcctacactaaaaaactgtttttacaagcagctacagcctcatttttagcttatgcttatgcttataagctaaaatttaaattttcaaccttaaatttagagttgattttggtgctttttcatcgtagtttatttttcagcctttgcttttagatcgctaataacatgtatataaaagttttatttacaaattattttccatttttaaatatgccgtttcgcttattacgatggagtccttaacatatttttacaaacggtcaaatgctccgcctaccatttaaggtttacaaaaatcgacaattttcacaggaaggcctatgatagagatggaaatgggatggagaacctgggagagagggggctgagggagaagaggagataaggatttagtcacagggctctccaaatttcaaaatttagtagcaccttcacattttgtaggcaaatcatttaaggtgccatctccaaaaatcgatttttacaagcaagatcttaaggcttctttttctccctcggtgcgccacccgaaactccaaatcccccccccccccccactaaatattgcggccatctctgccaccataccgctggggggactagagcatcgtcctcatcaccggtggcaccacgtactccactgcctccacccaagatgcatcgcaaggtagctgggggattggagctccatcctcatcgccggcacccccacgctctccagccgctgctgttagcttctcggctccaagctccaagctccgctctccggccaccgctgccgaacgggcgtcgcgaggccatgccattgtcgctcgcccccgcttcagagaggaaggggaagagagaagtgggatgtgccactgacaattgggatccatcacttttaaatttatttttggtaactgaaatgccacgtaggatcaaaccgccatcaaaaccgctttagggatgtaaattgatctgattttaatagtttggatactctatatccggtactgtgatttaagaatgaaactcaaactcaacatgagaaacctagaatgaacttattcccagatttaatgctagagtatttccagtcctagcaatgcgaggcaaggtagttatggaattttttttatttttaatttttttattaaaatatttacaaaagtaattttgtgtttcaaaattttacaaaactagtcgcctgccgccctctgggagggcgatgtttaaaaatcgccctcccagagggcgattttcgtgacgtggctaaccaccggtagcgtacgtctaacggccggctacagggggcctgccttttgcaggcggcccccttgccgcccttacggagggcggtttagtactgtgcggagggccgcctgcaaaagggcggcgaggaccctggttttttttgcaggcggcccccttgccgcccttacggagggcggtttagtactgtgcggggggccgctgcaaaaggcggcgaggaccctgtttttttgcaggcggccccattgccgcccttacggagggcggtttggtactgtgctggttgccgccagctttaagagcagcccccaggtgtttagttcggtgcatttagaaaatttagtaaatcatcacttctaaaattgtgaaacaagaaaaaacattattagaattgaattgtacgttgtttcggcggtttggagcccaacaaggggtgtttttacaccgaaatatttaattgttactgtaaaaactacataaatcattgtttcaaagtcaaaggaggaatagtttcaaactacataaatctaactattttgcaattaaaattttaagaaataggtattttacataaacctgatttttagcacttaaaattaggtaaagtatcgttttgaaacgaacaaagtacgtgcattttgacaaaattttaataatttaatttttcatataaattggagggctatgagggggtttgttacctataaattgtaagttacgcataattctcgtgtatgttgaatcatgtacacaattgaaggtggaagttataaaaatataagcaggtacatataaattataaggatacaacgtatcatggcgtcaaagaaactgtagaaatcggaacgatacagtcacattaaattataattcatgacgcatacaacagcacaacatagtaattaaacattataatgacaagatagcatggataaaagatacaaatttgtcggtcctaacaaatcgagcctgagcttatctaccgaccccttccgcgtcgttcaacatgtattgcattttgatggtccttctctcactggtactctacctgtgtttcagactcagttatcttttggccatcatatgtaggattgacattgtcgatccataaagtgaatgcgcacctccttggattgccctgagaaacaaacatagttcagataggatagtaataataagcagattctacttaaatttggaatttgttatacatacaacgaaattgtcgtctacattggggcagacaatgtagccacctggcaattgtttgttctgcaaacgaggtagccacctggcagcgatctctacaaccacactttggatgctccgaccatttaggtaaacctaatagattgttcctccagtctaagcttgcaatttgtacctgacgttcgtactccatccatgcctgaatgaattgcgtggtcgtctcaggttgcgttatcgtttgaccaatggaagtaactctgaccgtatcgatccattgtatgaattgacatttcctaacctcctcctatttgaaaatttgtgtaaatagaggtaagtgcatgaaagtagtgattagtggtacccaaaaaaaaagatacttacgacgaaatcatcgtcgtcaatgttaggacacacgaagcatctttgtcctcgagttcgttgtcttacggaccttatcacctgacaacggtcaccacaacgacactctggatgttcccgccatgtggggagtcttagggggtttacctgccattctaaagcttctgcagcaatccgacgttcatgctcatccttccgcctgaggtagtccgatcttgattcactacgtgcatatgaacgtgttccgtcgttttgtgggttctctgtatctacccactcaatgtagttgcacaatttacggtatgtctgcgtaagatgttatgatggagtagaaatctgttagcttttgatgtgttcagtatagttaattgaacttgtaacgaatgaatgatacctgatcaaggtttgcacattggaagaatctcctgccccgagtttctaccatgaggcttgacttaagtatgcatcgatccccacaagtgcataacggccggtcacaccatggtggaaacctaccggcgaaaggatcgcttcgccagttgagacgctcaagaaatggagcttccattctctctagatgtgtgggaagatgaaagatgatatgaagagcttgtattcggcttgtctattatatagggccgcaactagtgctataactagacttaattttgttcatctggcgcacttgatgtgacaacacgcgcacgcgtgagcatcattcactttatctccgagaacagggccgaaagatgatagtgacaactcgaactaccaaggtatatgtgtactgtggtctgctgcgctacctaaatgagccaatcttcacgcgccgaaagtttgttgtcgtatgcgtaagtagttttaatatgcagtgtattgatgacacgagcacatgtgggcagtaattaattcacgtgcggaatctatggtgcaaagttgatcctgacaactcgacgaaacgctttgtctataatggactggaccatcacgcgccgaaagttaggcttcgtatgcatggaatagttgtagcagtggacatgtggaaggaacaaaatatcagagcgtcaaggcaatggtaccttagtactaacagcaaaagtaatactggtctacacagcaaaagtaagccaaaagaaaagtgcacacaaccactcaataggtggaccactactgccgaggactcttaccccggtccctcctgccctgcgccctaacgtgtccctgggaatacgtcagacggtccggtggtacggcacggcctgctcgaccctcctgcactggtgtgaccagtggctgctcctgggtgtgcgcctccagagctccgccaagctgtgaggacccaagtatctcgtggtctggcgccccgtgaaagtcgtcgtcgtagaaccgggcagtaggacctgtgccaccggcgtgtgaggaagaggctccactagcaaagatccctcgcggctgcgtgtcaggacgagggatcggcaatctctgtgacaaactgctgcctccgacaaagacgccggaaggcagacggggacctgcgcgtaacgtatttagttaggacgtagtcatgttaccgagaataaatcatatatacttgaactaacctctgggcagagcagtaccgtgcgaagaaccagttgtaggtcgcacaactccggtactaggggcgcgtggacgtggtggtactggaccaggtggaggtaccgcgtccatggcgctgcgacaagagaagacgcggatgacagcgcgtatcttctcctgcatccggtcgaaggtaatcctctgctcagcatcactcaagtgtagcccggcgtccaacctcactgttatcgaggtaatatcggcgttcacagctcgtgccgcgtcggcctattcaagacataagatagcatgtcagtaggaaaataattgaaggacctgagtagaaacaattgccagaagtgagtagaagtttgacatacccccatgaagtagtctcggtcacggtgcgtggggtactcatccctgacagtggcaagtcgtggctgtggtgcggctggagtgaaggtcacacggccacgagtgcgaggtaagtaccaccgtaggtagtccctgtaggtgtcctctgagtgtggaacgaacgcgtgtagtgcagtgggtggtgggagatctggacggcgcatcacgggcaaaaagcgctcagtgatatcctcctgccagccagcaccaccgtctactggaccaactgcggctcctgccagtggtagtccgagtaggtacgacacgtcctgtagtgtcggagccatctctccacagggaagatggaacgtgtgcgtctcaggcctccagcgatctgccagagtggcaaggagtgaccggtctgcatcccaccgcctcgcagggtctctctcgtctgcccctgcctcaacaagcctacaaagcggtaggaggcctgccacacgcaacctgcataatggaaagtcaaaaattagtacatcaaattgaaagtcgactcaaatgtgcttaaaaaaaattgaaaataggcgtaccacggaacgtgccgcgggtcgacacgcaacagctggtgtgaaggacgtggacggaaggtgccgagctgcgcaccctgtaccgcagagaggtacgagcggtggctcctgtcaatgccacgactcaagagctcaggtgtgtcgtccgccatagctgcatcaaaaataattatcagaaccataataaatataaataacaacaattcaatgtgcaattacttaaacatatgagtaattaatgatagtataaacttcgatgtcgcatgctacagagattataacaacagtacaatgctatttcacattggtcacaacacaacaacatattgtttaacgattacaacaaaattcattgaaattacaacatatgagtacttggtacgagaacattaggatacaatactcaataattcgcaatacatgactactaatttcatcacattacatgatataaatacttagtctcagtacttattaggatacaatactgaatagttcgcaatacatgactactaatttcatcacattacatgactgaaatacttagtctcagtactaattaggatacaatagtgctcgagttcatggcctaacaatattagaccatcgcatcgcctgccgcacgaggacgcctgggacgtgctcgtctggttgttgttccttccccagctggtcttcttccatcacttgcttctccagatggaccaacatcctcgacgcttggaccctgtgcagtcttcgggcatttcttgtaagtatggccgcgttggtcacacttgctgcagcgtagagtcctcccaccagcttccaactcgtccatgtcatttttgatgcgtctagtctgacgccgcccctttttcacccttaacttcgatggatcaggaatgaaaaaaacttgggacctctgagttgtgtaagatcctgagatcccgaacccatatatctcctcactccaagtatgaaagattgcttccttcctgaaataaggtgacacgtacacatcgggacgtatgccgcaatcacctgctgctgcaagtacgtgagagcaaggcagatgtcgaagcttaggcttcatacaggtgcaactgcatcccccatcagccttcaatacacattcgtgcacaacatgcttacgcatgattccatgcctgctcctatcaacacacattatttcataccgatgaacttttgttccttgaggcacaactctatgcctctgtgcctttgcaattttatcttccatgtacttagtcactacgctgccaaatattatcttgttatctaccattgagggaccaattttcttgtatcgatccctgaagtaggcctgtgtgccgtgaaggataaattcgactataccaaccaacggtagtccttgcactcctcgcattacccagttgtaaacctcggctagattagttgtcattatgccatatcgagaactattggtgtcgaacaatagagaccacttctcctttggttcattctcaatccaatgactgaactttcggatagatgatcctgacctccttctcattgtgggtgggtcatcatgtagtgcaccaagaggtactggaggctcgtcaccttcagcttgtggtcgacgagattgctcgtcagtttgcttgcttgtcaactcatccaacttattccacaactcattaaattttttctcttgattctgtgaacagagcctcttaaaaagatccataagatgcttgttcttgaattgcttgtaaaaatagcacccatgtgacgcatgcaccaccgactccgaacatcgggccacttagctggaattcccttctcctcccaaccattctgcaagtag

SEQ ID NO: 93589 - DNA, 509 bp, Oryza sativa
tgacgacgcttgggttctgtttgatgccatgccagagaggaatgttgtttcttggaatgccatgatctctgggtatgcacgaaaccacaggattgaggaagcacttgatttgttcacgaagatgcctattagggatgttgcttcttggaacattatgatcactggctttatccagaacaaagacttgaagagtgcacggcaactttttgatgagatgcctaaaaggaatgtgatcacttggaccaccatgatgaatggttacttacaatgcatgcagagtgaaatggcactaaaattatttactgtatgcttgttcaaggaatccaaccaaatcaagtgacatttctaggttctcttgatgcgtgcagcaaccttgctgcactctgtgaagggcagcaggttcatcagatgatatgcaaaacaccatctcagtttgatacttttgtggaatccactctaatgaacttatatgccaagtgtggtgaaattaggctggcaagaaatgtgtt

SEQ ID NO: 93590 - DNA, 6465 bp, Oryza sativa
agtgggaggggatggatctcacctagcatgctccgctagcgcccctcaccccacgcttggtggttgtgagaggaagggggagaaagagagatcgattcatggatatcctgtctctccatccctccacaatcttggttctcactctcacagtagagcggaggaggaggtgaggatgagaaaggaaagaagagtcgagccgatagctgagtaggtcgtgccgtgccaggctggcatgtcatgccgaggaagaggccgaggatgggcctggccatcggtcagagggcccttttgactaactatagtctataggtgagcacacgtgcccgtaatgaaactcgtccatccctaggctgcaggatccgaccgatttagcctgagctgcatatccggattctacactgaaaatatttcttaggtgatgatcatatctcacactaaccctttaaccaaacactctaaaaatagtggcggtcatatcatattcaggtatatcccatcaagtcatcaaccaaacaaaccttatgtttatcaactcagtagttatatgtgcacaggatatgctactttataatgacgttaaatttattaacccttcttttaaaatagtgagtccataaatttattataatgacacatgacggtataagaacgttcatataaaaaattaatgaacttttagtatataatagatctcacattaaactagagggtacgataaatcatattttgctacctcatcataatcattttctttacaaagcaaccattaaattctttttttaagtactgctacgtactactagtttttttttttttttgaaaacacaagtttattatatagattaaagacagagttcacggggaacaagttcccctatacatcgccataactgatacaacttgcagagcaaaaccaacctttcaaaaggtaaagccaaattgtctaaggggacaaactttccaaataaaccaaacagcagtaagagtgtgcactccgcttgacagaccggtgaccctttagctgcctccacaagcctctactaagagtgtgcactccgcttaatagaccggtgaccccttcagctgcctccacaagaacggtacaattcgagattgattgttgagtcaaagattttggttaagcttcactggactcaacatcgattttccaaggagttctccatcaaatctgaggaatgctaactgcaaacctgtcaacaagaatcggacaggaggtctgcactcaacccgaccgaagcactcgacatggttactgctgcagataaaattagaagtcccttaagaccaaccaggcctaatcatgagacaattaggacaatggcgatagaactgctgccttgctacatcccaccagaaccttgcggaaggaaatgatgactgccaagctagagtaagaattaatgaaaggcatctgtaaaaatggtttgcaatacaagaatgacaagtatttatttgctttcataaaataaatggtaacgtgagggccggggagtatttataaacgttagactacgtgtgttcaattatattagatttcagttttttcttcataaaattaattaaggagagtacaattagtacaaaggaaagattaaaatattttactttgtcatgaagaataattgaactcgagaggacctagctgccacttgcatgatgtcttgtcccctgtctattagggtgtgaccggtgatctacctgccctgatcagtgatcctagatccgtacgtagctcgctctttcgtcctataaaaacccaggagcctggctgccaagattaaaccctatctcgcggtgagctcgatacgacccgtctccactctagctagtgtcgtgattaaatttagttagctatggcagctggtggtgcggcgccgctcaggatcaccggtggacggcagctggtggtgctcctcctcctgctgataatcacgctgttcgtcttgacgcagcccatgatcgccatggcctccgccgcgagggctttgggagaaaacgacggcaaccctgactgtgtcatccgtgaccaccctgctggcgaaaatggaataccaccatgcccgccgcgtccctaataaacctgtcggtgatcgatcagctgtctcagcgatttaattagtattgtaatcgtcgtgcgtacgtctacagcagtcagctgatggtaaaaccaaataaattttagtgctagctagctagctcctctccggagaactacgatagatgccgtacgtatatatgcgtatgtttggatgtcatgcatgctttgacctctgcatggcctattccgacatttgctacggtacgtgcgtcctacagctagcagccggctatatatgtgtgtcagtgtgtgtaacaacgtataactgtgccttttatatttcaaataagtgtctcattcacatgatgctgagacagtagttacttctgaatgtatggctctttcttattactatatcacagtaccaataaaaagcaaaaaaaaaaagtattctattaccttttctttttgattacacacgcgcacaaaccactaaatgacaatactacactcacacctgtgcaacactactaggaaaaacgtttttgcaggcggccaaaaacagtcttctcaagcggacggccattccgcctataggcaaaagtcttgcgaaaatcacaggcggccgactggtccacctaggggggaagaaacctaggaagaccattttcctaggcggactgaagcacgatgcgtcacctgggaaaacaggaaggagccgccgtctaagaaaatacgcgccaaaatttaaaatttcccaccaaatttattaataatattttttaattaactaatgcataaataatattaggaactaacaaacatttaatactgacaaacaaacatatattgcattagtgaaaagtatcgtcaatatgttacaatattttttacatttgtcacttcaagtagatcaagaaacaaatgtaatgatcactacatagtaacgatggtgcagttagtcacggatgaaataacacagatgtgtacaaagaaatctattggacttacctaaagttgtatgtggccattatgattcttttatgttgaaatttcaagaaggctcgtccaatgtactgtgtgacagtaagtattttagtcttgtgcaagcccttcttgtattccgctatctctttaggcattttgtccttgagctgctcagagtttggtcatagcgtcacgatatgctgtgtctaatagatccttgttggatccagatatccgataggctccactgtcttctcagcatccatgtattgcatcgtataaaacaagttcgttaataataatcgcatgcttctgtattctattgatttatttgtataataaatgcgcgttcatactcacaggcaccatgcaccgaaaaagtttacatccatctttttccgatgatagatggcgtggagatcagagaaatctaaccacaaggaacctttgttggccatgaaagcatcaggcggtaatcgaacagttaaagacattaggcctttcttgctggcgtctatgtaccatttacgtagctttctcatctcccatggaccctcatcaagtgcataaatctggccaaagtgcttttcaaacttttccaaacaatcaacagttgcaaagaattatgggccggcaagttcagcggccttcttctcatcttctctttgcttggcacattttttaccctctctaaaagcgaataccatccacttctccttttgatcatccttagacttggagttgtgacttctgagcactttaggcacttcagacttgtcggtggcattgtcatcgaccggggttttgtccatgtcatcttttgcaggagatgggtcctcatatacctctggttctattttggctcattccaaacctggtgcgacttcgatttctgttcggaaggatgacaacttgcacttcctgttcttgcacgtccggttcgtttttctggcataatttgcacctctggttctttttccggcacaatcgacattattgccaatgtagatggcccttaagtgcccttaggtagctcatgttcttccgccttatcattcaatggtttctttagaggtctctgtgatttcagcagaacattggtgctagtggcataggttatatcttttttgccataaaattacaagaacgaccgcatccctttatatctttttttcgccacaaaattacgagaacagccgtatccctaaatatggttatacaatcaggagttgggatgtccaggccagactggtgtataatatttaatttatctctattggaattgtcaatgatctgtccaatcagagataatgcttgaatttatgattgcctattcagagttggtagtgtactgctgcataaccatatcgaaaaataaagcaaagtacatcactgctttacttcaatcaaatgctcatccttgtccccttggcattaattattggcccttaattatttaaagtgtgaagcttttcaagtccacgcatatactatacacgcatgtgtttgctcaaactttcggatactgtttttcatacatgaaatcttatattactaaaacagccttggaataagtcaccacatttaatgtggaggctagaaatttctacattaattagaaaaaagaaaagaagagtccaagtagatgtataattaaaaaataactgaaattcggaattaaaagtaagtaatattgaaagaagagtacatataagaacccaatataagattaattaaaattcataataaaaaataaaataaaacccaacattagaaaagaaaaataaaacaagaattcaagtaggaataaaatttaataataactaaaatttgaaattgaaaataagcaatattaaaataagagtccatataataacctaatacgagattaattaaaatttgtaataaaaataaaataaaatctgaaattagaaaaataatagtaataaagagttcaagtcggaatagaattttaaatcaactgaaattgaaaataaaaaataaggaatattaatccatataaaacacaatatgatattaagtaaaattcgaaataaaaaataacataaattctgaaattagaaaaagagaaataagagttcaaattggattacagtttataaataaccaaaattaataataaagaataaggacggttgaaaataagagatcatctagaacacaagacaagattaattaatttttttagtaaatattaattaaaattaggaataacaaataaaatgaattctgaaaatagaaaaataattataagagttcaagtaggagtacaatttataaataaaataatatcggaatgaaaaatgtggaattttcaaaaacaaatctagaacacaaacgatgacaaatgacaacaaagaggggagaatcaacatgccattaaaggaatagagtgatcacgattgttgggacatctcaaaactattaacaagacctcagaaaaaatcccaatgatgactaaaaagagggaccacggacaagctattaaacaacacagtcattgtggttggcgggcttctaaaaattataaaatgaaaccaaacgagacaataaacactaaaacctacaaggtctaatttttaaaggtttcagagagaatgaatagaagccatgataaatcgaggaagcaaataaaagagaggtgacaaataagtaaggaactattggcgtgacttttaaaaactataaaattaggaacactgggatgataaggtttggtcttttgaagtcttaagacaacaggtatttcacaaattttaagaaaaaacatgataaaaaatagataattttgtatgggtgctagtcgtgcaattgcgcgggccacccggctagcaaataaaataaattctaaacatagaaaaaataattataagagtttaaatagaaatatgatttataagtaaaagaatatcagaatgaaaaatatggaattttaaaaaaaaagttcatctagaacacagcgataacatataacaataaagaggggagaaacaacaagcctatgaaggaatagagtgttggcggctgatgggacatctaagaactattaacaaaaccccgaatagtatcccaatgatgattaaaagaagggacgttagacagactgttaaacagcacgatcacggcggttggcgggacttctaaaaagtaaaaaagtaaacccaatgataaccatgttcgatttttaaaatctccatgacaacaaagagtgaagcagcgggcgagccatagaggagtacaacggtgacggagcgtggggctcctcaccaggagaccgcgcaggcccccctttgccggttcggccggggacgctaagtgaagttctaagctctcaatctgtggaatgttcgctaaagtggaaacgcgcaagacacgggcgatgtatacaggttcgggcc

SEQ ID NO: 93591 - DNA, 1487 bp, Oryza sativa
atggaaatgatacatacatggcacaaatcctaaaaaagaaacttgcattgctctagctatttacaggtaggtgattgtttgccagaaaataaatagaatgtaacaaagtagaaggctcgaaagctttcttgtagctaaatgggtaaaattgaccaaaagatctccacgcctatagttgctaaatccgctaacttggcatagtggaacttacttccatgtggcataaccatggactcaaatctctgactgattgagtcgtgctgatgaacaagcttgaactctgtaatcatcagagtattcagctttgcagcaactacaaacctattttggtcacctagcttatcaattggaccttgaaagagcttaatttgtgggggcatataactaacgtgacaagttatagtcaagtttaggctgccacagccatcctttagtttatatacccaaacttgcgccgtggcctcaattgcacgggagaagtgtgctagccttatgtccaccgccatgccgcaatcaccattgatgcgataaatgtatggtatgaaattcgttatctcgctgaaggtggcagccccgtcgacaagcaacagatcatcttgctcactctcccccatcttgatcctcatgtcgtactcgatcatcacgcgagcgttcatcgcgatgcccctcttagggccagtcatctgtatgaacggataggagacgtcgccgatggtgaacggattgtccctggtgcggttgaagacgtagtttcgcaatgggtccaagagattccggacagccatgaacccatacagctgaatagcaccggcaccaggagctctggtggcgaaattagagatttcagctagcttaagggagaagatctgcatcatggagccaccaatgtgccactggcaatcggcgacgcatggcttgcagtcctgctctgaatacgatggcgtcatcggttccaggcgagctgatgatggaatggatcgattaagcaaacagtgattagtatatactacttgacaaaagatgaaaaatctatcaatcgaaaggtggagaagttgcacaaaaccacatggattttgccacatggcacataacctaagatattatggtcctaaagttttttacaaaaccacaccgttaaacaaattggtataatcctatattaattgaaaaaagctttacttagaagaatgtagcattgtggaaaaaactcataaatctgatatgtgattgtagaactcaaaagaatgataaatcaaagtcaaaatgattgataaagtggttttgtgaaactttatagccataataatacccagggttatgtgccacgtgctaaaacctctatggttttgtataatttagaccatataatacctggcgttaagtgaaatttactcttgttaaattgatgaaaactttgacagtcgaaatggggggtaaaactaagagaaataatattaacttgacagcagatgaggagtagtgggatt

SEQ ID NO: 93592 - DNA, 1832 bp, Oryza sativa
gtcatctattaaaaaacggaggtagtatatttaaatcaaatgagatatttaaactttaggaaaacagttccataacatttgcatgcacgagaaattactaagatatatggaattctgaatgaattgctcttggcatctgcttacctccaaaccgcagtcattaacatatacatttgtaaagagctcagatggatcgggcattggactttcctgcagtattgaacgtgccatgattcataagcacaagtagttcgaatgaacgaaacatttttgaggacatatataactgcaattcagacctttgctttcgcgatggcagtgtcgacttgcttccttatttctttctccatgtcctaagaagaaacatcatagtagatttgacttaggatttctgtgtttatgttttccgccaaagctaatctcatgcaaggatacactatttttgtgtcggtttgtgcttctcttttgtatctcataatgaactaaaatatacagctgatttctctgccttgaatcaaagaaaaacagcatgctacgtcttgcattattgctttgtgatactatttatatgtaccacaatagtataccttgagttcttgtgtggttgcaaagtcatgggccagtagtagcttcctaaccctttcaattggatcgcgctcctgttggtaacataacacaaacaacttactcagaatgaatgtcttcggtgtaaattaagttttgagtcgagactcgagagctcatggccggccatcctgattcctgacctgtcttatgcctgcaatttcatctctggtgcggtaagtgctccctggatctgacatagagtgtccgtggtatctgtaggtgtccatctcaagaatctacaacaccgagaggatatagaaaagttacatgcatctccaagagcaggattgtgttttctactgattagcggcactgaatctatcgaacaatatgagctaaaccacactaccagcagtgtatttcagcacagcccaacccctgagagatccagaaatgtccataatgtgcacagtcgaaatggcaatcaggaaattcacttacaatcggtccattttcaagagcatgttgcttggcaaatttacaagcttgtttgactgcaagaacatccataccatcgacttgcaccaaacacaaggtaccataaccatcatcacaacgatacaaacaagagcaccaacacggccacctccatgcctgcatatccccataacttcttgcatgcaagctaatcgcagtaaaaataactgcaacccaacttgccgtaggtgtggcaagccacacaaagtaatcgttggcggttggccacaagtgtggtaagatgtgacttaaaaatgagcctacgacatgtgagccagcgagttaatgaagtgtggcaaatcatagttatagcaaaccaaacaccaacctaagaaagtttggcacatctagtactcgaatatgtggcatgacgatttgtggcagtgaaccaaacaaccccggaacccacaactagatcacagagtatggtgatcagagtccagaaggatgttgcactcaaatttactggtcaattatgttcagctcagttctcattgtcacatcaacagatcaactctccatcagccagaaagagttcaaacaactactactcataaaaaaaattcaaataaaacagacgttaaatattgggtacgaaaattcacaactgcgcttaaatgagacggagaagtatttagttaccttcaatcctggcacatagtcgccgcgtttgtagtatgcggggcttttcgatgccctccattccgccgtccccatcccatctgtgc

SEQ ID NO: 93593 - DNA, 643 bp, Oryza sativa
taacaaatctgttaccatcactgataagagtggtaaatgattaattattcgtagcatgccatgatgtcagaaacagtaagctgagtagctgatgtgtgtgaattaacgtgtttttgtgtgtgtgcagctgctgatgagaggggagcacgaggagaggcacagggggacgctggagaggtacagggagaaggcggagcactacgtgtgcgcgtgcatggggcggaacgcggccggcggcgcggacgccaacgtggagcggagccccggcgggatgctgtacgtgcggcagtggaacaacatgcagtacgtcaccaacgccgcgttcctcctctccgcctactcggactacctcgccggcgccggagacggagacggggacggcggcggcggcgtcgcgacgtgcgtgggcggcgggggcgcgggcgccggggaggtgttcgcggcggcgagggagcaggtggactacgtgctggggagcaacccgcgcgggatgagctacctcgtcggctacggcgagaggttcccggcgagggtgcaccaccgggcggcgtcgatcgtgccgtacaaggacagcaaggagttcatcgggtgcgcgcaggggttcgacgactggttcggccgccggggcgccaaccccaacgtc

SEQ ID NO: 93594 - DNA, 986 bp, Oryza sativa
tactttgcaattacacatcacaagattctctgtaactttctttttaacatgaagattctttataactttcttcagcacaaaatacaaacagcatataaaatgcaatgaacttcaatataacaacccaaattttatctctttgatctgtgcgccatgactacaaggaatacctcaccaagtcctaacatggcagtatatcatacatatcattctacactatattatctacatttctaatggaacaagaggcaggaacgggttagccagaatcgccatgttactcgcggacgaacctgtactcgtccgcagcttgagattgatcccctctacacggcccctactggatccgctggacgcccccttgctgagcctgtcctgcagcgaatgccgcagcgaacctgagaacagcagacatcacaaattcagcgccatatccatctcgaaaacccacgggcgcaagtacatccacagaatcgagcaacgcaaagtttgcgagatcccactgacttgcggacacctgctgcgacttgctgtcgatttgcagcacgatggacttgctgctgaggcccgggtccctctgcaggtccaccacaattggcgccctcgtcgccccgttctcccccgtcggctgcaccccaagcaccaccaccacccccaaatctaagaatcaaaaaatggaaataggcgaagagctagttgtcgggtagtagtagtagtagtagtagcacgagctcaccagcacggggtggccgatgaggctgttcagcacggccgacttgcccgccccctgcacgaagcagatcagaactggatcagatcgggggagcgcacgagcgagcgagcgagcgggcgggcggatcgcggcggctccaacggcggcggcggcctattatacttacgacgttgccgagcgcgacggcgttgaggaaggtggaggggcggcgtggggcggagtcgtcggaggggtcgtcgtcgcgcagcagcga

SEQ ID NO: 93595 - DNA, 5546 bp, Oryza sativa
  unsure (1)..(5546): unsure at all n locations
ttccacccccgaaaccactccaaaaccaaaccaaatctcgcggcgcatggcggcggcggcggtggcggcgaacggcggcggcgacggcgcgcaggcgtccaacgcgcccgcccccaccaggctcgcgtcggtctacagcgaggtgcagaccagccgcctcaagcacgcgctccccctcccctccgtcctccgctcccccttcgccctcgccgacggccccgccagctccgccgccggcaaccccggtcagtcccgagcccgactcttctgtggatctcgccctcctcctgcttggttggtgttcgttactggtgtgagctttagatttgatctggttgtggtggtggtggtgtgcaggtgagatcgcgaagctgttccccaacctgttcggccagccgtccgtgtcgctggtgccgtcgccggagccggcgtccaccaggccgctcaaggtcggcgtcgtgctctccggcggtcaggcgcccggcggccacaatgtcatctgcggcatcttcggtgagtgcgctagtgttctcgagctgtttgttaaccctgtttacccaaggctatggaggatcagttctctgtacaagcgaatttgaagctcgtggtttcgagatgggggtgttcgcgatctggatagggnaanttcngtgnngtntnttntnaagctagttagagttggtgttctccaaacaagctttggcatcgaacgcgcacagttcttagatcttgatcgattttggttgtttagcgagggccagaattaagagatctgcttattttttgattgtgagttgtgtcccggttgcactgaaaaatcgaataggcactaatgatatattgtggttccaaatatatttcttgatgaatttgcttgccttgtgtcggaccagattacctgcaggaatatgcaaaaggatccgtcatgtatggattcaagggaggtccagctggagtcatgaagtgcaagtacgttgagctcactgcggattatgtgtacccctacagaaaccaggtatagcaacttagattcactaagcatgctattgggtcgaaaattcgacaggtgcctattctctgattttctgtaaatcatgttagtttagtaggtggtgttaggtaaggttctggtgtagaaaatatgataagaccctttttttggtgcaaataattacattctcattttcttttttggagtatgatcatgctaggtgtcaagtactgctgatggttaggtcgctgcatgaaatatacacacttttcctttttaaggggctctcttatttcaggtacgattttaattttgtttctctttttgatagggtggatttgatatgatctgcagtggtagggacaagattgaaacaccagagcaggtatatctttgcgcttttatgtgcaaatgcttatttaatccctttatctgcctttcagggtatttggctattttgttgcctagtttcactagcattttcttattttaaattctgtcatgtatttgagcagttcaagcaagctgaagacactgtaaacaaacttgatttggatgggcttgttgtcattggtggtgatgattcaaacacaaacgcatgccttcttgctgagtacttcaggttggcccctaatatgtgtaaccctgttcttttgcttcttaggcaattttctttagttgctgttgacaaagacctttgtgtactgttgatgctctgtcaactgtaaacaggtcaattccgaaaggaaatacagaaaaaagttttccaaacagtaacaaaaagctcttatttttgttgtatgttgctgaagcatattttctgcatgatgttttctgttaaacaagcattaagtctgcaatagcattgagccattaactgaattctgcaacatagagaatctagatattattctcgatagttttattggcaatattaactatatgcttgttgacaagtgagtgattgtttaactttgtagggggaagaacatgaaaactcgtgtcattggttgcccaaagactattgatggagatctgaaatgcaaggaggttccaacaagctttgggtttgacactgcttgcaaggtatcaggttcttgatccttgtgcatcagttttcaaaatttcagctaattctactgtagattgtgaagttttcacccttatgaccttgatgcacttgctcaactgcacatggtgaaattaggacattttgcacataatatgaaaatcatcacggcaataataacaagttgacgatttttcctcaaaaaagttaacgattgatccatcttctttttcagatatactctgaaatgattggtaatgttatgactgatgcacgctcaaccgggaagtactaccactgtaagtttctgttttggttgtcagacatatgccaaactatgatttttgttttcctaaacatggaaagagagttgataggagcaaactatgtttagtttgaagagatcatggataataattgccaacagtagctgtacatggctattaaagtatactgtcatttagtttatccataactaaattgaagaaggtcattacatgctcagcaacctagtaaagtagtatttattttttcgtacattatacaacaaggcctcaaacatcctcataatgctgtaacaacatgctgctaacatataaaatccttgagtgtcaacttctgcagatggttaatttaacattattttgtctatttctgacacaatactaataagtatttgttatgttcatgtagttgtgaggcttatgggacgtgctgcttctcacattacattggagtgtgctctgcaaacacatcctaatgttgcactcattggagaagaggtttgtaattcttatatatgatcttctacattgacctgacactccaaccttttcctagcttgaatactgttccataatggtggaatcatctattcatttcgattcatgtttatttcatgctgatttcatttacactttttcctaccaaatgtgatgggcatgattggggctagtccactaggccttattgaggttcgttgtccctggacccagttggtgttgcatttccatggaagtcagcatcacaatcacaagggcaagcggtagatagacaatggacacttgtttttctgtcaatgctaacaactacaataggtctcctttaaagcggattattgtaacaattgtatatacgttaatactactgcagtatgttgctgtacagtaacattgcaggtcccaattcggtgttggcacatagcacaaacctcgtactttatatcacagtttggtactaaaaattgactcgagtaaaatgttgctggagatgatctgcagtttttctaaagtgcacatggcatattgtttgcttattatcattaccatttcagaacacttcttttttgtactgtaggttgctgcaaagaaggaaactcttaaaagtgtcaccgactacattaccgacattgtctgcaagcgtgcagaacttggttacaactatggtgtgatccttatcccagagggtctgattgatttcatcccagaggtttgacaatcttcattcacctgtgatttgtgttgtcacgatttgcattactgatttcattctgtttctttcctaggttcaaaaactcattgcagaattgaatgaaattttggcgcatgatgttgttgatgaggcaggggcttggaaaagcaagcttcaaccagaatccaggcaactgtttgacttcctgcccaaaaccatccaggagcaacttttgcttgaaagagatcctcatggaaatgttcaggtaaacagttatagtcctcccttcgctgacatgactttttgctgaagagttggtcatactaagtccctaactggtgttggaaatttttgtttttaggttgcaaaaattgaaacagagaaaatgcttattgccatggttgagactgaattggagaagagaaaagctgaggggaagtaccccgcacatttcagaggccaatctcacttctttgggtatgtatgaattgttgcattttccaaaaaaataattccatctctaatgctgttgctgtgtaattttgcagatatgaaggaagatgtggccttcctactatttttgattctaactattgctatgcgttaggctacggttctggggcacttctccaatgtgggaagacaggactgattacgtcggtatgcacactatagttccctgtcacttgttggatacccagattggaacctaagaacgggctttgtggaagtgatgtttgcagcatgtttgtttacgaaccagcgcaggcagatgaacttctaatgatatgatcatgctcttatgtttgtatttttactcaggttggcaacctcgctgctcctgtggaagaatggaccgttggtggaactgcattgacatcgttgatggatgttgagaggaggcacggtaggtttctacagttccgttgtttgcacttggagattagctagctatgtttcattaaatttcttttgaccgtttattcaaatacctactatgtgattaaatcttcaagttacttttggaactaatttgggtcagattttcatataatatgcattgcattacctgtcatttccttgtttaaatcataaaactaatgtttttttttgttttctgcaatcaggaaagtacaagccagtgatcaagaaggctatggtggaacttgacggtacgaagcacttctattatcaacgctaacagtaatgtgatttatggacctttacccaaaatctcatttcatctatcatccattttcaggggcaccgtttaagaagtttgcttcattgcgagatgagtggtccctcaagaaccattacatcagccctggtacgtggacatgcaatagctagcaagtagtgcaaaatgactataacagcaacatagagaacaatgacatgtttaatttcttgcgaaacaggtcccatccagttcagtggccctggaagcaacgatgcgaaccacaccttgatgttggaactcggcgccgaggcatagagagacacgacgataccgacgtgtaccttttaaattttttgttcttacagttttgaaaagttgagatggaacctcgcagagtgacctgcaggctccatatttgtggagtgctcaataagaggttccattgggagtttctgtggagtagagatatgtgtaccaataataactgatgttagctttgcatgatccattgctccatttttacacagaagttaacttggttttattgtagctctgggttttgttcaactggatgcgacgctataattatgggttttgttcaactggatgcgacgctataattatgaacataaataatccaggttgaggggcggttttggttttctttacttgttattatctcatctatgttcatacatactcgttgacgatcgaccgtcggcatcagtttgcgttaagcttaaagctaaccatagcagtattctcgccctttctccaattccaaaggtcatttttgcatgcacattgtggacgcccttacaatctcattgctt

SEQ ID NO: 93596 - DNA, 1133 bp, Oryza sativa
cgccggcgagctcgcccacgcccttgacgccatcaagtggggcaccgactacttcatcaaagcccataccaagccccacgagctctgggccgaggtaactaaatcactctcattttcactctcattacccagttaataacgtacttacgtagctactactaatcaaccaaacctgagagaaaattagaattattcaaaccatgcgaccaacatgcacgcatcgattggctagctagctagctgcagttggcaaaaagaaagaagatttttttttgtaagatttttttttgttttcttttttaaaaaagaaagaacatttgttaggtggagcaacaggacaaagttaagctatagctgggagtggttaattcagtgtctgatcgagacgcgcaaatctcacaccacaccatccccccatgattgtctcctcctcctgctcgcatcacatggaatcgattagaaattaacaatccattcttttctttttagctaattaattctctccatggctttgacaatgtgagctcaaataatgattattaaccaaccacggtgatcgtcgatcatggcgtgtgtgtgcaggtgggagacggcgacaccgaccactactgctggcagcggccggaggacatgacgacgtcgaggcaggcgtacaaggtggaccgccgccgcccgggatccgacgtcgccggcgagaccgccgccgccatggccgccgcctccatcgtcttccgccaatccaacccgcactactcccacctcctcctccaccacgcccagcaggtactaattaattactacttactaatcatccccctctaattaaccccgattaactcactaatcaccgtcttaacaaccacggtcaaaacggtaaatcttttttttttcaacgggttcacatcgaatcgaagacgtgttcctctcctcgttccccgtgccgcatgtgccagctttggcttggccagccggatgacgtcagcgacaccgtgtgaagcttctgtcggtcgtgtgacgccgacatgtggggcccccatccccggtggggtagtagattctccgtggaaggacaaagacatcccgctgctgctaagcacgttgacgtttgcgtcgaattaggttactaattaggt

SEQ ID NO: 93597 - DNA, 757 bp, Oryza sativa
aacgattttttttgagcttttttgctcacaaaagcatgcattgggtagttcaggtgtgcacccacacggtgggagagaagagatggttgtagagttagcaagctgtgagttttaggcaaggcagaaacatttgactccttgaggaggtggaagattacattcataggccggttgtccaccactccctggcccagaccacgaccatcgtcctgagttagtctacgatccaacataatctccagccatccattttttaagcttgctgcccctagtgactgcttggagtgtactgaaaaccgattgcccagcgaatcctgtaaaaatgcaagtgatggcattgggtagtaattgccctgcaaagggatcttatcatatgtctgcctcctactcatctgaaagccatttagatcagaatagaagactccttggttgtcaatatctgtcttgaatctgacaatcaactccttgtcattaaatacatggccaacaagttcaacatggtattccttctcaatcagcatatcctgtatagagtctccacagctataaatccgtgtgctatgtgagatgggtgacttatgccactgtgtctttggaagggaatgagcctcttgaaccaatggcccttcactaaggatgaaatatcccccttcctcaacaatggattgtgcttcccctattggtttgaacaagtatgccccactaccgtggctgcggtacatgccatttcttcaccaacatcggtgtgttccccatc

SEQ ID NO: 93598 - DNA, 962 bp, Oryza sativa
aatccttttggagagataagcagcggccatagcacttggcccgttacgatgtgtatctacaacctcccccctggctatgcatgaagaggaagtacataatgatgccgattattattcaaggccccaagcaacctggtaacgacatcgatgtgtacctaagaccactggtcgaagatcttaaacaattgtggaagaagaaaggtgtccccgtgtgggatgaggacaaacaggaggagtttaacctacgagcgctgctattcgtaatcatcaacgattggcctgcacttagcaacctatccggacagtccaacaagtggtacaaggcttgcactcactgtatggatgaaacagaaagtatgtatcttaagcactgtaggaaggttgtatacatgggtcatcgtcgattccttgcagcaaaccacctggtacggaagaaaggcaagcacttcgaacataaggccgaccaccgtacgaagcctaaacatcgcagcgggaaaacagtgtttgctatggttaaaaatcttaaagtagtgttcggaaaggggcctgaaagccagcctatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacgcaaagtcaaaagatacactggaagcacgtaatgatctgaaacatatggaacaacgcggcgaccttcacccggaaccaaagaaaaaggaaccattacttgagtccaaccagctacactcttagcaaggcagaaaaaggaaagtatgtttgaatgcttggagagcataaaggtaccgtctggatactccaccaatttcaagcaaataataagcattaaggaaaagaagtttcacaaccctaaagtct

SEQ ID NO: 93599 - DNA, 989 bp, Oryza sativa
catgtcgaaggaaaaaacagaggagcatgtggaaaaacaaaagacaaaagagaggagcatgtggaaaaagaagtcaatattttggagactaccatactagaaggatcttaaagttcgccactgcatagatttgatgcatgtcgaaaagaatatatgtgagagtttaatgagattactgcttaacctaggtactacaaaggatggtctcaacgcccgacgagatctggaagaaatgggtgttcgctcggaactacatcccataaccacggaatttggcagggtttaccttcctccagcctgctacactctctcgaaagaagagaatattgatttgctaacatgtttgagtggtataaaggttccatctggttactcatcaagaatcagtaggctcgtttcactacaagatcttaagttggtaggaatgaagtcgcatgattgccacgttcttatcacatagctgttgcccgttgcaataaggaatattttgcctcctaagctgcgacacacgatccaacggttgtgttccttcttccatgcaatcggccaaaagatcattgatcccgagggactagatgaactacaggcagaacttgtgagaaccctatgtcatcttgagatgtactttcctccaactttctttgacataatggaacatcttcccgtgcaccttgtgaggcaaacaaagtgctatggtccagcattcatgacgcagatgtatccttgcgaaaggtacctggggatccttaagggttatgtatggaaccgttcacaccccgaggggagtatcatcgagagttacaccaccgaagaggtcatcgatttttgtgtggactacatgtcagaaacatcttcaattggattaccacgatctcatcacgaagggaggcttgatggtattggtactgttggaagaaagaaagactgttaggtcggatcagaaggtacgataaagctcatttcatggtactgcagcattatgactgatg

SEQ ID NO: 93600 - DNA, 738 bp, Oryza sativa
ctggattcctaaatttttattatcatcttttggtcgacttctgcttgtgtgtaggctttgtggcaaggaagaaaaacgtgtggatcgtggattccggttgttcgcggcacatgaccggtgataaaaattggttctcctccctcaagaaggcatccaagactgaatcgattatctttggtgatgcttctacaagtgtcgttttcgctacacgtttggttaaggtaaatgaaaattttgaattgaagaatgtagcgttggttgaggacttaaagtacaatttgctttcagtttcacaaattgttgatgaaaattttgaggttcactttaagaaaactggaagtaaagtttttgattcttatggtgattctgtgttgaatatttctcgctatggaagagtgtttaaagctgattttgaaaatcctgtttcacctgtgataacatgtttggttgctaagtttgataaagatgtgatgttttggcatcgtagacttggacatgttggttttgatcatctcactaggttaagtggtttggatcatgttcgtggtttgcctaaacttaagaaagatcttgatttggtttgtacaccgtgtcgtcatgctaagatggttgctacttcacatgctcctgttgtttctgtgatgacggatgcaccgggacagctattacatatggacactgttggtccagctagagtgcaattcgttggaggaaagtggtatgtgttggttattgttg

SEQ ID NO: 93601 - DNA, 880 bp, Oryza sativa
cgatgtttgcttcatggcgcgtggtgaatctgacacagagtatgaagataatgaggtaagtgcttttgaggaagctattaatattttgagtgaaaaaaataagaagtgtgagaagatgtatagaaaacaggaatttatcattgaatctcttaaatctgaaattgctagattaaaatctcttattcctaatgatgatgattgctcaaattgtgaggttttaatgaatgagatttcaaaaattagagatgttaatgctgcacatgatttgaaaaataaatcttctcttgcttgtagttttgctttgcacacacgtactttggatgagttgtttttaacgaaaaagttgttgcaaaaatatcaaattgcttttcatactagtttgatgtttaacatgatttctgctaaaaagttaaaacaacctcatgatgttttggattgcttaacatgtaatttgaataagttgaaattgaaagatgctttaggtcgtgttgagttcatggaagatgttgtgaaaaacaatgaagtgctttcttgcgctaaatgtcgtaaaagcaatggtgtcatggtagattgtgaaaattgtgctaatttggaaaaagaggtttcttatttgaaaaattctttgctaagattttctgatggtaaaaagaacctcaacatgattttggatcaataaaaggttagcacacataaccgtggtttaggttttaatccttatgctcataattctagacatcctcctgttgtgttaggtgttggtgctagaagtggtgagattttggttaaacctgatactaataaaactgtgtttaaatctgctggtatcatgtctaatatgagtgcatttttttcaaatccaatgttgtgcattcaaatctcc

SEQ ID NO: 93602 - DNA, 3074 bp, Oryza sativa
gaaagaggtcttgaacatgaattttcttctcctcgtgttcctcaacaaaacggtgttgttgaaaggaaaattcgtgttttggttaagatggctagaacgatgttggatgaatataaaactcctagaaaattttgggctgaggcgattaacactgcttgttatatttcaaatcgagttttcttgagattaaacttggaaaaacttcttatgaacttcgatttggacatcaacccaaagtttcacatttgcgtgtttttggttgcaagtgctttgtcttgaaatctggaaatttggataagtttgaggcacgttctaccgatggattgtttcttggttaccccgcacatactcgtggctatcgtgtacttattttggagactaacaaaatcgttgagacttgcgaagtttctttcgatgaggctagtccaggtagtagacccgatattgcaggtacactatcacaggttcaggggaaggatggtcgtatttttgaagacgagagcgacgacaacgacgacgacgaggtcagctcggccggacagaccgagcgccaagccggtcagaccgccggtacacctccggtcagaccggcacaggaggtgcggttagaccggccagggtcgtcagctgagggttctattaatgctgttcgagatggtcctccggagactacaactttgaccagtactgatacagaacgtgggtcaacttcagaagttgctactcctttgcacattcaacgacgacatccgccggaacaaatcattggtaatataggtgagcggactacaaggtctaaggtaacgactcatgatgtttgtgcaaattctgcatttgttgcttcttttgaacccaaagatgtgtcacatgcattaactgatgaatcgtggattaacgccatgcatgaagaacttgaaaattttgagagaaacaaagtttggactttagttgaaccaccttctggacataatattattggaaccaagtgggtattcaaaaataaacaaaatgaggatggtttgattgtgagaaataaagctagacttgttgctcaaggttttactcaagttgagggtttggattttgttgaaacttttgctcctgttgctagaattgaggcaattagacttttgtttgcttttgctgcttcaaaaggttttaaattgtatcaaatggatgtgaaaagtgcttttctaaatggttttatacaggaggaagtttatgtcaaacaaccaccaggttttgaaaatcctgattttcccaaccatgtttttaaattgtctaaagctttgtatggcttgaaacaagctcctagagcatggtatataggcttaagaactttttgcttgcgaaaggttttacaatgggaaagattgacaaaacactttttgttcttaagcatggtgataatcaactttttgttcagatttatgtggatgatatcatctttggttgttcgactcacgctttggttgtagattttgctgagactatacgcagggaatttgagatgagcatgatgggtgagttatcgtactttttgggattgcaaattaagcaaacacctcaaggtacctttgtgcatcaaacgaagtatacgaaggatctttaattttgagaaggttcaagatggagaattgcaagccaattttaacaccaattgattctacagctgtgttggatcctgatgaagatggtgaagccgttgatcaaaaagagtatagaagtatgattggatctttgttgtatctaactgcttctaggccagacatacaatttgctatgtgtttgtgtgcacgctttcaagcttctcctcgtgcttcacatcgtcaagcggtcaagcgaataatgaggtatttgaatcatacacttgagtttggaatttggtattctacttcatcttctatatgtttaagtggatattccgatgctgattttagtggttgtagaattaataggaaaagtactagtagaacatgttattttcttggtacatcattgattgcatggtcttctaggaaacaatctagtgttgcttaatcaaatgctgaatctgaatatgttgctgctgctagttgttgttcacagattctttggcttttatctactttgaaagattatggtcttacttttgagaaagtacctctcttttgtgataatactagtgctatcaatattgctaagaatcatgttcaacactcacgcacaaagcacattgatattcgttttcacatggacaccaagttgcaaattgctgatattttcactaaacctttggattctattcgctttgcttttcttcgtggtgaattgggcataattcatccttttggcatggtttgagggggagtttgtacctcatggttttatcaagcaataatatgataatgagaaaaattgagaaaagagagctttgtttatgcatatggtattttcttgtgcatgctagcaatactttgaaggtttatttgtctctagcatagcttgtatgtattctagtcttttcatgagatttagattttgcttttaagggagattatgcatgacacttaaattctacttgaattaagcaaatatgcaatgatgatgctagcatatggtttgatttataaatgctctatatatatgctttattgacttgttattccttgtcacaccctgaagttctttcccaagcctaaattgaagttataaatggtctcaagaaaataccagtgtaaagcaagagtaaaccttaataaattaatgcaaataataatcggaattggcatgtgaatttttcttgagttctacatgtcgaaattcgctaacaagatttttagtggaattttcagagctctcgaaataattttaaccaattaaaattgagcatatgcaattttaaatcccagggaaaatcttttcctccttttctttttcttttccctccttttcctcttcttgggccgtcggcccagtccaccccgccgccgggcgcgccctcctccttgtgggccagcccaagccgcccttcctctccccccgagacgccaacaggtgggccccacctgtcgaggtcgtccccatccttcggc

SEQ ID NO: 93603 - DNA, 2985 bp, Oryza sativa
gcctccgctgtggaccgccgcgccgccaccgtggactgccgccgagccccgcgccaccgccgctgtggacagcctcgccgccgcctgcaacctcctcgtcgccgctgtggaccgctgccacgccgccgtcgccgagcccccgcaccccgctggaaacccgcctctccctcgccaccgctgtggaccgccgcaccgccgccgtggaccgccgcctcgccgtcgcgtgcaacctcctcgccgccgttgccgagccccgcaccaccgccgccgtggaccgccgcgccgccgccgggagagccgcctggattgggttcggtttagggttagcgttagaaattttcaccgtttcatctttctttttcttttaccgtgaaaactggtatatcctgcactgagggtaaaatggtcattatcaaaaaaaataacggttgtaacggtgtagagttgactatgatggtatttttgggagaaagaggcttgtacaatggtatttctgggaagttgcttttgtcgatggcatttctaggattagagtgcttgtcgatggcatttcatggattttctcaaaactatacaattgttactattggatatatatgaacttgtaggtttcgatacaattgttactattggatatatatgaacttgtaggtttcgatacaattgttactattggatatagtttcgttcggtgaccgctactccctctgtcccaaaaaaactcaacctaggaggggcacaatgaatccttgtccaaattcgttgtcttaggagaggccacatcccctcctagattgagttttttcgggacgtagcgagtagtgcactaagtcaagtgacacattttgtcgttccatgtgtacgggcgctattagggcactcacagtgcgccgtgaattttgttgaattccgtttggcctcggctgccaaacaggactccagaactccaaaagacacaaggtcagcattgcgtttttgcctccaaaaaacgcctgagacgttttccccagtctcgatcgaggccaaagcacgagtagcaaactttggtcatacgcgcttcaatttcgtgagcccaaccaataacatggcagcgaatttttactgtttgcatacgtggaacgctcaggccgaacgcctgcgcacagcactgttgaatggccttaccatgtactccctccctcccacccctcctagtataatgaatcaggactaccctttatccagattcattgttctaagaggggtcacgtccccacccctactaagttgagttttttttgggacggaggaagtacacggcacagaaaaaaagagcacgtacaacacaatatacaggcgaacattatttttattttgttttcataccatatactaatgctaataatgctcacattttattaatcttcttccagttcaggctaacaacaaacagctgctacgctataccaaaaacatatacgaatttgtttctcaatgcaaaagttctttcccgaagagcccagcaatggctcgtccagggtcgtcttgcttgaccagggattctcccaccaaaacctacagcatcaacagacacgcttaaattttcagcgaataggatttgtagaaatgcgaatgaatttcagcaggaacatgcaattttatattgatatattgtagcatatttccttcctatagcatataattttggacgaccacaaatctaacattgactcttgtcattaaggaaaaattcgaggtaaattgacaagtgaaaaccgcacaactagtgagaaaagggaaatctgtactaactaacccaatttctcagatgtttcaacaagtttgtcgaatactgaaatcgtataggactagtttacattaatccacaagtaatttgaaaacttacagcggaaactccagcattttgcacataagcaacgtcatctgggttgaacagccctgattcgccaacaacctgaaaacccatcataagttggataaagaccagcacaaactagcaccctaggtgtttcagcaaacctaactatccaaggaaccaaaagtcaagtcaatatcactacaaaaatttatggataacactaaaccctaacatttcctttgatagtaatgtcatgtgcatgtacattgttacgaacaattggaaaatctcatcctgatataccaacaaaaatcacttatttcttcaatacttctagtagttcatctagaatgcacaacagagtacatataatgctgaatagacaaacaggtcatttcaatcttctattgaacagaatatgtgcttgctggaaaggctaccattaaggatgcatgatctgttacaatactaacaggatataatttgaatctagtctagactactaggttacaaagatccgacacaataaattgtttgtgtatggcaggatattgaatgaacaatagctattgactgaagttgtcttcttttttttttttttttgaaaccgtcagctattgaacgaagtcaatcataaggttatgaattcttagcatttgtaaagattgtgttgatgtaccaaagaatccattctcccatatcattttcctcagcagtatacataaattgcataaagtttacacataaatatatctgacataattaattttctattttccatttgctgtaaaatagactgtcgcaaacattcagtcagtgataacagtagatgcaagttaagaattcaacacaataaaagaacaggcgtccaagtgcctacttgtcatacaaagtcagtaaccatttacctaagattccaatatatagaataacagtactaacatttgattgagttgaacagatgcatgaaaatacaactagtgaattgtcacacattagcatgggatattaccaatattcccttctccctgatggtatcaccatgcatatctagcaacatctttgtgtttgaagtatcgacaacaaatgtttctgcagtgtaaatatttttggaagtaagcaggaaa

SEQ ID NO: 93604 - DNA, 1872 bp, Oryza sativa
caacatgttgggaaaaaagtgagcacaagaaaagtatcataccaaggctgcggttattgatgccaataagctgaactccacttatattcagcacacgctccatctccctttcatcatgaacctaaaataacatcaccggataatagaataaaaattaagcttggatctgtgcagattattagagtgtaatcatttcagttattaactcaaatagtacatgttaacaaaaaaaatctgaaacatcatataagttatggtatttgttttccatataaatgtgaatatgagacttatctccacgaaacatgcttcaccaccactccataggccagtttaaatcccgtttaaatgatgtaagctagttttcaattcatgggaccctccagaattaaaaaaaaaatcattgttacaaaatataaagcagtgactaacctcaataagagctgtcattcccaactccttacatatgcgaaggaagtactttatgtcgagatcaggtagcacagcggcaataagcagaattgcatctgcgccctgagagcgggcataatagatctgccatttatcgatgacaaactctttgcataggagagggcactgcatttacacaagatatgtacatcttgagaaaaaaaatggtaatacacaagcattgtcttcatgtttaaataacacatatatcaaccaataccttcactcctgacttccgcacctttgcgagattttcaaaacttccctatcaaataaaagaaagaattagcttagaccagtaaaagtacatgttccaattccaaatccattaacacatccaattccaaagccacctgaaaatacttctcatcggtcaagatgctcaagcatgcagcaccattcttttcataagcctgagcaatttcaacctgcaacaaatttcacactagttatgtaaccaagctttgaagtagcagcgaaaatgacaactaagaagccaaaatctcacaggattgaagttctccctgagcacacccctacttggcgatgccttcttgacctcagcgatcaacgctggcataccattgcgcttgaaggctgatgctaaagcaccgtagaagtctcttgcaggaggagcctgccctgcagcctcaatcacctccttgagaggcttcttggcatgcccctgcacaagaccagtaacagcaatcagccattgtacgaagtatcaagaatgaactacagaaatcgtttctccaaacaatattagaaacagacacaagcatgtcatttggcgtccaggtacacaattttatttttaggtaatattcccttgccattaattagaagaaccacaaactgagcacatcttccgagggatatcaaatattaagatgaaaaaaaagaaaagattaagcatcaaaaattctcctgcaccttgatcttgaacatcaagtatcaacagcatagctaatgaatgagtgtgatttgtaccaaactaaattattgaggtaattgatttgggtttatggttatatacatacctcggctacctcaacctccttgtcccaaatgatcttctccaggatgttgcggggagcacccagctcctcctcgatctccttcaaggggacattgggacggcagtgcctgcggatgcggatcccttgactagccgctatgtcgttgatcgacttgccgttctcccactgcgctagctccaccgcgttcaccatgtcgtcctgcgctagctcctcgagtatggagtccttagagaaaaatggaggagcatttcaagaaacgacggatataaacaggaaacaagaaatactccgaaatggcgctcaaaagagggcaaaaaaaacaccatgtagacttcgaatccgtgctcaagaaatgggg

SEQ ID NO: 93605 - DNA, 740 bp, Oryza sativa
tcattttccgccgctggtcgtcgctgccccctccggtaaggactccctcccccttcctttccttccccatcccgcgtgcgccgtcgcttttggtcacgccgctgctccggctatgcgccgccgccttcgcgccgtctgccgccgccggtcgccgccggtggtcgtgcacgctgccgcctctagccatggccggccagccggctttgaagccgagccgagcccggcggctgctccctgcgccgtccgatcggcccgaggccgattcggaccgtcggtcccgtggaccggcggtggactacccgcgtggtcccggtccatggtggactggccgctttgtgccgctgacccatggggcccacgtgccggcaccccctccctctccccttgcaccactgacatgcgggccccgcatgtcggcgccgcccgctccctttgatgacgtcggccctgggcatttattgcgcaataattcaattaaggattttttctgtttatagtaaaaacacagcgaatcttctaaaattcataactaattcatccgagctccgtttaagcccattaaagtctcagtaaatcaagaaaaatgtgtagaatccattaaaaatagttttgttctctgtttcagtagtcttatagcctgtttgtattgtttgctttgtatgtcgcttagattccggttcttccgacgctccggtgtacttcgagatagtcgccgaggttcctccaacagcagagcaagg

SEQ ID NO: 93606 - DNA, 558 bp, Oryza sativa
tttttgggataattacgacctgattttgtttcgatgacttgctctcgcctgttctactaccattgcaagcctgtgctgtgcatatcatttttttttcaaaaaataagtgttttggtttctcttaagtacggcattgggatattcttcatttgaaaaacagcagcaatttctgatttcttaacatcaccacatagtttgaacacaggatgtgtaccgtaccaaaagtggattttaatcttgacgactacactctccacataagagaattcatcagaagctagaaacagaacggcttttgtgttttgtcatttgatccaagcgtaaactcaggatggaaaactggaaccagaaaacttcgactttgtaggctcggagaaaaatattcactattacaaaaatccatgcaggagtcaagttaaaagaagaaacagggttctgtctttgagatggagtataatttatttaagatcattccctccatcccatcatccatgagtttgcaaacttcagctcacattctaaaaatgaagatgccaaagagagagaagggacagcaac

SEQ ID NO: 93607 - DNA, 836 bp, Oryza sativa
atagctcataatgatagatatcttgggttaccggtatttattggtagatccaaagcgaaaacctttgaatacttaaaggagaaaatctggagatgcatccagggatggaaggaaaaatttttatccaaggcaggaaaagaaattttaattaaagcagttgcacaagctattccaacatatgcaatgtcatgtttttatttaacaaaatctctttgtgatgagttaacttctatgattttgcgcttctggtgggctcaacatgataatgacaaaaaaattcattggttgggaaaggataaaatcatgaagccaaagagtcaaggaggtttggggtttagagacctacattccttcaatattgctatgttggctcggcaaggttggcgccttatccaaaatcctgattctctttgctcaaggctgctaaaggccaaatattttcctaactgtaatgttcttgatgcgcagtcaaggaaacaaatgtcatattcctggagaagtattctaaagggaatacaattactaagaaaaggcgtaatatggcgggtcggaaatggagagcatataaacatctggtcagacccatggctgccaagagatatgagattcgtcacaacaagaagaggggcatctttaattacaagggtgtgtgagctcattgatccaacaacaggccagtgggatattgaattaatccagcagattttcaatgagaacgatgcaaaaatcataacaagaataccactaagggaaggtcaggaagattttattgcttggcaaccagatactaaaggaattttctcggtaaaatcagcatacaagctacatgagaagat

SEQ ID NO: 93608 - DNA, 691 bp, Oryza sativa
agaaattttggtccgaactccgaaataaggcttcaatattcagatccagatatgaaaattccttctgaaaaatgtgaagcagaatggtgtgtacctgacagaacacactgaattgcatcgaacaggatggacacagcaagaataggcatcatcttagctatataatctgccacttcctcctcattgctgtacgcatatccccagagattgcgcacaataaccatcacgaggccttctgaagttcctaccaagaacgccaggagcatcacaacacgggtcgccaagcgtgccgcctgcggtcgcccagctccgagctcattcgacacgcgcgtactggtaaatcgaatcaatcaagcgatcaatgttctcgaaactgctggtatttctcatagtctatttgttgtttcagagttcacaggttttgtttctaaagaaatggactctgttttgtttctgaattatgacttcagactctgttcagagttcagagttcagagttcagacactgaccttatggcagcaccaagtccaagtggcaccatgaaggcgaaagagtttgtgttcaagctacaagcaatcgtagtagcagcagcaatgattaattagcggagacaacaaattgcactaaattttagccaaaaaaaataaaatgtaggatttgaatagatcaccatatggacagaacggccgt

SEQ ID NO: 93609 - DNA, 1560 bp, Oryza sativa
tcttttcaattattatttgtgctctgaaaattccactaaatttatttacgcattttaggcttttaggaaatatacaaaattcctccaagcctcatttgacttttatctttgcacattttaattgttggaggctttcacatgaattttaattattctttgcacaatttcgaggatgtattttagagtcgatttgggacgtgacaaacctaccccccttaaacggaatctcgaccccgagattcggaagaactggcgaagagatcgggatgggctgccttcagctcgtcttcacgctcccaagtagctttttcttcggcgtgattgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaaggcatttcttgagttgcgacacatggaacacatcatgcacgttgcccaaggaggcgggcagctccaactggtaagcgacttctccgcgtcgagcaatgatacggaaaggacccacataccgaggtgcaagcttccctttcgtctgaaacctgtgtacacctcgcaatggcgtgactcgaagatacacaaaatcatccactgcgaattccaggtcacggcgacggttatctgcataacttttctgccgtgactgtgccacctttagattatcccgaatgattctgactttagcttcagcttctctcaggatatcagtcccgaacacttggctttccccaacttggtcccacaggagcggtgttcggcatttgcgcccgtacaacgcttcatatggtgccatttgtatgctggcttgatagctgttattgtaggagaactcggcataggggagactcttatcccaggtcttcccgaaatctagtacacatgcgcggagcatatcttctaggatttgatttagacgctcggtctgtccatctgtctgcgggtgataggcggtgctgaaattcaatcgagtacccaactcttcttggagcttcttccaaaagtgagaggtgaattggcttcccctatcagatacgattttcttgggaacgccgtggagactcacgatcctagcgaagtagagctccgctagtttgttccctccataggtggtcttcacaggaataaatcgagctaccttggttaatcgatccacaactacccatatagaatcatatccaccttgggtctttggaagtccagtgatgaaatccatcccaatttcatcccatttccattcgggtacttggagtggttggagaagtccggccggtcgttggtgctctgccttgacacgctggcacacatcacacagggccacaaactctgcaatttcccgcttcatgctaacccaccagtatttctccttcaagtctaagtacatctttgtactgcccgggtggatggaataaggactttcgtgagcttcctgaagtatcagctgtttaagttctctgttatctgggacgcatacccgatttccattc

SEQ ID NO: 93610 - DNA, 957 bp, Oryza sativa
caaccgggggcacggaggtctgatccccgcgtccgtgttgaggtgacactccggacgaggaggcaccctccgttgcgtgggtagcacgtcgaccattacgccggcgctcgataccgatgcgggcatctggccccccacgctgatcttcccgggtcagaggtgctgacgagggagtggcagccgaacggcgagcaacagccgccgctcgccgcgccctccgccttgacgacacggagccggtggtagcagcgccagaggtcttggtggcggaggaccgcccaccaacacctaggtgctgccgtgccgtcatgaccaagttggctacgtcatccagccaacgttgggctggagactccgggtcagggacgacgggcgggtgacgtaggagcgcgcccgcagcttggagcgcgccctggggcgtgctaccgtcgccgtagacgaggaggcgacgctccccatctcggcgcccttctccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagagcttgtgcgcttttgcttgtttagccattgggctgaacaggaaaagcttggcgcacacgaaagagtatgagagcttagaaaaacacacgcagaaccccctacatggcgcgtcagatgacggagcgtggggctcctcaccgggagaccgcgcaggtccccctttgccggttcggccgggggccctgggtgaggttctaagctcctagtctgtggaatgttcgcgaaagtggaaacacacaagacacgggcaatgtatacaggttcgggccgctgagaagcgtaataccctactcctgtgttctggtagatctgtgtacgaagaagctacaaagagct

SEQ ID NO: 93611 - DNA, 843 bp, Oryza sativa
atgcagcgctatcagtatgcaagaagctgcaaacaacacagacctcctgacgtatgcttcgggatgttgcgaaacagccctgcagaaacaaaatccaatgtcaaaatcgtaccacttggttataactaagaaagtctttaacacggaaatgcttgttttaggcttggcagacctagatctgatcatatcaagaagagctggggcaacaactgatccctttgtatgcattgccatgcaattgacacagacccagcatgtatatcaatttacctaggacaacaaagtccggattgagcaagtcaacaccatgtgatcttttatcatatccttgcataacagggagcataaaagcagcagcatataaaggaaatctgttttttgaccactctgtctgcaaatccttagcttttccaagaccccatttaggagattttcctgatttaacttgaccagatctagatggaacttctctttcataccggtgtgaccaattcagaagtgttcctgattctgagacttccctccaaggacctgcaccagcaggtccctgatcactaggaactagccaagagggagaggtgtcggatatcaagtttccatgccgcagctctctccttacaattttagtttccgcaagctcctgtgcggcctcagtcataacatcaataatcaaaatgcgctgacttacatccacgcttgatgagtacagcaacttggtgagaacatctaatgattcaaatgtgcaggttaccagcaaggcaactaatgccttctgtctcttttcttcagcagaatcttcctctccttccattgccacgtcagaacatcgaacatgcacaagtg

SEQ ID NO: 93612 - DNA, 1107 bp, Oryza sativa
cccacgattaccataattcttaaatttattactgctattaaattggttcattaaagttcaagttgcttaggcaaataaaataagacaggctccgacacagttatgccacacaccggcataaccatgccccacacgactcaacaagaagacaaacgaggaagaacacacgcgcaagcctactaactgctcgtctactgctgcgacgggccagggcggaaggtgagcaacagcgcatcctccgtgctaccaacgccggaggcttccccctcctggggaaccacgggcgcgggctcggcacgaggggtctcgacgaagcaggtccacgccagggactgacgaacaagctcaggcctggaggtgctcttgcgggcggtgatcttctggctgcggcagacgcggcgacgcttggggcggcagacctctccctgggcgatcttgagctgatgcagctgcgcctccaccgcgtcgaggtccttcttgagctgcaggttctcctggcgcagctccaggatcttcatgttgttctcgaccataccgcggcgcaccatctgatggaagtcgatacgagccgcgtcgtacgcctccaccatgcgtgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagggtgccgatggcgaggagagcggcgctctggcaagcggcggggaaggagtctccacccgcggtgactgccaacgaagcccgctcagaagagccggcgaggatcactgcggtgacctcccacccagcgtggggctccgcgtcgtctccctcctgatccggaagcggcctggcctggtagtccactccgtgtggataccccaagaccacgcacatgcctcgcaactccaagacgaagcagtcatgtccaaaccatgacgggtgacgctgccggccatctacaaacaaaaacaaaaagagaaacaacattttaaaggtcagattttgatgataagtgaagcagcaagacagagagagactagacagttttcacaaataacaaagg

SEQ ID NO: 93613 - DNA, 5879 bp, Oryza sativa
caatccctagccagggggatcctcctcgcatcagcagcatcagcagcagcagcaacgtcgcccagcgcaccgacctcaattcgtggtgcgcgtcccacagccgcagcagcatcagaatcagcaagggactcgtgcgccccgtcctcatacgccagctgtgcagcccgttcaaggccgcagggacgctcaaggtcagcagcgtctgtgcttcaactgcttcgagcccgggcactttgcggataaatgcccaaagccaaggcgtcagcaaggccaagcgcctccccgctccaacaacggcgggaaggatgtctgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgtagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaacaaaacagttaagtaattaaacaatattaagccaacgctatacaacataccctgttgtataggcccaaccattctgaacaaccaccccggctgcacagttctatctccaaaccaggaatgtaccattccaaaccaggagctaatcaaattattaccagttatagcatcttttataatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacaataattaattaactaatcacgattgaccatcgtgaactatcaataagccatcatgaaataatagtgaatcattagttatcccataagtgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccggcgcatgggcggcggttcacgctaacggacggccgagattgatccgatccaaatcggacggctgagattgatcgagtccacggcggttcacggcggacggccttgatgacgccagcaatgacgtcaccgacggcggcggcggctcggctaggcagacggctcgggcggcgcacgctcaccggcgaacggcggcgctacggcacgaacggaggacaccaacgggtagcggacggcacggcgaacacaccgacgaccaaaacgacggcggagaagcaacggacggcgacggcgacgagaaggaagcggcggctaccttcgggttgtcgacggcgacgaagctccagcgggttccgacggctgcgaaggggcggacgaggacggcggcgacttggcgatgacgacggcggtcttcccgagcggcggcgacagctggagcgacggcggagcacggctgaagcggcggcggcgacggcgaagctagggcacacggcgctagagctactccggcgacgagaggcgaaggcgagggctgcgacgggtagaggagacaccgggggtccttttaaaggggctcggaggcggcggcgaaggcccacggcgacggcaacggcgaaggaaactcgcggcttggaaagagggaaaaccgatccgaatcgaactcgattccaaagctttccaaagcgatttaaccaaagattccaaaggagaaaaggtagaggagatcccggagatcatttcccctctattgattcggccggagaaggaaagaggcggccggatttggaaagcggcggcgacggcagctcggcggcgcgaaactagggtttcggcccgaggaagacgacgactgacgggtgggccccacctgtcagcggccgaacgcgcgcgcgcggctgcggactgggccggctgggccgaggagagagagaagagaggttttgggccgactttcggcccaaagccaaaagaagactttttaaaacctttttcaattaaaattatttcttaaatgcaattccatttattaaaaatactttcttagctcaaataaatcccagaaaaatctaggaattatagaattaagcaaagtatttaatgaaattttatctggcccaattttatattggaatttattaattaaacatagattttcttttcaagacttttaaaattatttctaaaaattccatttaaacaacaatttatatattttgaattttcagggtgtgacaatgtcattcggggccgtgtgaatcatgtgacggccgaggacgtgctgacaactccagacgtcatcgttggtacgttcctcgttcattccatccctgctacaattttgtttgactctggagcttcccactcgtttatatctgtgcgattcgtggggagaaatcagttgggggtagaaaggcttagaaaccctctgctcatcaccacccctggaggggttatgacagcaaagtattatagccctgccgtccctatagaaattcaggggattccttttccctcggatctgattctgctagacaccaagaacttggatgtgattcttgggatgaattggttggcacaattccaaggagtagtggattgcgcgagacgcactgttactctgtaccgagggccagaacaaccggttgttttctttgcacccccaacctctgtcagaagttcagaacttcatcagatagaactgtcagaaattcccatcgtcagagagttcggagacgtgtttccggaagaactacccggtatgccgcctaagcgagagattgagttccgaatagatcttgctccaggaaccactcctctgcacaagcgaccctaccgtatggcagcaaatgaactagccgaagtaaagaaacagctggaagagttgaaagaaaaggggtacatacgtccgagtacttccccatggggtgctcctgtgatttttgtagagaagaaagacaagacgaagaggatgtgcgttgactacagagctctcaatgaagtcaccatcaaaaacaagtaccctcttccccggatcgatgatctgttcgatcagctcaaaggtgccactgtattctccaagattgatctccgttccggatatcaccaattacgtattcgtgaagaagatattccgaagaccgcattcaccacgcgatacgggctgtatgaattcacggtgatgtcgttcggtttgaccaatgcgcctgccttcttcatgaacttaatgaataaagtgttcatggaatacttggataagtttgttgtggttttcattgatgacattctgatatactcacaaccagaggaagaccatcagcaccatctccgtctggtgttgggaaagttgcgggaacatcaattgtatgccaagcttagcaagtgtgagttctggttgtccgaagtcaaattcttagggcacgtgatatctgctaaaggagttgctgtggatcccgaaacagtgaccgccgtcaccgattggaagcaacccaagacagtcactcaaattcgcagtttcttaggtttggcaggatactaccggaggttcatcgagaacttctccaaaatcgctcgacccatgacacagttgttgaagaaagaagagaaatttgtgtggagcccgcaatgcgagaaggcgtttcaaactctcaaggaaaagctggtttcctcgccagtgttaatcttgccggatacccgcaaggacttcatggtgtattgtgatgcttcgcgccaaggattggggtgcgtgctcatgcaggatggtcatgtggtagcctatgcctcacgtcagctacgacctcatgaaggcaactaccctacacatgacttggaattagccgcagtagttcatgctctaaaaatctggcggcactatctcattgggaatcgctgtgaaatctataccgaccataagagtctgaaatacatcttcactcagtcggacctgaatcttcggcaaaggagatggttagaactcatcaaggattatgatgtgggaattcactatcatcctggtaaggccaacgtggttgccgacgctctaagtcgaaagagtcattgcaacactcttaacgtccgtggcattccacccgaacttagtcaacaaatggaagccctgaacctaagcatagttggtcgtggattcttggctgcgttggaagccaagcctaccttgctcgatcaaatccgcgaggctcagaagaatgatccggacatgcatggactcctcaagaatatgaaacagggtaaagccgctggtttcacagaggatgaacacggaaccctatggaacggaaatcgggtatgcgttccagatagcagagaacttaaacagctgatacttcaggaagctcacgaaagtccttattcaatccaccctggcagtaccaagatgtacttagacttgaaggagaaatactggtgggttagcatgaagcgggaaattgcagagttcgtggctctgtgtgatgtgtgccagcgtgtcaaggcagagcaccagcgaccggccggactcctccaacctctccaagtgccagaatggaaatgggatgaaattgggatggatttcatcaccggacttccaaaaacccaaggcggatatgattctatatgggtagttgtggatcggttaaccaaggtggctcgattcattcctgtgaagaccacctatggagggaacaaactagcggagctctacttcgctaggatcgtgagtctccatggtattcccaagaaaatcgtatctgataggggaagccaattcacctctcacttttggaagaagctccaagaagagcttggtacccgatt

SEQ ID NO: 93614 - DNA, 1579 bp, Oryza sativa
cagctcggcggcgcgaaactagggtttcggcccgaggaagaggacgactgacgggtgggccccacctgtcaggggccgaacgcgcgcgcgcggctgcggactgggccggctgggccgaggagagagagaagagaggttttgggccgactttcggcccaaagccaaaagaagactttttaaaacctttttcaattaaaattatttcttaaatgcaattccatttattaaaaatactttcttagctcaaataaatcccagaaaaatctaggaattatagaattaagcaaagtatttaatgaaattttatctggcccaattttatattggaatttattaattaaacatagattttcttttcaagacttttaaaattatttctaaaaattccatttaaacaacaatttatatattttgaattttcagggtgtgacaaacctaccccccttaaacagaatctcgtcctcgagattcggaagaactggcgaacagaagcggatgagctgactttaattcatcttctcgttcccaagttgattcttcttccgagtgattactccattgaactttgcagaaacggataactcgattcctggttcttctctcatttgtttccagtatacggattggtttctcaacataagtcaaatcctcttggacttctatctggtcaatattagcttcttcggtaggtacccttaaacactttttcaattgcgacacatggaacacattatggactcctgccaaggattgaggtaactccaactgataagcaacctctcctcttctgctgacaatcttataaggtcccacaaaacgcggtgccaattttcctttggtctgaaaacgatgaactcctcgaagaggcgtgacacgaagatacacataatctccttcttcaaaactcaaatctctgcggcgattgtcggcataactcttatgacgagattgagccactcgcaatctttcttgaatgatctttaccttttcttctgcttcccttaggatatccgtcccgaaaacctgacgttctcccgtttgatcccacaaaagcggagtgcggcacttccgaccatacagtgcttcgtaaggagccatctgtagactagcttgataactgttgttgtacgaaaattctgcatagggtagattcttatcccaacttccaccgaaatctagagcacaagctctcaacatgtcttccaaaatttgattcaccctttcggtttgtccgtctgtctgcggatgataagcagtactaaagttcaacttagaacccatctcttcctgaagtttcttccaaaaatttgaagtaaactgactgcctcaatcagacacaatcttcttagggacgccatgcaaacacacaatccttgccatatacaattccgccaagcgacttccagaataggttgtctttaccggaatgaaatgagccactttggtaagtctgtcgactatcacccaaatagagtcatggcccgatgacgttctgggcaaaccagtgataaaatccatacctatttcttcccatttccattcaggaatcttcaaaggttgcaacaaaccgggctgcagg

SEQ ID NO: 93615 - DNA, 1159 bp, Oryza sativa
gtgcagtgcagtgatgaagagaaagtcatcttcgccgcccaccagctgcagggacccgcatctctatggtgggaccacttccaagctacgcagccagagggacagcctattacatgggctcgcttcaccgccgctttccggagaacccatgtgctcgccggagtcgtggccctcaagaaaagggaattccgagagttgaagcaaggcaaccgctccgtgatggagtatttgcatgagttcaacaacctggcccgttacgctccggaggatgtgcgggaagatgaggagaagcaagagaagttcctggcaggaatggaccccgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccagccgtgcagcctggtcaaggccacagggacgctcaaggtcagcagcgtctgtgcttcaactgctttgagcccgggcactttgcggataaatgcccgaagccaaggcgtcagcaaggccaagcgcctccccgctccaacaacggtggcaaggacgtcattcggggtcgtgtgaatcacgtgacggccgaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaagttggatgtgatccttgggatgaattggttggctcaattccaaggagtagtggtttgcgcgagacgca

SEQ ID NO: 93616 - DNA, 1072 bp, Oryza sativa
attggcattctcttttttttttttcctcctatttggttcatatatagtttcactcatagttccatactaattgcattgactactgtatattttccccctgcaggtcttgcgtggacagtgcggacgtggtttcttacatacatgaccgtttatcggtggtgagtcttttctttccctcagtttgtcttcttggcaggacaagatatcttagtggtgttaatcatgctatctgttctaggaaatgacttcaatcaagcaatgtaaatatcctgattttctcttttcttttaaaaaaaaactgtgtaagccctaaacctcacaaaaccatttgttagtttagcactgaatatgcatgcctggctgacaaactgccatctgctttgacttcgattctttcgctgttaaaactgctgttaccaataatgctgtgaccaattaatattgctatgcaggagggtgcagagctgcgtgtcatctgtgaggaggttgttgagttcggcttggcatcgggcgagaacactaccgtcatcctggttcagttcaagcccggcgccttccagtaccagctggtggatcccgctggatttggcactgccgtctctaacattgccagcaccagtgctgcgccggctggtgccagcgacacaagcgacgagggcgtcgatgacgctgccactgccaggcccaccgttatgggctacgacgcggactccagcaccggcagcgccgatgccacggtcgacagcgacgaggtcgatcccaacgccacggctgacagctacaatcccagggggcacgctgagatcgttgccagccacaccgacgacgaggtctacaccagcggcagtgccagggttgagagcggcgagctcgccgtccccactcccagcgccaacaacaccgtcgcggatgatgtcaaggtcgacgccgctgtcgtcgccggcggcagtaccaccgccatggctgctgacgaagccaccgtggtgtcgttgttgtcgaccatcgtggataactactactccattaacaccagcgaggagccagcgaggaggttgatcccactgccactgtc

SEQ ID NO: 93617 - DNA, 620 bp, Oryza sativa
acggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaatcctatttattgcgtcagccgagggagcagggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacagtcgggcccacttggcagccgcgagggcgcgcccgagggcggactcgccggcgcggtcgacggaagcggcgcgcccgcgccccgatggtcaccgccggcgaccaccggcgcggcggatcggcgcccgagagagaggagggaagggggaaggcgaacggcggtcctcggctcaccccgggacaacgac

SEQ ID NO: 93618 - DNA, 796 bp, Oryza sativa
agaatatatttggaacctggaacaactccgatccataagagactttatcgaatggcagccaatgagttggcagaagttaagaggcaagtagatgatttgctacagaaaggatacatcagaccgagttcatcaccatgggagctccggttatttttgtggaaaagaaagaccatactcagagaatgtgtgtggactatcgtgcactaaacgatgtgactatcaagaataagtatccactacccaggattgatgatttgtttgatcagcttaaaggtgccactgttttctccaagatagatcttcgatcagggtattatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactctcgaaccaaagaagagcatgaggaacatcttcgtcttgcattggagaagctacgagaacatcaactgtatgctaagtttagcaagtgtgaattttggttgtccgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattaccggaggtttatagagaatttttccaagattgctaagcccatgacacg

SEQ ID NO: 93619 - DNA, 2576 bp, Oryza sativa
  unsure (1)..(2576): unsure at all n locations
agcccgacgcaggccgagttcgcgtcggcgctggcgttcgcgatcggcggcatcctgccgttgctgacgagcgggttcatcaagccgtggggccccagggtcggcgtcgtgtgctgccgcgatcagcgtcgggctggccggcttcggcgccgcggacgggtacctcggcggcgccaacatggtgaggtccggctctagggtcctcctcggcggatggctcgccatgctcatcacctacgccgtgctccggctgttcgcgacgatctttcacggcatgaacatctcgtcgtcggcgtgatgatgcgtgtgacgcagaaatcgatctatctggagatgaaaaagaaaataatccaggggttgtgctagctagctgtttaattaactactcttggtttgccagtagtgctgtacctagtggctgattattaactaccgaatccctggataccgaactgggaataatcagggggtgtaagtgtaatggttntttgatttgtgatgaggcaagaccaggcaaatggtctcaaatgagaatattggtgttaattattgtataccgattcccttctcactttgcctcccgtttgtttttgatttgtctgtgtctctgtgacagttcagaaactagctgatgctcttggttgcaatatccaggtgtgccactggcacgttgaattgtgtttggttgattggccagcaaatgccaaagaatgcgttgaaggtgcatccgggattgccaatggtcaaaggaacttgtaccaatggaaaagaacagtttagaacacagaaaacaagaacagtgcacagattgtcatatgccccctcagagagtccagtaaaaggcccagttcatcttgggcctatttatgccacgaaagcccatcttcataaggaatataggccttcttcttccacactaaagttcagatttctttatatagaattaaagttacagacttgcgaaacttacactacagaaaattacttttgaggtgtaaaaaaacaagcactcgaccgatccaacgaaaatatctggtgatcacagatctgatgatctgttagcctcgagatattctgcacctgatttctcgatcttatagcatagaaaattatcaatccagtgacccggttgcacaaatggaaggtagaataatataagaaaaaggacgatacagctggaacgttgacaaaagaaagataaacacggttgctttcactacaaattaaaatggtataatactactccactaccaataaaagttccgctacaaccgtacgcaatattcagatcttagcaaattgaactggagagcatttctcaaagaagaaaaccaaaaagcctaactgaaagtctgaaattcaactggaatggatctctcgacgaaagatttcattttcttttggagtcctgaaagccaaaagagagaggccgctggttttgcgagccatgagcccatgaaggctacgcttcccacgggatcgtctgattcgtctccctcctctcgtcggttcttcccaacctctcccaacttctttttctggattcttgtggccgccacgcgccaccgcggtttttgtaccaactggggtacgaacgagagacgacctcgcgcgcgcggcgcgaaagtcgcatgtgccaacggcatcgtgccggcctcttccaccggatccctctttttctctatctctcgtggcggccacacgcctcttgctaatttaagccccccaacttgcacgtcggattcgtcgcgatcccccggacagatcgcgttgtcgcatggcggccacgcgcccaccgggtagtttattcccatcgcgacgaatatttcggccatgtttccatctcggagcacgtaatccgggatgctttaggtgaactgctccacgcctccacgtaccaactaccacgccaacgccaaagccaacgccaaagctcaccgtggtgtgtggtggccctttcttgatgaaagtcgtctgctccctgtacagcagataataatatgctcgcggttttggcgcgccttatgtttaaaaagttttatctttgaagaacagataataatatgtttgaggtcgtggctggcgtgaggtttatggaaacattatgtttactcttggtcggcttatttttatatataagttgggacagctggattcttatgatatatctagattagtcgtcggtttgcttgttacatgtataatagtttaaggctcgtgagtcgtgatgtcctcgagcttagctcatgtgggcgtggctaaggctccaaatgagctaggatgagcatatatatgcaaaagttcatgagcttggttgtgtgatgcaaataaactataagattaggtacaaaactagtatttatctgcataataaaatagtatgtaggagtgtaaaatatctttcatagcatttttcttgtttgctaattttaaaatttaaattgtgttttcctcctttttatcatggattttttttctattggatacagatattatctcattaacaagctttcagccaagctcagatttcaaatatgttgagcttgagcttgcttggaagcttgagtattctatag

SEQ ID NO: 93620 - DNA, 715 bp, Oryza sativa
ctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcttggatgaatctggcctccagaagtcgcgccacctcctcgcggatgaaggcttgacgttccggggcctgccaccgcactttctgccggaccggccttgcgcccggccgtacggcgagacggtgctcaatcacctccctggggaccccggtcatgtccgccggtctccaggcgaagacgtcggcgtttgcccgcaggaaggagacgagcgcgtcttcctatttatcgtccagaagaccaccgattcgtgtggtcttggacgggccgtcgcccagggcaacctgcttgatcgggacctcgtcgcacgtgatcatccgatgcctcggggcggctgggacggaggtgctgagcctctcgtcgccacccgcgggcttggatgccgcggcgaggtggtccgcgcgctgctccatgcaagcaagcgcg

SEQ ID NO: 93621 - DNA, 1456 bp, Oryza sativa
cgggcatgcttctcgggttcttggtctctgcccgaggcattgaggccaaccccgagaagatacgagctatagagcggatgcgccccccagcaagcttagggatgtgcaatgcgtcactggctgtatggccgccctaagtcggttcatatcgaggctgggagagaaggcgctacccctatttaaactcgtcaaacgctccgggccgtttatctggacggaggaggctgaacgggccctcactcagttgaaggcgtacctcagttctcccccagtcctggtcgccccggagccagatgagccgttgctactctacctggcgggaaccccgcaggtggtcagcgcggcgttggtcatggagcgcgacgaggacgaccctcgcttcgcgcatccccaccctgtgtcgactcgacccgggagagagcagggaggagaggcccccgagccgaacggtggcccaaggcccccgacggccggagctggccctccgcccgcttgtccgaaggtgccaggcgcccccgacccccaggatggccacggggccactgcgggaaggccgcgcctgtcgccctctgaccccgaggtcatcggcacagaagccgagtgcgccccgcgcggcctctcggagcgtgacgaggacgatcctcgctctgcgcgtccccaccctgtgtcgattcgacccgggagagagcagggaggagaggcccccgagccgaacggtggcctaaggcccccgacggccggagctggccctccgcccgcttgtccgacggtgctaggcgcccccgacccccaggatggccccggggccactgcaggaaggccgcgcctgtcgccctccgaccccgaggtcgtcggcacagaagctgagtgcgccccgcgcggcctctcggacgaagagcgccctggaaatgcggcccctagtgaagaagatcggccccgccgaaaggtgtagcggcccgtctacttcgttagcgaggcccttcgggacgccaagacccgataccctcaggcctagaagatgctttacgctattctgatggcttcgaggaagttgcgccattatttccaggcgcatcaggtcacggtggttacgtcctaccccctcggccaaatcttgcataaccgagagggtactggacgggtggtgaaatgggcaatcgaactctctgagttcgatttgcactttgaaccacgccacgcagtcaagagccaggccctcgccgactttgtggcagagtggacaccggctcccgagcccgtctccatccccgaggccagctcgggcccttcgcagctgcctcacaccgcctattgggtgatgcagttcgacggctccctgtctcttcagggtgccggtgcgggggtcacgttgacctcgccgagcggagatgtcctcaaatacctggtccgcctcgactttcgggcaaccaacaatatggcagagtacgagggactc

SEQ ID NO: 93622 - DNA, 1110 bp, Oryza sativa
gacctcgtcctacgccgcgtccaaaagcgtgctggactgagcaagctctcaccaatgtggaagggtccgtatcgagtgatcggcgtccccgggccgggctccgttcggctggccacgggcgacggcacagagctgcctaacccgtggaacatcaaacaccttcgtcgcttctacccctagtgggggtcgggtgtcaggtctcgggctcgggccaaccccgcaccccgcccgggcgtgcagggttggccgggggctaccacatgcataagcttatcttttttctcttccgtatttcaataaaagcattttcgatttcctaaggactgtgtctgtgccattgtttcctttcgaagaatcttggcttgaattagcacgctcgtgctcgatcctgccctcagtggcccgggccggctaaaatcgccaaacggggcccagaaccgagccgtgccccggggcgtggtgaactccgggggggaatcggcaaaggcccacaatcgggtccccataaccctcggtcaccgcgctcccggcctggccagtctcgacacgtggatctccccaggcactagccccgacccgcgccgtttgaggctgggacctgggcacgagtcctcgttcaagccaagacacagaaggaccgcggcacagaccatcctcgtctcatatacacaacgaacagagctgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcgtcgctgtcgtccgcaccaccgtcgccgccctcctcgtcggagtcgagggcgaacgcgagccgaggggccgtaccctcgaagctgtggacgatgtggacggcggcgtcccggacctgtgcgcgcgcgccatcctcggttccaggagagaactcgtccagcgctgcccacggggagaagtccgggtccctggcctagtagcttgccagtacgagctccaccgccccccgggcgaggtccctcgaggatgacttgatcgtctcctcgagctcctcggg

SEQ ID NO: 93623 - DNA, 903 bp, Oryza sativa
tcagtggggcagcggaaggcatgggggagagccgcctcggtaaggatgccgcacggctcgtcccaccgatcgacgtgccggactcagggacgtcccccgaagctggcccgtcctgagcgtcgcccgagaggtcgggcccgagcggtgcgcccgcggcctcgtcgtgggtggcctcggaagtcgtcgtcgcctcgggcggagtcgggtcggaggcttggcaggccgcccggcgtgcgcgcgccgcctccgtctcccggacggactcctcggcccggtggagtcgggcctcctcccaagcggcttcctcagcctggcaagcccggacagcctcctgggcagcttcctcggcttcccggaggcggtttgcggtttctcgccggtcagctctccgcctccgggcctccgcggtcgccgtctcctcggcctcagaccggccggacttggaatggcgggaagggcgcgacgggatctcgctgaggtagaagaaaaactagaagacgaaaaacgggtgagtgaaaacttgccttgggagatgggagaatgaatacggccgcagtgggcgcagggacgaacctgcgaggaggtcggctaaacgaccaccttgggggggagatgaggtttccccggtatggttcggtcccccccatcttgtggagccgcttcttttttcgcttcccctcgggccgcgacgtcggcacagcaccctccgggcgcctgctgctggcacgcaccgccccgccccctcggggaggagatggggagggggtatcctcctgtttcctcttcccccgggcgtcggtagggcggctgccccccgggcccccgtcacggggcccagaagcacgaccccctcccggcgtagattgttcccccctgcggctcccgcccgcgccatcgtggcct

SEQ ID NO: 93624 - DNA, 1218 bp, Oryza sativa
aaaaattgggttcgaatttttctctggttcgcttgtgattttgtgggggctaaagaatcaatccttcggggctcggagcgatggacgtggaccagctgatcctgttcgtctttgtgtgctgtttgtcctcgaggtttgctggtgagctctgtgatattcaagtcatgtttgtttcccgtgctgtttcttggacatcgccgtcgtgtttgccctccgagtgttgttcttaggtttgattgattgaactacggtcggtgatttgttttctctatgttttgacagatgcgtatgatccggtagatccgaatgggaacatcataatcaactgggattttcagagcatcgagaacgtctacacggtgcgcatgcctgctagtgagtttagtactgccgttaatttttcactgtttgggatcatcccagtagtagatatgcagtcgaataaaagattcagaatttcagacgtaccatcgttgcaactatcctttttatctcgattctaacttttccccattatttcctccggtgaaacttatcattagtacagccgaaatacgatattctgacaaaaaaaatttgacgttcgcaaccgccaacaccacgaatcaatcgatatatcctgtgcttatgcaggtcatggtgagcgtccacaatcaccagctgtaccgccacatcgagcagcccgggtggcggctgagctggaggtgggctggcaacgagatcatctggggcatgacgggcgcggaggcgacggagcagggcgactgccaccggatccgtggcgccacccggccgcattgctgcgagaagcaaccggtcatcgtggacctgccccccggcacgccgtacaacaaccaggtctccagctgctgccggggcggcgtgctgtcgtcgctcacgcagaacaaccggacgtccaccgcggcgttccagatggtggtcggcggcttcaggcgcgccacgtaccacgacggcgacaggggccccgcgctgccgtcacgcttcggcgtcggagtgcccgggtactcctgcagcaacgccaccaaggtgaacgcgaccaggtcaccgatcggcaggaccggcacgtccagtctctgcgtaaggcttctcccctttctttcttatcgcggcgcgtgcgttgagcgggagttctgagcgattcttgctgccgcgcgcgcgggcgccgtgtgcagtgacatggcaggtcacctgcacgta

SEQ ID NO: 93625 - DNA, 855 bp, Oryza sativa
tacacttccagcaacaaaagaacccaagatttatgaatgctcagaggataagaataatttctgtgctaacaaaacttaccttcacccacgttgacatcaatttcctgtacaacagttcaaaaaaaacaaatgattgatttcgtagatagcaagcacagcagaagacaattcaaaaaaggaacgcaaaacaaaatataaggacaaatatttcatttactgaccattgctgtcatcccacaatccaagcagctccaaggcccttgctcccagaatcaacacatgcaagagcaacaaaagccaaaacaaagttgctaaaaagtacacatataacccagtcaatatcacacagagaacaatagaccaaaaaaatgaaaatgtcatgtggacacatctaaaaattatagataagaatatcttgcacatctgaaattagagacaaaaattcctcaacagttgctatctcagataacttgtgagataacgggcaccacactaaacctaaaaattccatgctaagcaatggaagtaaactagagacagtatgtcaagcttctatcaaggaagaagcctcaggtcaatctatattctaccaagagaaatagagataacagaaaaaaaacagtacaaaactaggcctcattactaactagcaaaaaaaaaatatatcaggcacatatctaagaaaataaagatgcctagggttccccaaactacaagtctctgataaaaccaatatcaataattaacaatctaactaccaatagtcagttacagtgcgaaataataaaaattacaactgtaactaaggtatatttccactgtaagtggtgtgagttgcactgtaagtgtgtttta

SEQ ID NO: 93626 - DNA, 751 bp, Oryza sativa
  unsure (1)..(751): unsure at all n locations
cctacaactacgagatggtccaccgcgtcggctccttcgccgtgccgctctcccgcgacgaggaggccgccatgcgctcctaccagttcgtccccgtcgagacgcagcacggccgcctcgtcgtctctgtccagtacctccccagcctcgctgccttcaatctcgagatctcctccttgtcgccctccatgctgatcgccgactacgtgggcagccctgctgccgagccaatgcgtgccttcccagcttcgctcacaggagccacaggttccgctttcccgcaggcgctgtccaatcagccgcagcgcccgcacagctgggcgacgccagcgctctgcccgcaggcgcctaggcagcaagctagattttcgccacctcatttgctcaacgcatcacccactccatcgccacccaattttcccagcgggtatcttcaatctcgtcctaagggagggtctgcaccaatgagcataccacaggtgggtgacaggaggagcccaattcaccggccgatcacattgccaccaacgtctccgaggagagtaggggagacaggaacatctagtgcacaacagtctccatcagagagatgcccctcgtttgggagggcagatggatttcgaataatggatccctatgcaagcctgtcgccaggacgcaaggtgatccatggntttaaagcctacaatatgctttcaacttatattcgatacttgcgtatgccttatcttcatcactgctcaatactgga

SEQ ID NO: 93627 - DNA, 1144 bp, Oryza sativa
tatgtgcacgatacacaggcatacctgggtaatgatcaaagtatgaatttcccatttcctgtgtagggtagaactttacatcattgcgcacctgccgtaattttactaatggtgtacgaatagaagcctgtcaaatagcttaatatattcttttcgactaaatggtttgctgagagcatccaataacctctgcttgaaatctgaatccggtctactgttgatatgtgccggccatataacaccttgtgacccctgcatattataatatttttaagtaataagagaagtgcatcatgtaaacaagaggagaaaaaacccttatagtagattttattgtttgtgagataaatgcaaaattgccagatcaattggagaacaatgaaatactttagcatgtacattacataaccttagtatttgagactaattcttctttgaagagtccatatgggtgttactgttactgttccataattcaagtaggggaaaatttgagaaatatcatcacaaagatatgtgagcctggaccctctcgtgtcaatgacacatccgatggtatttttcaactcagtgatttttgcggtggtaataggcaaattggcccataaagtggaggggatgttcagcgtgaatttgctagagaatagtgttctggttggtacaatacagtatcagcttattcatacatgtccatcaacaggccttttgttgaatcgtactgaaatatcgaagactactatcatcttcttttgcgtatattctattaggcgaaaaacagagaactatttctggactgaaaacgtgtatacgctgctcaattcaaagaaacaacagtgccacaggtaacaacgattggagatgtataaaaaattctcaccggggggatggaagggccggcattattggaattgcttgaactcatcttcctcttcttcttactatctaatgttcgcacggatgcgtcacccaccgccacccagtgcatacttttgggtccggaagaattaccaccggctcgtctgaatccatggccacctctttctcccgcgcatcctcgacctcgctgctgctctcggaggacgcggcgcacgggtaggtgacgacggcgccgtcaatctcgagcaccatgttgtcgttcaccacg

SEQ ID NO: 93628 - DNA, 552 bp, Oryza sativa
ccattgttgagattgaaagccaatcagctgtttacttggggggcagagcaatagaaggctttggataatattaaggaatatcttagctctcctcctgttttgattcctccacaaaaaggagtaccttttagattatatctatcggccggtgagaagtcatcggctcagttttgattcaggagcttgaaggaaaggaaagggttgtattctatctcagtcgtcggctcttggatgcagaaactagatattcccctgtggagaagttatgcttgtgcctatatttttcatgtacaaggttgaggcaatatctactatccaacgaatgtactgtcatatgcaaggccgatgttgtcaaatacatgttttcggctccaattttgaaagtaagggttggaaagtggatattctctttaactgagtttgatctttgatatgagtcgccgaaggcaattaagggacaagctatagccgattttattgtggaacatcgtgatgattcaatcggctcggtcgagattgtgccatcgactttattctttgatggatcggtgc

SEQ ID NO: 93629 - DNA, 3664 bp, Oryza sativa
gattgagatagattaatctctattggccgtaaactaaggcccgtcaccgatgattcattttccatctttcatttgttgtgagtgcaaaatatatagctgctgtgtaataattcattttattagtcataatacattttcggatagtaaatgatttcaaatggaaatatgttcaaattttgttagtcataatacatttcaaattttgttgtagagccgttcaagatctactagttttattttggtcatttttctatataatttttttcccaacagcttgaaattgattttgacaatatgacaaatctaattaaccgcatttgtaaatactaaatgatttcaaattgaaatatgttcaacaacaaagttgatcctctcattaggatctacaacttttattttggtcatttataataaaacaaaattagccatattaatgactacacatatcaagtctttgcaataaaacaaaatacttcattcatttcaatagataagtacaaatgcatcagtcacaaggttatgccttccgtatgacctgaacgagcatatgccacaggctcttggggatcatcgtcaaggtcaatgtgaggtcttacatgaagattatggttgtattcttcttcatcgacgacgttgtcaactcctacaattcggcgctttccatccctcacgatgtacatcttcttgtttgaagggtctattatgtagaatatctgctcgacctgtttcgcaagtacaaatggttcatcggcgtatcccaccttagatagatctactaaagtgaaaccttcattgtcggctttggcaccagtgcgtagattcacccaatggcagcggaacaaaggaaccttgttcttgacgtagtttagctcccagatctcctcaatgcggccgtagtatgtgtttgaccaacttgatcctggaatgcatctatacggacgccgctgtttctgcactgtgcttttgtcatcttgtttaacggtgtaaaatgtgtatccatttatatcgtatccttgccatgtgtctacggttccatccccaacaactgtactgtctcatttgggacatccgtgtacattgtcacacgattcttgaaccattcgttaaaccgagaattatgttctctgttaatccatgcatcagatcgccccaagttctcatctcggattttcgctaagtgctcctcaaagtatgggccaacttctgccatatgttggagcacagcgtaatgagcctgcgcgtacgacgcttgatcgggcctaattcttttccttccgattgtgccaacacctgacaaccttccctcgtgacgagacgcgagaactccaataggatcggcatcggacatgtaattcacacagaactcaatagcctcctcggtcgtgtaacattcaatgatgctccccatgggtttagctctgttacgaacgtacgacttcagaactcccatgtacctttcaaacggccacatttcgcttagaaaagctgggccacatagttttgtttgcttcaccagatgaacagggagatgaaccattatatcaaagaaagacagtggaaaaaacatctccaggtgacagagggtattcacaatatcggtctgcagcccatctagatcttctggatctataaccttctgtccaattgcattgaagaaggcgcacagacgttggatcgtgtgacgcactttcggtggtagaatgcctctggtagcaactggcaagatttgtgtgattagcacatggcaatcatgagacttcattcaaacaagttctagatcgtccaatttaacatgcttacttatcgtcgctgaatagcccgatggaactttaatatccttcaagcataataacattgcgatcttctcatctttcgacagtgtgtggcaggctggagggaggtacactttacctagctgtgcatctcgtataggctggagttcactgtagataaaggcgcgcgttcaacccgtcctttgtcttcccggaaatattcaacatcaggccaaccaaactctcacacacattcttgtctacatgcatgagatcaatgcaatgacggacatcaagatctttccagtaaggtagccgctaaaatatggattttttcttccacatacccttctcctttgtcttgctacgttttcttttcttcccaaactcattgcttatgtccttgaccatattgtggacctcatctccggacaaatctttgggagcaggctgaagttctctcttaccgttaaaaaatttcttctttcttataaatgcgtgacgtagcgggagccacctccggtgacccatgtataccatctttcgtgatttcttcagccaccggcttcgtgtatgttccttgcaatcggagcatgccttctttccttttatagtttgtccggaaagattaccgagtgcagggtagtcactaatggtgcagaacaatagaactcttagcttgaagttctcctgaccatatgcatctcaagtttccacatcttctttccaaagaatctccagatcgtcgataacaggctccaggaatacatcgatatcattgccgggttgccttggaccttggattaacaagcacaacataatatatttccgtttaaagcataaccatggcgggaggttatagttcgcaataagaactggccaagtgctgtgagtactactcatgtcaccgaaaggattcatgccatccgtacacagacatatcctcatgtttctatggtcggcagcaaagtctttgtgttttcgatcgatattcctccattcagtcgaatccgctgggtgtctaagcataccgtcgttccttctctccgtggcgtgccaacgtactaacttcgcttcgttcgggttggcaaagattctcttgaaacgatcaatgataggtagataccacacaacctttgcgagaccacccctctttgacttatttcctttgtcagcacttttctttcgcttgtatcgagaagccttgcagacaggacaagcatccaagtccgcatattgcttgtggtacaatatgtagtcgttgggacaagcgtgaattctacggacctctaaccccagtagacacagaacctgctttgcttcgtatgtcgtctcgggtaatgtgttctcaacaggaagcatagccttcaaaattccgaaaatatctgtgaaactcttgtctgtccatccactacttgccttcagcttcattagggccaaggtaactgacaacttagtgtgtgttgcttttgcatccagcgtacagaggcgtctcggaaccacttaccaacctgctgaacttcattccatctctctcattctgggctgggtcctcaacatcacgtaacatgtcttgcagtagatcgtgatctacatcaactatttcaccgcccaatggagaaggtataaacatgtcatgctcatcttcatcttcctgattatacgcaccacttctatctgctgctactccacttcttgattcttgctctccatgcttcacccaacatgtatagcccttcatgaatcctcgttgtatcagatgaccgtgtacgtcctctccgctataaaacatattctcattcttgcaatctgcacatggatgtcacgaccggaaataacccaccgggcgtctcttacgtgcgtgtattattccttgtcccatgaggcaaggt

SEQ ID NO: 93630 - DNA, 1102 bp, Oryza sativa
tttcacaagagtaagcatctctcttcggcttcttttgtaattacctcactcttcggctaattactcatagactttgtgtttacagaagaagaaaactgctgtgaagaagaaaccagcagcaataattgtcaagtcggccccaccagtaagatatctttaattcttttactagtcaatctcaaccaacactatataacacttgcatattttatagccacctcctccttctcctcctgtacagcaatcgtcgagtgaccgggctctatcgactgtagggagtcatcatattgaggaggaagaacaaccagctgctcctactatcccagtaagtttccttttgataaaagaaattagatcggctatattgacctagctctcaaacttcctgaaattgttcctgcaggttctagtcgatctcttctcttttgacatcggagattatcttgatgaggcagaagaggatatttcaagcaaagctctagcccccttatctgacgatgtgaagaaaacagttgaagatatctcccgttggctagaggcctcttctttagatagcttggtggtcgactgtggatcgattaggacacgactacatgaagttcaagctctgattcccgaagaactagccgatgtcctaactccagccgcttatcttgaacaacatcaattcaagctgaaaaaagccaagctaagactagccgaacgccgtgagcgcaaggagattgaagccacaatccaggtcaatcggcagcttatgcatgaagaaaaagtcaaactcgatcagttatccgagggtccgattaactccaatattaatcggctcgaagctcgcaagattgatctcttggcacagctcgaagaatgcaatgctgaactagacatggaccacaaaaagctagccgatctcccaaaatctgtcgaagagcagaaagcaagactcaaatcggctatcaagaatgttgctgacatgaccaagtccctaaaggtcatttttggaactgatgctcaagatgcccaagccattgaagaagtagaacaaattaggcaaagggctattttggctatccagcaatacctgtctcaatgacttttgtgtaatagg

SEQ ID NO: 93631 - DNA, 1560 bp, Oryza sativa
gtggtttgttgtatgttcttggtgaagacgggaagatggcggtgtatgatccatgcaaccacgacaataattttacagttcccgataaacctaagggctttggaatcaaacaccaagttgatagccacctgtttgagtccgaccaaggcgcgctcatggctgtcctcgtcggctacagtggtgcgcctatccatgtcgtcaagctcaacgaagagacgatggagtgggagaagatgcggtcattggaaggacatgcgttgttcaccgggacatacacgacaatgttgaggaagactaagcttagattgatgcaaaacaaggtgttcctcccgaggctgtatgactggcctgagactatccatgtcgacattgttacacgtgatggcgaaacagcatttgtaccaaagtcatccagttcgtctaacaccaaggagatcacctcggacataaatatttggttctacgagtttgggcagcaagacgcaagagagttttggggatcggagagagtagattatagtatttgggttgattttagtactaattgacacaaattgacgttgttagctcttatattttcatatagtgaatcatctcacaatgaagttactcttctttcaggccaaaatcaaaatcgacgcaaatgaaatttgatataatatttctttgttggttgaaacatggcgctattaatattatgcactcagccaatgcaatttttgcatgaattgatattgatatttgtgcacagtaatttatgaggatttaagggaataataaaattataggcttggatgattttctcggaaaatttgaatttttttgggagggaaggatttagggtttgggtgattcacaaggatttaggcaagttttgaatttcaaaattcgaaccttgggatttgtaatggaactttgggatgaagtttttgggatatcaaggagagacccaccgagatcttttggcacacttaagtccttgaggatacagaaagatctaaaatttttgcaattaggatttcgttttatacaaaataagttagaaaaataattcattcgactgtgagttgctgaagatatggtggtgttatcggaagacttgaccgaatagccatcactgctaaatggtggcatggatctacttaatccacaaatagactttcccattaaaccaaccatatgactgattactcccttcatttcaccaacatccattatccaatgcatgaatcgatttaaaaccaaaacgtatcacatagagctagaagaatgaggaaaacttcaccaaaagcaaagtagttaacgtacaggtgcaagtagttaacgtacagtatcaatgatactggttggtgacgttggctttcatcatatacttggttatcttcttcttcgccttcttgtcttccgactcacacgtcttagcgtgagccagaagtgggtttctcgccctggccgaagaaggttcaagaagaatcttcttgtagccttttccgcagatccaacacttctttgggtcgaattcctcctgctgacgcacggccacctgatggcccgttgcag

SEQ ID NO: 93632 - DNA, 661 bp, Oryza sativa
ctctgaaactgtctttggttgcttccaattggttacggattccacgttactaggatcgacggcaactcctccggctgagatgacgtgaccaaggaatttcacttcggacaaccaaaattcacacttgctaaacttagcatacagttgatgttctcgtagcttctccaatgcaagacgaagatgttcctcatgctcttctttggttcgagagtagataagaatatcatcaataaagaccaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgataataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggct

SEQ ID NO: 93633 - DNA, 683 bp, Oryza sativa
gaatgaatgataaaatcagtatatatttacatcctcctaaatcatctaatgataggttaattgatggaacgattttacaaaaggaaagtgccagagccgaatagtgctaacaatgcatgtaattcatgtttggatgatataaactgggaagatgagattaaatatgatccaggattaagaaaacaaattgatgagtaccatcctaatctcagagagagggtgagaaggaaatacttggagaatggcccttgtcaacctcgcacatttgcttttcctatgacaggttcaagaaggtttgtcccggaatggtttgatgagtttggaagttggcttgaatacagtgagtccaaaaatcgagcatattgttttttctatttcttgtttagagaaaagaaggatggtggatatgaagcatttgttaaaaatggttggaatggttttcatagaaaagaaaggttgaaattgcatgtaggtgatgtcggtggttcacactatcaagcaatgaagaagtgtgatgatttattacaaaaaaagacagcacattgatgttgcttttcatagtgtgagagaaactggtaagagggactatcttactcgattgaatgggtccattgatgttgctaggatgctagtaaagctaggattgcctttccgaggtcacgatgagtcaaaggagccctaca

SEQ ID NO: 93634 - DNA, 1891 bp, Oryza sativa
gagacttgaacggtccaattccgagttcaaatggccaagatatggccatttgaagtttatatgctctttaaatggatatttgcgaatttcttcatttaattttcaattaaaaatcctatttattgcgtcagccgagggagcagggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagaggagggaagggggaaagcgaacggcggtcctcggctcaccccgggacaacgacgacgacggaaacgacgaccgaagcggcgagagacggcggcgcgggtcgggatgacgagggcgacggtgctccggcagtcgacgggcgaaacggaggagcggacggggtcgacgacaacgcggcgaagccgatggaggtggcgccgagtcgggaggaagtccggagtgacgacggcggcgaaccgaaggttggcggcgacggcggagagagaggaggacggcgctagcacgaatccgacggcgagagcgagcggcgagcggcggaaacggaggagagaggcacggggagcaaatatatagcgccgagagggggagagcgcggccggagagggaggaaacggccgcggagatctcggctccattgaagacaccggcgacgattgcgggattcaaatcggacgaatccgagggagagagagagggaaaagagggggaaacgggagagggaatcacggggagtgatttccccctctttaatgcgcgcggggacggcgggatgcggcggaatccgcggcggcggcggcgctagggcacgggcgggcggcggcgcggcgcgaggaggaagatgacaggcgggacccacccgtcagcgagggtggcgggcgggcccacccgtcagcggcgcgcgcgcggggaggagccgatgggccgcggggagaggagagaggggggggagttgggccgagccggcccaagaagggaaaaggggaggaaaaggacttcttttagggttttctttttataaaccttttcaactttgtttatttcttctcaattattatttgtgctctgaaaattccactaaaatttatttacacattttaggcttttaggaaatatacaaaaatcctccaagcctcatttgacttttatctttgcacattttaattgttggaggctttcacatgaattttaattattctcggcacaattttgaggatgaattttagagtcgttttgggacgcgacaaacctaccccccttaaacggaatctcgaccccgagattcggaagaactggcgaagagatcgggatgggctgccttcagctcgtcttcacgctcccaagtagctttttcttcggcgtgattgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaaggcatttcttgagttgcgacacatggaacacatcatgcacgttgcccaaggaggcgggcagctccaactggtaagcgacttctccgcgtcgagcaatgatacggaaaggacccacataccgaggtgcaagcttccctttcgtctgaaacctgtgtacacctcgcaatggcgtgactcgaagataca

SEQ ID NO: 93635 - DNA, 1142 bp, Oryza sativa
cgaagtacgccgccaaccaggggggcctcgcccagcgcctctcggagatggccgggactctccaacggctccccgaggagctcgagaggacgattaagtcatcctcgagggaccttgcccgaggagcggtggagctcgtactggcgagttaccaggccagggaccccgacttctccccatggatggcgctggacgagttccctcccgggactgaggacggcgcgcgcgcgcgggtccaggacgccgccaaccatatcgttcacagcttcgagggttcggcccctcggctcgcgttcgccctcagctccgacgaggagggcgatgacggcggtgtgggcgacagtggcgacgaggctggcgactcgggtgcatcggagtgagcctccaggtccccgccaatctttaaatacgtctttcttcttttctttcttccgaagccttcgggcctcctttttgtatagattaacttactctgcaatcaaaataaagaaatttctgtgtcaatttcattttactgtgtgtatgagaacgaggatgatctgtgccatggttcttttgtgtcttagctcgaacaagggctcgtgcccaggtcccagtcctcaaatggctcgggtcggggctagtgcctggggagatccacgtgtcgagactggccaggccgggagcgtggtgaccgagggttatgggtgacccggttgtgggtttttgccgattcccccccggagttaaccacgccccggggcacggctcggttctgggccccttttggcgattttagccgactcgagcccccgagggcaggatcgagcacgagtgacctatttcaagtcaagattcttcaaaaggaaacaacagcacagacacagcctttaggaaatcgaaaatgcttttattgaaatacagatagaagagaaataagaatatgcatgtgtggtagcccccggccaaccctgcacgcccgaggggggtacggggttggcccgagcccgaaacctgacacccgaaccctattaggggtagaagcgacgaaggtgttcgatgttccacgggttaggcagctctgtgccgtcgcccgcggccagccgaacggagcccggccgggggacgctgatcactcgatacggaccctcccacattggtga

SEQ ID NO: 93636 - DNA, 641 bp, Oryza sativa
ggatccggaccagaggaccaggggaggagagattggagactcccggaggatccaggagaagatcccacgagaggcaaaaaggaggaaaggggtttctagagtttgagctctctggttctccagctctttgtagcttcttcgtacacagatctaccagaacacaggagtagggtattacgcttctcagcggcccgaacctgtatacatcacccgtgtcttgtgtgtttccactttcgcgaacattccacagactaggagcttagaacctcacccagggcccccggccgaaccggcaaagggggacctgcgcggtctcccggtgaggagccccacgctccgtcacatgatgtcaataatatgaaatcgaaatgtttcttggttgtaatgaaagcgttcgaaagttcgagcttgttttcgaatcttatagagaatcatgcactcatgcttcgtatttggcagttggttatactcgctccttccgcttttgatgcataattcgactactgagaaaagttagttaattgctgtatcgaggaaaagaagcaagttagttttatagcaggtacaatagcatactataagagtaagtttaatagtatagtccactactagctccaattcatccatagccaatctaatag

SEQ ID NO: 93637 - DNA, 668 bp, Oryza sativa
agcacagcatgtgtggttgtcatcagaggtaaccaagtgattgttggacatgttggtgattctcgttgcgtactctcaagacagggtggcctggtatagtgattgtttccctattgaatttctggttaatacctaatttgcaagctcgttcattgtggcgcctaacatttgtgcttgtttccattttgtcaataggctattgatttatccttcgatcacaaaccatgcacaagaactgagtctgaaagagagagagttcaaaatgcaggagggagatctcttggacttaggtgtgaacaagtaatggggaattatgtagtcaaggaacaatgggtcctcggtgattttgggggaggtgtaacaatctcaagatcaattggtatagtcttgtctggatctgtttttcattgattgcatgtaatagcacaaaaagaagcacattacactgtgattggcgttttacctacttacatttcaggtgactttgctttcaagaagaacaaagatttagatcgtgaaaaacaaatgctggtatgtgatccggacatcctcgctgtaagtgtaactaagtgtaaataggtccgtttggtagaatatgaagttcagttttgccgggttgggatctgatggaaaattgccctttcaatgtcaggatgacataactgatg

SEQ ID NO: 93638 - DNA, 1370 bp, Oryza sativa
gcagtggtcttgagatatgttgataaatatggaattgtgagagagagatttgttggtcttgtccatgtgactgaaacaacttctgcctatctcaagtcttctattgatgctctatttgcagaactgaagctaagtctaaagcaagttagagggcaaggatatgacggtgctagcaatatgtgaggtgagttcaatggtttgcaatcattgatcatgagggaaaatagttcagcttattatgttcactgttttgctcaccaactccaataggttcttgtggctattgtgagaaaacataaaggcgttagtgatttttttactaagatttccatcttactgaatgtggtgggtggatcatctaagagaagggatttgattagagatattaatgttaaagaaatgagtaaggcattgggttgtgggcaacttcaaactagaaccgggttgaatcaagagcaatgtcttcagagacctggggatactcgatggagttcccactataaaactctcaaaagtttggttggcatgtttgctacaatagtcaaagtgctagaaattgtggaaaaagacaaaaatgattggaaaattagagatcaagcatcgaatcttttggagtacttccaatcttttgattttgtcttctatttgcacctcatgttgactatattaacaatcacaaacagcttgtcactagcattgcaacggaaggatcaagacatagtgaatgctatgaaatgtgtaaagtcaactaggctcaatttggatgagcttagaagagaaaagtgggagaaagttctagatgaagtctctgacttttgtgacaagtatgatattgtcaaattggaaatggaagatacatatattgatcccaagaagcgtaggcacaaatctagaattacaaacaagcattactatcaagtggattgttttaatgatgttattgattggatacttcaagagcttgacaatcgcttcagtgagacaagctctcaattgcttatttgctcatcggcttttagtccaagagactcatttcatgatttcaatctagagaatttgatgagtttagcaaaattgtatcctagtgattttaattctggaaatttgagggaccttagccaccaacttggtctctacatcgctgatgtgagggatgatggtagattctccaacatacaaactattgccgagctttctcaaataatggtggagacaagaaaacatctttgttatccattggtttatcaacttttaaaacttgtacttgtattgcccgtcgctactgccacagttgagaggtgcttttcagctatgaagaatgtgaaaacatatttgtgcaataaaattggtgatgagtacttaagtgatag

SEQ ID NO: 93639 - DNA, 1277 bp, Oryza sativa
ggggggggggggcggccgtacccagccaaccaaccaggaggcataaaccaaaaacaagggtagcagaaaccaactattccgatcctaccaaagcaaagttctactactacgatactagtgctacctaggatcagtatcatcctgcgcatgcagcggtgcacgcatcatcacacatcatcttcgaccaggacaaaattgagtgaagaatcgctggtgtgcagcttgctgccggccgtggcgctggtgctgccgttggtgaccttgtcgtcggctgcgacagtggcagtgggatcaacctcctcgctggctcctcgctggtgttaatggagtagtagttatccacgatggtcgacaacaacgacaccacggtggcttcgtcagcagccatggcggtggtactgccgccggcgacgacagcggcgtcgaccttgacctcatccgcgacggtgttgttggcgctgggagtggggacggcgagctcgccgctctcaaccctggcactgccgctggtgtagacctcgtcgtcggtgtggctggcaacgatctcagcgtgccccctgggattgtagctgtcagccgtggcgttgggatcgacctcgtcgctgtcgaccgtggcatcggcgctgccggtgctggagtccgcgtcgtagcccataacggtgggcctggcagtggcagcgtcatcgacgccctcgtcgcttgtgtcgctggcaccagccggcgcagcactggtgctggcaatgttagagacggcagtgccaaatccagcgggatccaccagctggtactggaaggcgccgggcttgaactgaaccaggatgacggtagtgttctcgcccgatgccaagccgaactcaacaacctcctcacagatgacacgcagctctgcaccctcctgcatagcaatattaattggtcacagcattattggtaacagcagttttaacagcgaaagaatcgaagtcaaagcagatggcagtttgtcagccaggcatgcatattcagtgctaaactaacaaatggttttgtgaggtttagggcttacacagtttttttttaaaagaaaagagaaaatcaggatatttacattgcttgattgaagtcatttcctagaacagatagcatgattaacaccactaagatatcttgtcctgccaagaagacaaactgagggaaagaaaagactcaccaccgataaacggtcatgtatgtaagaaaccacgtccgcactgtccacgcaagacctgcagggggaaaatatacaggggctgcaggaa

SEQ ID NO: 93640 - DNA, 667 bp, Oryza sativa
ggaccctctatccgcccgcggctaacggaattgttctgaagtgcattcctcgggaacaaggcgtcgagcttcttgccgatatccatgaaggcgaatgcggagcccactccgcctagagcaccttggttggcaaagcctttcgtcaaggtttctattggccgacagctctcaatgatgcggtcgacctggtccggcgatgcagagcgtgtcaattccacgccaagcaaatccatcagccggcccaggccatgcagatcataccactttcatggccatttgctgtctgggggctcgatatcctgggaccgtttaggcaggccccgggcgggtttgagtatctgtatgtcgcgatcgacaagttcactaagtggcccgaggcttatccggtcgtcaagatcgataagcactccgcacttaagttcattaagggcattacagcccggtttggggtgcctaaccgtattattacggataatggcacccaattcactagtgaacttttcggcgatcactgcgaagacatgggcatcaagctctgcttcgcctcccccgcccaccccagaagcaatggccaagtggagcgcgccaatgcggaaatcctcagaggccttaaaaccaagaccttcaacatcctcaagaagcacggcgattcgtggatcgaggagtt

SEQ ID NO: 93641 - DNA, 556 bp, Oryza sativa
taagtctgtcgactatcacccaaatagagtcatggcccgatgacgttctgggcaaaccagtgataaaatccatacctatttcttcccatttccattcaggaatcttcaaaggttgcaacaaaccggcgggtttctgatgttctgccttgactcgctgacaaacatcacatactgctacgtattctgcgatttcacgcttcatacttgcccaccaaaatctttccttgagatcctggtacatcttggtactaccagggtgaatggagtataaagtatcatgagcttctttcagaattgcatcctttaagtctttgttgtcggggacacagattctttcacccaaccatacagttccgtgctcatcttccaagaaaccaatagcttttcctcttctcatattcttcttgatctcttgaatatcaggatcattaatttgggcttctctagcttgatcaattagagtgggcttcgcttctaaggctgcaacgaaacctctattgacaattcccaaatttaatctttcaaattccttgcataattccaatggcaactgtcg

SEQ ID NO: 93642 - DNA, 1271 bp, Oryza sativa
gctgtatgaattcacggtgatgtcgttcggtttgaccaatgcgcctgccttcttcatgaacttaatgaataaagtgttcatggaatacttggataagtttgttgtggttttcattgatgacattctgatatactcacaaccagaggaagaccatcagcaccatctccgtctggtgttgggaaagttgcgggaacatcaattgtatgccaagcttagcaagtgtgagttctggttgtccgaagtcaaattcttagggcacgtgatatctgcaaaaggagttgctgtggatcccgaaacagtgaccgccgtcaccgattggaagcaacccaagacagttacccaagtccgcagtttcttaggtttggcaggatactatcggagattcatcgagaacttctccaaaatcgctcgacccatgacacagttgttgaagaaagaagagaaatttgtgtggagcccgcaatgcgagaaggcgtttcaaactctcaaggaaaagctggtttcctcgccagtgttaatcttgccggatacccgcaaggacttcatggtgtattgtgatgcttcgcgccaaggattggggtgcgtgctcatgcaggatggtcatgtggtagcctatgcctcacgtcagctacgacctcatgaaggcaactaccctacacatgacttggaattagccgcagtagttcatgctctaaaaatctggcggcactatctcattgggaatcgctgtgaaatctataccgaccataagagtctgaaatacatcttcactcagtcggacctgaatcttcggcaaaggagatggttagaactcatcaaggattatgatgtgggaattcactatcatcctggtaaggccaacgtggttgccgacgctctaagtcgaaagagccattgcaacactcttaacgtccgtggcattccacccgaacttaaccaacagatggaagccctgaacctaaacatagttggtcgtggatttttggccgcgttggaagccaagcccaccttgctcgatcaaatccgcgaggctcagaagaatgatccggacatgcatggactcctcaagaatatgaaacagggtaaagccgctggtttcacagaggatgaacacggaaccctatggaatggaaatcgggtatgcgtcccagataacagagaacttaaacagctgatacttcaggaagctcacgaaagtccttattccatccacccgggcagtacaaagatgtacttagacttgaaggagaaatactggtgggttagcatga

SEQ ID NO: 93643 - DNA, 1061 bp, Oryza sativa
ctgtcggttacaaaaaaggtcctgtccaattctgttttcctgctcgatgttttggtgcaaccatctactgtttcagttcctggaagttatcaagctaggaaacaccagaaactaccaagatacactggtgcaccgtgatctgttcctcttgcaggtgacttcttgattcatgaaacttatcaccagttgaagaatcattttcttttttcctctgtaaaacttgtgttcttggcctgattgcaatggcagatgtacaatggagtagaggagagcagtgcaggaacatgttcagagctaatctttgcacccatcgatgcatcgttcagtgatgattctccgctgctgccttccggtttctacatcatccctatcgattctcctctgtaagtaaatctcacacaattagataatacactagcatttcgaatcaaattttctaaaatttttatgctataaaaaacataattcttctggattttctttccttgcaaatgttaggacacatctagctcgaactgcatgctagatctcgcttccatgctcgaagcagcgacgccatggagcaggatcagcggcatcaatagcagcggcgagctccaaggcggtgatgacgatcgcgttccagttcgcgttcgagagccacctgcagggcagcgtgcccgccatggcgcagcagtacatgtgcagcatcatctcatcggtgcagaggattgccgtggtgctctcatcctcccgcctcgtccctcccggcgttgccgccgccacgcagcacgcgccggcgactcggtgctgcccagatggatttgccagagctataggtttgtggcttcgcagctgcttgtaatacagttcatatctgtaagattttttaaaaaaaaacagttcgcttttcagaactcatgatgctttgcttatgcagatttcattttggagctgaactcatcaaatctgcagatgccaacagcagcagtgaatcggttctgaaagcagtttggcatcatcccagtgccatactctactgctctctcaaggcttcttcagcctctatttttctttttctg

SEQ ID NO: 93644 - DNA, 760 bp, Oryza sativa
cgactacactttgctcttctccgacaactacgtgctgctccggcaattctccctctacgtcgttctcgcgttgcgaccgttccagaggtcttctctgctagtctccttcaacattggcttatgattcatggtggtcccctgcctcgcccacgcggtattggaaacactggcgtgcgcgttcgtcctgagttgtcccggggtctggcaaaccctgtgtgacgtctcgtccttcacggttcgactacattggcttttcggcgtcatcttcctcaacgattgccgtgattgtgtcaccgtcttcgtctccagtgcatcctcacgcaccttggtccatgacgcccctcccatgtgtccatgaccactctacggcgccctatgcgcgtcctgcggctcggctacctcgacatcagcttcctgacttcggctacaacgaccacggctactctacacacggcttcatcgactacggctcccttgcacccttcgctttggctacattgactacggcacacagggctatcatccgtattgagtactcttgccggtttcttctccagtccaagtgtccacgctgctcacgcttggactgtgggggatgttagagtcatattaggatatgattgatttgtgtagactcctatatctgtaatccttccttatctcctctccatgtactcctatgtatatcagccctctgaggctcaatacagtcaatccacgattcgcaatatcctctctccctgtactatccaacattata

SEQ ID NO: 93645 - DNA, 668 bp, Oryza sativa
ggttggagaagtccggccggtcgttggtgctctgccttgacacgctggcacacatcacacagggccacgaactctgcaatttcccgcttcatgctaacccaccagtatttctccttcaagtctaagtacatcttggtactgccagggtggattgaataaggactttcgtgagcttcctgaagtatcagctgtttaagttctctgctatctggaacgcatacccgatttccgttccatagggttccgtgttcatcctctgtgaaaccagcggctttaccctgtttcatattcttgaggagtccatgcatgtccggatcattcttctgagcctcacggatttgatcgagcaaggtaggcttggcttccaacgcagccaagaatccacgaccaactatgcttaggttcagggcttccatttgttgactaagttcgggtggaatgccacggacgttaagagtgttgcaatgactctttcgacttagagcgtcggcaaccacgttggccttaccaggatgatagtgaattcccacatcataatccttgatgagttctaaccatctcctttgccgaagattcagatccgactgggtgaagatgtatttcaagctcttatgatcggtatatatttcacagcgattcccaatgagatagtgccgccagatttttag

SEQ ID NO: 93646 - DNA, 1374 bp, Oryza sativa
ctgtgtgatttaaaacttttaaaaattgtaagtatcacatataactagcatatacatgatttaaacttgttgaaacctctaataatcgtgttgtaattaacatatgccatacatttttatatggataatcaatacatccaaaatagtttacatcgtgtacacaataattacggcattacatcggcagtgacggttgaccgcacgtactttctcctcactattgttccctccttgtgatcgctgcgtgagtaaggggtgtcttcatttgataggaggatgctagggtcaatcatcaccgtgaaagggggttgcccatccaactgatcgtaatcctcatcagtcttgtcctcaactccgacgatttttcttttgcctgggagaaccacttgacgcttaggctcatcaggccctctgtccttctttcctttgctagacatgtccttcacgaaaaagacttgcgttacatcattggcaagggcaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacatggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgtcgtgtaatccatgcatcggatttaccgatgttcctggcgcgaactagaaccaagtgctcctcgatgtaaggagctaccaatgaagagtgttgcagaacagtgaaatgggctttacggaataaattgttgtctaccgtcattattgctttccttcggagagtctacagtagtctcccttcatggcgtgattcaggtaccccgattgggcgaaggtcttcgataaattctacgcaaaattcgatgacctcatctgttccataacccttgtcgatgcttgcctctggaacgagctcggttacgaacacacttcttcagaacgccccatgttcctctcgaaaggaaacatgttgtgtaggtacataggcccgacaatacggatctctttcacaaggtgacaaagcagatgcgtcattatattgaaaaatgaaggtggaaatatcaactcaaaactgacgagacattgcaccacttcattctgaagggcttctaatctatccg

SEQ ID NO: 93647 - DNA, 955 bp, Oryza sativa
ccatcactcgctatttcctcctggcccgcttgatttccttcaaatccaacatactgagcaaagtccggaatattgtcgtcttccacttcatcttcttccatttcaacaccttgctctccgtgggatatccaacaattatagcttggcatgaaccccgactcaaacaagtggaaatgaatagtcctagatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacgcacattttctctctcatcaacttacaactaaattttggagacaaaaaaagtgtgcaaaacataggtgcaaatgtagtatgacaaaaaaaacattggaggatgaagttgtaaaccttttaggcacctccgatttgtatgtaatcaccaaaataaattcaatagaaattttggcatgacctcccctcttttttgaagaaattttgaagcttgctcgggcagctggaggaggaagaagacatatatatatataggggtgggactttagtcccggttggtagcaccaaccggggctaaagatcaccgggatctttagccccggt

SEQ ID NO: 93648 - DNA, 4628 bp, Oryza sativa
tcgctctgttacggagtatctgcacgagttcaatcgtcttactcgttatgctccggaagatgtgcgcaatgatgaagagcgccaggagaagttcttggaaggacttaatgatgagctttcttacccactcatgactggagattattatgatttccagaagttagtggataaggctattcgccaggaggacaagtacaatcgcatggagcaaaagaaacgccggattgctcaattcaagacacaacaggggaataatcagaagccacgtcttactttaggaccccagtctatgccacagggaggttcttcgtctgttgttcgtccgcagcgtcagttcttcaacaacaatgctggcaacaacatccgcaatcaagctctacgtcctgttgcagtttcgacacagcaacaacctgccaagaaggagcaaggcagcaagcccgtggtgtgtttcaattgtggagacccaggacattacgctgacaagtgtccgaagccccgacgcgtgaaggttgtccctgcccagagcaactctaccgcaccagcatcaaaggcccgtgtcaatcatgttgctgctgcagaagctcaagatgctccagatgtgattttgggtacgttccttgttaactcagttcctgcaacagtgcttttcgattctggtgctacacattcattattatctatgagttttgcgggaaatcatgggatggaagtagaagatcttagacgtcctttgatggttagtaccccaagtaatcaagcactctctttgcaacgtagcccctctgtcagaatagaaattcaaggagtatcatttctggccaatcttatcctgttagaatccaaagaccttgatgtcatcctagggatggactggttagctagacataaaggtgtgatagactgtgccaatagaaaagtaactctcaccagcaatgatggtcgagttgtgactgttcatgcattgtcttctgagtctttaaggtcaagactgaaccagataactttggaagagattcctatagtccgggagtatcctgatgtgttcccagatgatttacctggtatgccgcctaaaagggatatagagttcagaatagatttggtaccaggaacaactctgatccataagagaccttatcgaatggcagccaatgagttggcagaagtcaaaaggcaagtagacgatttgcttcagaaaggatacatcagaccgagttcatctccatggggagctccggttatttttgtggaaaagaaagaccatacccagagaatgtgtgtggactatcgtgcactaaatgatgtgactatcaagaataagtatccactacccagaattgatgatttgtttgatcagcttaaaggtgccaccattttttccaagatagatcttcgatcagggtatcaccagttgagaatcaaagaggaagatatacctaagacaacttttaccactaggtatgggttgttcgaatgtactgtgatgtcttttggacttaccaatgcccctgctttctttatgaacttgatgaataaggtgtttatggaatacctagacaagtttgtggtggtctttattgatgacattcttatctactcccgaaccaaagaagagcatgaagaacatcttcgccttgcactagagaagttacgagaacatcaactgtatgctaagtttagcaagtgtgaattttggttgtccgaagtgaagttccttggtcacgtcatctcagcgggaggagttgccgttgatcctagtaatgtggaatccgtaaccaactggaaacaaccgaagacagtttcagagattcgcagtttcctaggcctcgcaggatattaccggaggtttatagagaatttttccaagattgctaagcccatgacacgactgcttcagaaagatgtgaagtacaagtggtcagaagaatgtgagcaaagttttcaagagttgaagaatcgcttgatatcagctcctattttgattttaccttatccaaagaagggtttccaagtgtattgcgatgcatccaaacttgggttaggttgtgttctgatgcaagatgggaaggtggttgcctatgcatctcgtcagttgcgtccgcatgagaagaactaccctactcatgatcttgagttagctgcagtagttcatgcgttgaagatttggcgtcattatcttttcggtactcgtacagaggtatataccgatcacaagagtttaaagtatatctttactcagtcggatctaaacatgagacaacggagatggttggaattaattaaggattatgacatgggaattcattatcacccgggaaaggctaatgttgtagcagacgctcttagcaggaaaggctattgcaatgctacggaaggacggcagttgccattggaattatgcaaggaatttgaaagattaaatttgggaattgtcagtagaggtttcattgcagccttagaagcgaagcccactctaattgatcaagttagagaagcccaaattaatgatcctgatattcaagagatcaagaagaatatgagaagaggaaaagctatcagtttcttggaagatgagcaaggaactgtatggttgggtgaaagaatctgcgtccccgacaacaaagatttaaaagatgcaattctgaaagaagctcatgataccttatactccattcaccctggtagtaccaagatgtaccaggatctcaaggaaagattttggtgggcaagtatgaagcgtgaaatcgcagaatacgtagcagtatgtgatgtttgtcagcgagtcaaggcagaacatcagaaacccgccgggttgttgcagcctttgaagattcctgaatggaaatgggaagaaatcggtatggattttatcactggtttacccagaacgtcatcaggccatgactctatttggataatagtcgacagacttaccaaagtggctcatttcatcccggtaaagacaacctattccggaagccggttagcggaattgtatatggccaggattgtgtgtttgcatggcgttcctaagaaaatagtgtctgatcgaggcagccagtttacttcaaatttttggaagaaacttcaggaagagatgggttctaagctgaactttagtactgcttatcatccgcaaacagacggacaaaccgaaagggtgaatcagattttggaagacatgttgcgagcttgtgctttagacttcggtggaagttgggataagaatctaccttatgcagaatttttgtataacaacagttatcaagctagtcttcagatggctccttacgaagcactgtatggtcggaagtgccgcactccgcttttgtgggatcaaacgggagaacgtcaggttttcgggacggatatcctaagggaagcagaagaaaaggtgaaaatcattcaagaaagattgcgtgtggctcagtctcgtcataagagttatgccgacaatcgccgcagagatttgagttttgaagaaggagattatgtgtatcttcgtgtcacgcctcttcgaggagttcatcgttttcacaccaaaggaaaattggcaccgcgttttgtgggaccttataagattatcagtagaagaggagaggttgcttatcagttggagttacctcaatctttggcaggagtccataatgtgttccatgtgtcgcaattgaaaaagtgtttaagggtacctaccgaagaagctaatcttgaacagatagaagtccaagagcatctgacctatgttgagaaaccaatccgtattttggaaatagatgagagaagaaccaggaatcgagttatccatttttgcaaagtccagtggagtaatcactcggaagaagaatcaacttgggaacgagaagatgaattgaagtcagctcatccgcatctattcgccagttcttccgaatctcgaggacgagattctgtttaaggggggtaggtttgtcacaccctgaaaattcaaaatatataaattgttgtttaaatggaatttttagaatttattttaaaagcctagaagagaagatctaattttaattaataaattccaatataaaatggggccagataaaatttcattaaatactttgcttaattctataattcgtagatttttctgggatttatttgagctaaggaagtatttttaataaatggaattgcatttaagaaataatttaaattgaaaaaggttttaaaagtcttcttttggctttgggccgaaagtcggcccaaaaccgctctctctctcctcggcccagacggcccagtccgagccgccgctcttctctctctcccgctgacaggtgggccccacctgtcagggtcgtcgtcttcgtcgcgccgccgccgcccgaaaccgtagtttcgcgccgccgccgttcctttccaaatccggccgctcatttccttctccggccgaattgaaagaggggaaatgatccccgagatctcctctaccttttctcctttggaaacatcggctaaatcggtttggaaatcgatggattcgagttcgaatcggatcagcttttctctctgcgagctcgagcttttcatctcgtcgccaggcggcgtgggccttcggcggcgccttctaacccctttaaaaggaccccccgtgt

SEQ ID NO: 93649 - DNA, 517 bp, Oryza sativa
ctgcagcccgttttgacttgtgattatttgttgatgtgatgatttgatgatgtgatgatttgtgatttgtcatttgtcatttgtcatttgtcatttgtcatttgtgggatcggcttgacggctcgaagcatcgagctgatttttttttttggctcatgtgcgcttcaaaggtgccggttttgaaaccggcacctttaatctttcattatctgtgccgcctccatggtgccggatgggaaaaccggcacctaagggggtttcctaactggcaccgacttgggattctgtagtagtagtgatgtctcatcatgattgatattgacggatcgtggggcttctcaccgggagaccgtgcaggcccccctttgccggttcggccgggggcgcgaagtgaggttcttcaccctcgatctgtggaatgttcgcgagagagcaaatgcacgagacacgggcgatgtagacaggttagggccgctgacaagcgtaataccctactcctgtgttatggtggatctgt

SEQ ID NO: 93650 - DNA, 1746 bp, Oryza sativa
tgacccaatttaataccagtgataaatttaagaataatggtagtcgggggggaaaagtttaaattgtaagcccctcctctgtttgcgggttctgtgtggggttttcagatggtgacgaccaggagaaatgctgttaccggtgatggcaatcaacctgaaggcagcaaccacaaccaccagggcaacccacctccacctcttccttcggcctccgccaccaccaccagacaccaacgccattctcacccaaatcctcgcccagcaagccaacatgatgactactttcctccaccacctccaaaatccgccacaacagaatgctccacctccacctccccaacactctaaactcgccgagttcctccgcatccgcccacctaccttctctagctccaacaaccccgtggatgcgttggattggttgcatgccgtggggaaaaagctggacactgtgcagtgcagtgatgaagagaaagtcatcttcgccgcccaccagctgcagggacccgcatctctatggtgggaccacttccaagctacgcagccagagggacagcctattacatgggctcgcttcaccgccgctttccggagaacccatgtgcccgccggagtcgtggccctcaagaaaagggaattccgagagttgaagcaaggcaaccgctccgtgatggagtatttgcatgagttcaacaacctggcccgttacgctccggaggatgtgcgggaagatgaggagaagcaagagaagttcctggcaggaatggaccccgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcttacgccagccgtgcagcctggtcaaggccacagggacgctcaaggtcagcagcgtctgtgcttcaactgctttgagcccgggcactttgcggataaatgcccgaagccaaggcgtcagcaaggccaagcgcctccccgctccaacaacggtggcaaggacgtcattcggggtcgtgtgaatcacgtgacggccgaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaagttggatgtgatccttgggatgaattggttggctcaattccaaggagtagtggtttgcgcgagacgcactgtcctctgtaccgagggccggaacaaccggttgttttctttgcacccccagcctctgtcagaagttcagaacttcatcagataggactgtcagaaatccccatagtcagggagttcggagacgtgtttccggaa

SEQ ID NO: 93651 - DNA, 1227 bp, Oryza sativa
tgccgacctggtttcttacatacatgaccgtttatcggtggtgagtcttttctttccctcagtttgtcttcttggcaggacaagatatcttagtggtgttaatcatgctatctgttctaggaaatgacttcaatcaagcaatgtaaatatcctgattttctcttttcttttaaaaaaaaactgtgtaagccctaaacctcacaaaaccatttgttagtttagcactgaatatgcatgcctggctgacaaactgccatctgctttgacttcgattctttcgctgttaaaactgctgttaccaataatgctgtgaccaattaatattgctatgcaggagggtgcagagctgcgtgtcatctgtgaggaggttgttgagttcggcttggcatcgggcgagaacactaccgtcatcctggttcagttcaagcccggcgccttccagtaccagctggtggatcccgctggatttggcactgccgtctctaacattgccagcaccagtgctgcgccggctggtgccagcgacacaagcgacgagggcgtcgatgacgctgccactgccaggcccaccgttatgggctacgacgcggactccagcaccggcagcgccgatgccacggtcgacagcgacgaggtcgatcccaacgccacggctgacagctacaatcccagggggcacgctgagatcgttgccagccacaccgacgacgaggtctacaccagcggcagtgccagggttgagagcggcgagctcgccgtccccactcccagcgccaacaacaccgtcgcggatgaggtcaaggtcgacgccgctgtcgtcgccggcggcagtaccaccgccatggctgctgacgaagccaccgtggtgtcgttgttgtcgaccatcgtggataactactactccattaacaccagcgaggagccagcgaggaggttgatcccactgccactgtcgcagccgacgacaaggtcaccaacggcagcaccagcgccacggccggcagcaagctgcacaccagcgattcttcactcaattttgtcctggtcgaagatgatgtgtgatgatgcgtgcaccgctgcatgcgcaggatgatactgatcctaggtagcactagtatcgtagtagtagaactttgctttggtaggatcggaatagttggtttctgctacccttgtttttggtttatgcctcctggttggttggctgggtacgggcgcccccccccc

SEQ ID NO: 93652 - DNA, 645 bp, Oryza sativa
cagttccttgtgcttggcttccaagcggatgctcttgtccaccagacgttggaaatccggatagtccccagagactagacggacggacagctcggggtccattcctgccaggaacttctcttgcttctcctcatcttcccgcacatcctccggagcgtaacgggccaggttgttgaactcatgcaaatactccatcacggagcggttgccttgcttcaactctcggaattcccttttcttgagggccacgactccggcgagcacatgggttctccggaaagcggcggtgaagcgagcccatgtaataggctgtccctctggctgcgtagcttggaagtggtcccaccatagagatgcgggtccctgcagctggtgggcggcgaagatgactttctcttcatcactgcactgcacagtgtccagcttcttccccacggcatgcaaccaatccaacgcatccacggggttgttggagctagagaaggtaggtgggcggatgcggaggaactcggcgagtttagagtgttggggaggtggaggtggaacattctgttgtggcggatttgtgaggtggtggaggaaagtagtcatcatgttggcttgctgggcgaggatttgggtgagaatggcgttggtgtctggtgg

SEQ ID NO: 93653 - DNA, 554 bp, Oryza sativa
aaggaattgagaatgatgttaccacaagacatttggttgagatgttgtgggctatggatgaaagtcgtgcggagactgtgttagcagctcaagatcgtgaagatcggaatcgtggtaagatttgcaagctagaagacaaggtggatcgtttggagaaggaattagccgcattgaagggagaagcaccgccgcagaaggctaggattcgtcttaccgcaaggaagagagctttgtttgtccctcgctatcaattggcgccaaaggtccgcgtggtggagaaagaagttgccccagcaaatcctccggtcatcatcataagtagtgatgaagaagaagaacccaagcgcaacaattccaagtttgagtgggtagctatcaaagatgaggaagatgagccgaacgagccttcaatcgacctcctatgctcggaagaactagaatgacttgttaagtcgttgtcttagatcgttgtgttagcttgtgtcgcgtcccaaatcgactctaaaatctatcctcgaaattgtgcaaagaataatttaaaattcatgtgaaag

SEQ ID NO: 93654 - DNA, 5030 bp, Oryza sativa
  unsure (1)..(5030): unsure at all n locations
caagcgcctgtggtcgtcgccctagtcttccgctgtttttcgttgtctttgagtgtgctgggccttcgttgcccatgtaataattttatatacgcttccgcttgttaaactctgtattgtatcaacttttggtgtaccttgcctcctgggacaaggaataatacacgcacgtcgggaacgcctgttgggtgatttccggtcgggacagcttgcttggtttaagtttgtttgtgtgtgtgggtctcgcatgtgatttacatcaatggggggatgtaagtgcatgcgtttgtttgcttttgagtgttaagaagtgggtgagtttagtggtgtgagagtcttcagtttgtaataatgaaactcagttaagatcaataaaagttaaagtaattctctgtcctaagtagtttcccccgttttctcttcttatcctgtccataccagatggtgaacactcgtagcaatgggaatggtcccaacaaccccaataatatcatcaatggagagattcccactttggtccaagttcttgctcaacagtcacagcttatgaacatgatgatgcggcaatttcagaatcagcaaaaccaagggaataatcatgcacctccccagaacaagttagcagactttcttcgtgtgaggccgcgtgttttctctagtgccactaatcctgttgaagctagtgattggctacatcccatagagaagaagttgtatttatttcagtgtactgatcaggaaaaggtctcatttgcatcacatcagttgcatggccatgcctctgaatggtgggatcacttccgccttaacaggactactgctgaacctatcacttggcttgaattcaccgctgctttccaaaagtcgcatataccatcgggagtagcgtctctcaaaaagaagaaattcaggtcgcttacccagggatctcgctctgttactgagtatctgcacgagttcaatcgtcttgctcgttatgctccggaagatgtgcgcaatgatgaagagcgccaggagaagtttttgggaggacttaatgatgagctttcttacccacttatggttggagattaccctgatttccagaaattagtggataaggctattcgtcaggaggacaagtacaatcgcatggagcagaagaaacgtcggattgctcaattcaagacacaacagggaaataatcaaaagccgcgtcttaccttaggaccccagtccatgccacagggaggttcttcgtctgttgttcgtccgcaacgtcagttcttcaacaacaatgctggcaacaacatccgtaatcaagctccacgtcctgttgcagctccagcacagcaacaaccctgccaagagggagcaagccagcaagcccgtggtgtgtttcaactgtggagatccaggacattatgctgacaagtgtccgaaaccccgacgcgtgaaggttgtccctgtccagaataactctgctgtaccagcatcaaaggcccgtgtcaatcatgttgctgctgcagaagctcaagatgctccagatgtggttttgggtacgttccttgttaatcagttactgcaacagtacttttcgattctggtgctaacacattcattcttatctatgagttttgcgggaaatcatgggatggaagtagaagatcttagacgtcctttgatggttagtaccccaagtaatcaagcactctctttgcaacgtagcccctcggtcagaatagaaattaagggagtaccatttctggccaatcttatcttgttagaatccaaagaccttgatgtcatcctagggatggactggttagccagacataaaggtgtgatagactgtgccaacaaaaaagtaactctcaccagctatgatggtcgagttgtaaccgttcatgcattgtcatctgagtctttaaggtcaagactgaaccagataactttggaagagattcctatagtccgggagtatcctgatgtgttcccagatgatttaccgggtatgccgcctaaaagggatatagagttcagaatagatttggtacctggaacaactccgatccataagagaccttatcgaatggcagccaatgagttggcagaagttaagaaggcaagtaggaatgatttttgggggcccttttttaaacccagaaggatacatagaccgagtcataccatgggagctncgttattttttgggaaaagaaagccatactcagagaatgtggtggactatcgtgcactaaacgatgtgactatcaagaataagtatccactacccacgattgatgatttgtttgatcagcttaaaggtgccactgttttctccaagatagatcttcgatcagggtattatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactctcgaaccaaagaagagcatgaggaacatcttcgtcttgcattggagaagctacgagaacatcaactgtatgctaagtttagcaagtgtgaattttggttgtccgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattaccggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatattgagttagctgcagtcgttcatgcattaaagatttggcgtcattatcttttcggtactcatacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgtgacagatggacgacagttgccattggaattatgcaaggaatttgaaagattaaatttgggaattgtcaatagaggtttcgttgcagccttagaagcgaagcccactctaattgatcaagctagagaagcccaaattaatgatcctgatattcaagagatcaagaagaatatgagaagaggaaaagctattggtttcttggaagatgagcacggaactgtatggttgggtgaaagaatctgtgtccccgacaacaaagacttaaaggatgcaattctgaaagaagctcatgatactttatactccattcaccctggtagtaccaagatgtaccaggatctcaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaataggtatggattttatcactggtttgcccagaacgtcatcgggccatgactctatttgggtgatagtcgacagacttaccaaagtggctcatttcattccggtaaagacaacctattctggaagtcgcttggcggaattgtatatggcaaggattgtgtgtttgcatggcgtccctaagaagattgtgtctgattgaggcagtcagtttacttcaaatttttggaagaaacttcaggaagagatgggttctaagttgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtctacagatggctccttacgaagcactgtatggtcggaagtgccgcactccgcttttgtgggatcaaacgggagaacgtcaggttttcgggacggatatcctaagggaagcagaagaaaaggtaaagatcattcaagaaagattgcgagtggctcaatctcgtcataagagttatgccgacaatcgccgcagagatttgagttttgaagaaggagattatgtgtatcttcgtgtcacgcctcttcgaggagttcatcgttttcagaccaaaggaaaattggcaccgcgttttgtgggaccttataagattgtcagcagaagaggagaggttgcttatcagttggagttacctcaatccttggcaggagtccataatgtgttccatgtgtcgcaattgaaaaagtgtttaagggtacctaccgaagaagctaatattgaccagatagaagtccaagaggatttgacttatgttgagaaaccaatccgtatactggaaacaaatgagagaagaaccaggaatcgagttatccgtttctgcaaagttcaatggagtaatcactcggaagaagaatcaacttgggaacgagaagatgaattaaagtcagctcatccgcttctgttcgccagttcttccgaatctcgaggacgagattctgtttaaggggggtaggtttgtcacaccctgaaaattcaaaatatataaattgttgtttaaatggaatttttagaaataattttaaaagtcttgaaaagaaaatctatgtttaattaataaattccaatataaaattgggccagataaaatttcattaaaa

SEQ ID NO: 93655 - DNA, 1278 bp, Oryza sativa
gtgagagcttgctcaatccagcacgcgtttggacgcggcgtaggacgaggtcgttgacgcagagtgatcgggcccggatgcggcgctgatggtagcgccgtaggctctgctggtagcgcgcggctcggagggccgcgcgccgccttcgctcctccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggtgtggttcggttcgcccagagcaccgctggcaactcctcgatccacgaatcgccgtgcttcttgaggatgttgaaggtcttggttttaaggcctctgaggatttccgcattggcgcgctccacttggccattgcttctggggtgggcgggggaggcgaagcagagcttgatgcccatgtcttcgcagtgatcgccgaaaagttcactagtgaattgggtgccattatccgtaataatacggttaggcaccccaaaccgggctgtaatgcccttaatgaacttaagtgcggagtgcttatcgatcttgacgaccggataagcctcgggccacttagtgaacttgtcgatcgcgacatacagatactcaaacccgcccggggcctgcctaaacggttgtcacgaccggaaataacccaacgggcgttcctgacgtgcgtgcattaatccttgtcccaggaggcaaggtacaccaaaagctgatacaattcagagtttaacaagcggaagcgtaaatagaattattacacgggcagcgaaggcccagcacacaaagacaaacgaaaaacagcggaagactagggcgacgaccacaggcgcttgacagcaggcacgagctagacaccaaagccttcatcttcaaggaactcctcttctggacttgggaaaaattgagcaagactgagtacatccaccgtactcaacaagacacacccacaaatgcagaataaatgcaagggagtacaagggaattataatataaagggttagggttgcagtaaacagcatttaaagacatttagttgctcaaggctattttgtaaacgcgatcctagcactaaacaatattattaatcaaggccgtgaacccacacgaacctgccttaacccaaggcctacgatgattcagaccgaactggcaacccgaccctgggtcccagctcgtcccaagccaacccaggccaaccattccacat

SEQ ID NO: 93656 - DNA, 693 bp, Oryza sativa
aagcttaacaactcgcaaccaaccgttgaatccaccaattggtctattcgaggagagggaagtggtctttggggcacgccttgttgagatcggtgaagtcgacgcacatcctccacttctgttggctttgcgtactattactggatttacgagtcactctggatggaggacttctcttatgaagccagctttgagaagtttgtctagttcttttcgtatggcttgtttttggtcgggtgcgaatctccgcagtttctgcttaactggcttggcatcgggtcgcaacatcagtttgtgctcaatcacctccctggtactcccggcatgtctaacggttgccaagcgaacacgtctgcattgtctcggaggaaggtgatgagcacgagttcctatttgtcgtccaacgatgccccaatcttgacagttttgtcggggttggagctagacagtgggatgatcttgatggcgccatctggttttggtgtcttcttgggcttgctcactttcttggggttttcggttgtggcgggcgggttaggagtatgctcgaccatgtcgaggctccgcttgtcgcattgtactgccaacttggtgtctccctggatagtgattgtccctttcggtcctggcattttgagcacttggtatgcgtaatgcaacgcccccataaatttgcgagtgcagtcctcccaa

SEQ ID NO: 93657 - DNA, 1856 bp, Oryza sativa
ttgcctcaaaggatttgtcaacatgacttgccacaaatttggagtcagtccggatgagtaagcgccgaacccccaatgctttcgccttttttaggccccgcagtatagcttcgtactctgccgcgttgttggttgtgttgaactgcagccttgcggcgtatcgaatcggtacgccccctggcgaagtgagcactgccgcagcgcccgcccccttgtgcgaccacgagccgtcggagtacatcacccaaggttgttcgacaggctcaggttcaagggcgaatgccgatgtccattcggctacgaaatcagctagtacttgggacttgatggcagtgcgggcgacaaaatgcaagtcgaagggagataattccgccacccacttgctaagctagccagtaatttccttgccccggagcacttcgcccaaagggtactgcgatggaccgtgactttgtgggcctgaaagtagtgtttaagcttgcgcgaagccatcactagggcgtaagcaagcttctccatttcaatgtatcttatcttcgccccctgcaatgcttcggagatgaaatacactggtttctggcctgactctgtttcttgacacgagtgctgcactgaccgccaccggcgaagctgctagatacagtagcgattcgcttcctggtgctgggctgatcaaagcaggtgtgctctgcagatattgcttcagctcgtcgaacactgcttggcattcgggtgtccaggtgaacttttccgctccccggagggtcttgaagaaaggcaagcctctttcgaccgcttttgagaggaattgactgagtgccgcaatttggcctgcgagctttttgtacttcgcgtacgctcgacgggggcttcatttgctaaatggcatcgattttctcggggttcgcctcgatacccctttcagaaacgagggaacccaacaacttgcccgcgcgaacaccaaagacacacttgtcaagatttagtttcatacccgcagtgcgtaagttgtcgaaggtctcctgcaagtcggacgcatggtcgaaagccttgcggctttttacgacgatatcgtcgacataagcctccacatttcgccccaactgcttgtaaaggatcttgtacaccagcctggcgaaggtaaccccggcgttcctcaggccaaagggcatcctgaggtggcaataggtgccgaatagtgtgttgaaggctgtcttggggatgtcggccggattcatgtggatctggtggtagccggagtacgcatccaaaaagctcatgagtttgcagcaactgtcgaatccacgagttggtcgatccgtggcaaggggaaatcgtcgttcgggtacgctttgttgaggcctgtgaaatcgacacacatgcgccatttgccgttcgatttctgcaccagtaccgaattcgccagccactcggggttgttgatctcctggatcaccccagcctagagcagcttttggacttcggcttttgctgcttcttggagatcagcggacatcttgcgcagcttctgtttccttggcttggcatccggtttgactgctaggtgatgcataatgaggtttgtcgaaacacctcccacctcgtcggggccccaggtgaggatatcaatgtttttcttaagcacctccatgatgttctcaacttctctttcacctatgtcgcccccagcgatacaagccttgcgggatcggcgtcgtcgacctgcgggcttcggcgcgtgcttcgcccgatcatgcggttcggcctcaacattgtgcactgctctgttgatcacggccaaatcgccctttgatgtagttgaaggttgaagccccttgaccacgattgaccacgat

SEQ ID NO: 93658 - DNA, 1276 bp, Oryza sativa
ataaacggcgcagacgactccactccacaggcagcttgaccaaggctacacctaatcttccacaccatcagcatcattgtagaactcttccactgatgaatgattgtaaggtgagtatatgacatactcagcaagccacgcacaaatatccaagtgcacaaggataccaaaggatggcatagtagggtttcttttgcaaaagcagcatttagcacatattttagaatttaataaaacagttaagtattaaacaatattaatccaacgctacacaacataccctgttgtataggcccaaccattctgaacaaccatcccggctgcacagttctatctccaaaccaggaatataccattccaaaccaggagctgatcaaattattaccagttatagcatcatttactatggggagaagggtgagactaatcacgaaagacattgttagacccacccataaccgtgggcacggctattcgaatagttttactctgatcagaggtgtaccactgtacccacaagacacaaccccacatcatgtcaccatgtgcctcaataccaccacggtacctgggaaaggagttgtgacaataccgcttgcataacacactccaccgcagcgcaccttcctggatcataatcacccccttaaaaacaaggcatggactcccagcgacccccgtgggcttatcttcccccaattctcagtctggtgccccgcaatgaaccatgctatacaaaagataaagccgttgcccacgctggcttgagggtggcacggctaatgtttcacaaccgaaactcgtgaaccgatccttaattgtcatgagcacgactctcaaaaccatatgctcacaacccaccattaccaggttttagttggcacattaattaattaaccaatcacgattgaccatcgtgagctatcattaagccatcattaagtaatagtgagtcataagttatcccaaaagtgagctaatgtttctaagcatggctaagcaatcacatctaatatctagttgaaccaatatatatagcccaactagtcaagttaaaataacccaaggtatcaaggaataaaggaatcaagaacaaaaagggctataacaaacaataggttaattccacccaatgacattcgaaaataaatgcattagttgaatagaaacaattgcttgaaacgggatcaacatgctcaaagggttgtttgggatctgggagactggcctttctggccttggaactcttcaaattcttatactgggaaaacggact

SEQ ID NO: 93659 - DNA, 711 bp, Oryza sativa
ccataatgtgttccatgtgtcgcaattgaaaaagtgtttaagggtacctaccgaagaagctaatcttgaacagatagaagtccaagagcatctgacctatgttgagaaaccaatccgtattttggaaatagatgagagaagaaccaggaatcgagttatccatttttgcaaagtccagtggagtaatcactcggaagaagaatcaacttgggaacgagaagatgaattgaagtcagctcatccgcatctattcgccagttcttccgaatctcgaggacgagattctgtttaaggggggtaggtttgtcacaccctgaaaattcaaaatatataaattggcgtttaaatggaatttttagaatttattttaaaagcctagaagagaagatctatttataataaataaatcccaatataaaatggggccagataaaatttcattaaatactttgcttaattctataattcgtagatttttctgggatttatttgagctaaggaagtatttttaataaatggaattgcatttaagaaataatttaaattgaaaaaggttttaaaagtcttcttttggctttgggccgaaagtcggcccaaaaccgctctctctctcctcggcccagacggcccagtccgagccgccgctcttctctctctcccgctgacaggtgggccccacctgtcagggtcgtcgtcttcgtcgcgccgccg

SEQ ID NO: 93660 - DNA, 5009 bp, Oryza sativa
atgtcagtgaccacggccctctgaatttacgtaagaggatctcaatcccttcagtgacctagtcccccttcctctatccccccctctatctactgattgatgtccttgtttaacatatcttatgttgtgtgtaggatggtgatagatatcccaggaacaactggagtcaactgtatgcatagcatctgttagcaaatttaatttcatcgtaatcttttagattaaaaacaacaattcctaattttcttagatgtgttcattgccccataatcaacaaaagtacatattaattgttacaataaatagttcgtatcttactgaattgctatatgatagccgactttatagcaattcggtaagaaacaaaattcattgaagaagcactctatagccaatggctagtaaccatgagatatggagttcatgaatattaaaaagaaatgctaaaatgaactatcagggagaaggttagaaacaaatttaaactaaatccatgcctacaaagctacaacatgtcaacaatgctagctacttgcataggaaagcttacctaacatgtgtaacatatttgctaaatccctgcctagctaccggagctttgcagtttagcaaatatgttacattaagtcattaactttgccgcttatgtcaatagttatccccaaaaacaacataaaagatgcagccattaatgagcctaaacgtaaggaaacaagtgaaaagctaccatatggcaggaagagtactaaataattatcggaacaagttgattcttgaacccaagaacaagaagaagactatgttcaacgtgtaagtgctttattcaccacacttttttttagcttaatattgattcctagatttttggggtctaaagatgactatctacaaaaattcagaattgtgtgttgataaaatggcatacacaactccctgaaaagtcacatactaaatgagattaatatttcatattcacttcatctatcaagtttatatatattgttgaggggtagtggcatcaacacagtgttacagctaggagctacatattccctagcttaagactaaaagtataagttaaatatagctaaatcaaacacctaacatattttgtgctaggctaagcccaacttccatatagaagttcaagtttcatagggaggagacgacatgttatggaacatttaaaatagtaaaggtttaaaagctaaggttcacccaaatagacttcaaaatgatttgacaaacgaaattgggggatcctgaagaaaagacgaatctgcatactatagtagtgcatagcagttatgtcaattggaaaaaaaaaatacaaattgatttcgaatatagatgaaatatcataaaactcttgcaggtcaagacctcatgctttatgaaagaccggaactgagatatggtatccaccggatggtatttgtgttattccgacaacttggcaggggaaccgtttttgcaccagagatgcgacacaacttccattgtagaagctttgcgcaacaataccatctggacattgtggccgctacatatttcaactgccaaagggaagccggctctggtggaagaaggttcaggtccgagagttcttaatggacaattggagactatcgattgttgtatggcctttacgaagtggaatttcgaaataacatgcactatagtattgagtgcaccgtaaaaatctatttatgcaacacgataaatagctctaactaccacgacatgtacccaagaatacttatatataatgtcaaaaagaaatgtgcctttgatgatgagacggaaatttttcgattacatagaagacgcaaatgcgcgcatgagcaaacaactacacatatacatcacactcacatgcccatgtatgcgtttctaacaaacgctcaaagagatgaaggctagcggtaaatctccgatctcactaaatttctattgaaaatacacccacatgtgtgcaatatttgtaagcaacacggtttaaaccctggtgggtggaatcatgcacccatgactccaccaccacatcacatgtgcttatccagacgaaaattttcattacaaagcaattatcatagcacaagtgctataggcctcacaaagcaaatattaatggagtattggtttatttactttgatagaaaaaccactagatgcaacacaaacattctgtgcaaaaatcattgttcacaataagacaaataattttctcctctagagtgtgaacaaaaccgttgtaattgttaatacattattcacttcatccatgcatcaagaagcttgtcaaactcttggtcaatttgggtgggagcaaatcatgaatttctgtactatatgcatgaacatcaagtaataattttctagtcaaataaagacaagttatttcattcccttgggaatatggctaaccaatcagtaatttagcatacacttatttaagacattaatctaattcctaaggcttcattcgagaaagtagattggcttagctttgtcaccgcacaaggaacaagaatagcctctagcgtatgattagttaagtattaactattacaaacttgaaaatatggtttatttgattttaaaagaaacttctatatagaaagtttttgcccgaaaacacaccatctagcagttcgggaagcgtgcgcatggtaaatgaagaagttgtaaaagcgaaacgaggaaaagaacacaccctaagaatttatgtagaagcattggagaatggcccaggtgtttgagatagattaaatgagttttaattattacaaatttgaaaaatagatatattcaatattttaaagcaacttctatatagaaagttttcgcatgaaatttaccatttagcagtttgaaaagcgtgaatggaaactgaggtaaaatatgcatcttaatcagaaaagaatggggccgtcacaaggggattataacctccaaccctaggctccgttcttttccgctatgggcatgatccccgatctcttaaacgatgttgtttttgggaaataaaagtaagtttcttagaataaagttttaaaacaattagtagtattactgaaaaatgacatttatgccattcactaagtcacgtttggtaattaaacatacataatacaggctcagtaaatgagagttgagtggaaagggggtggctcaatttcatatcttaaagaagatgatgaaatcaacagaaaacgaggagcatatgttggagtgtgaacccggataacggggatctagcaggaccctcttttggagctagtcacgtgtgactaaggggctcgagcccctctagagcactagaatggattaacacaaagttgtatacaagtccggttcacccagaggtgtaatatcctactcccattgttgtgatctctctctttgtccttgaaggatcttacaagtttatcgactactcagagtagttctgcttcctttctcttcttggtttgattaaatgtgttgaagtctctcctaagccacctagcttcaaaccccatatccttccacggtcctaattctccccttataccttctctagggaataccacctgaccgcagttcgaaggaagattttgttcatatcaacattaggtacaatacgtcttgtctgctgcttctcttctcgcctgctccatcagccttggggtaggccctagaggggcacaccgtgagtggggcacggtgagagcttgccacattaacccgcccaatctatcggggacttggggccacttcaagcagggcccgttttgtgtggggtgcaacaacagctgccacacaccccgcttaatccatacaggctcgcctcgttgggtgtggggcccacttgccattgcttgttgagaggcggtaaaggtgtagttctcggtgagagcgcagtagtcaaccacgctcctccggtttcccatgtccatacaaggaccgacacggccatgctttttgcctcggggtttataaccgtccgatcatgcataaatgaggaggagttaagaacttgaagctagcccaagcacattgtttaacctctgtttgggaactggccttggggtgccttgagggttccgtccttcataatctaggatgggccacgtgccaccccccaaatcgattcctggtatgggtaacaagccgaatgagaggacacgtgcaacttcatggtgcacgtcgtctccttggggaccttggttcctcggtcaccaacaaccttactgtaaggaatacggttcctgtgagataaaatttgaagctaatagtatattcttttagtggaggagtaccagcgaggaggacaaaaaggacatgtaactatttgtcatgtttaagatgtggtgtttaacaatttactactcataatctatgacatgtgggtcctcatgtgcatatgatatgtgggtcacacctaaaagtaacaaatagttaaacatctcaaaaaaaaatccattgtaatttcggttaattcgatttgccattgcaaatatgcctttttagataactaccattacaattcgtttattcatagtcgtgccagtgaaattttacaaaattggaactgtgctactaccgtcacattttccatccatctcctcatttgaacgtgagacccactcgtcagattcatcttcttcatttcacactcccttatcttcttccttccccatctcagtgtcatggcgaggagcgtggggagagcaccttgatgatgcgggcgactaagctcttgttccaataaaggctggaggaggtggtggcggtggaggcgaaaggggaaggggaagggatgggaggaaacttggcccgttggcacaagcctgttggtcattgtctcatcctaggaggtcgagcgacgacgatggtaaagtaagtcgaggaggctaaggaggtcaagcagctggggagagctctcctaggtctccgtgaagctctcacctttgtcttccccctcccccctttgctcctcttcatgccatcgccgttgaagctaa

SEQ ID NO: 93661 - DNA, 936 bp, Oryza sativa
cgccagtctggacgagaagctcaagttcatgacgcggtggatcaccgcccacgtggaggacggcgacggggagctggagaagcccgtgctggtgacggagttcgggctgtcgcaccaggtggagggcttcgaagacgcgcaccgggacgtcctgtacagggcggtgtacgacatcgtccacggctcggccaggcggggcggcgccgccggcggcgcactcgtgtggcagctcgccgccgagggcatggaggagtaccacgacggcttctccatcgtacccagcgagaggccgtccatgatgcggctgatcaaggagcagtcgtgccggctcgccgcggtgaggtacggcgaggagggggccaggaaggtcctcaagacggtgtgcgcctgatcgttctgatcgtttcttttttttaaaaaaaaaaatcacgtcctagcttcttgtcctcttgaagaaaagaagaagaaaaatccagcgacgaaatgcgcaggagaaaatcagtgcgaaatcgcacgaaatagagtgtaatcaatgtgcgtgcacatctgcgtggcaaggttttgcgcagatcggcgccgacgtttgcagatccgccgacacggcccagtgggttttttttttttttttttttttttttttttttttttttttgccttctgtcttttgtgtgtgttgtacgtgcccttgacctttgatatgttaaatcattgtcgagtggcaggggaatccagttatatatagtcatcggacagtgtatttctgcgcgggaggtttttatatagctgcctgtaagcataataaaaagaggcaaatacaacacttaaatgtgatcaggtaaagcattactaaatcgattgatattgagatgattttaattgcgtcgccctggtccaaactttcaaagacggatgtcagattttgcaatatgactaggc

SEQ ID NO: 93662 - DNA, 9977 bp, Oryza sativa
tgggtttcttcaatctctcttcagctttactggttcttggaagaatgatgaagcggcgacgaaatccctcgcgattgatggctactccgggcctctgtttaaagttaagataacgagtggtgaattgtttctgcatgagagcgttaagcgcgcaattccacatagttgggatccttcagcattggctaggtcagtaggtaatcatcttatttgactgatatcagggtccagttctgatcattcgcatcttacattgttctttgtatgctgctgccattgtcatataataacaagctcctcttgtttcatatctcttcagctttatcgagaactatggtacccatattattacttctgttacggttggtggtaaggatgaagtatacataaagcagcattcctcatcccaattatcagaattggagttcagaaattacgtcaaagaaattggaagcgagagattctcagatggggatagcaagttaaatgcaactcccataaattacagtgagaaggttagctccatactgatatttctatttaaattaaaataaaagagggagatggcccacctgtaattgctgataataatagaagatcgtcatgagtcatgaatatcctaattagttacctggaaggctgtatggtcccttctgcgtcgtggctattttgtctacatctttgagaaccacctgaagtcatctgcaatgagaaattagataatttgatatcctaattttagctttttatctggcaaaacatcctaattccagcttgcaaaattgatcaacattttttatcccttatgcaggatatgacagtaatcttcagaaggaggggtggttgtgatcttgttcagaattttaatgattggataaaaactgttcagtcagcaccagatgtcataggcatgacatttctccctatcgtctcacttgtcggtgatatgcctggaaagaagcacctcgctcgtgcaattgaactttatttgaaatgtaagacacgcttctgattcccttgttttgtcagtatgctcatagtgtgctttgcctacttttaacatatagtttaaccccctgagctgttttcctaaagcactatcatttctgtatcaaagtccctttgtagttggccttcgtgttttagtaatgatcatctttttttcttctgtgatcaagatcaacagtttttccctacaatgacaaagtttagtgtgactaagttcatacggtagtggtgcttcacaaagacagtactgttactgtggataactgttttcctgtgtcttttttttctttctgttggactgagatattttcctggataaatatattacatgttggctcttcaatcatgctgttcttttttcactacagacaagccccaaattgaagagttgcagtatttcttggatttccaagttcaactagtttgggctccagtaccaccaggtattgctggtcaacatagaaaggagcctgtatgtccatcacttcagtttagtttgatgggcccaaagctctttgttagcactgaacaggtaaaaggataccccacaggccctttcttttacgcaagtacattagtgtgataatttccttttctagttttgctgtaagttggttaatttaatgttctcaccagctcctaccctgttgactgagtctctgaggcaaagacaaccataattttactttattgccttataacctcaagattatacatttacattggatgaaatatacttttgcttggaagttatgaaaaagataaaataaagtgtttttaagacaataaattctgaaaccaatgtagcacatgctaacatccaatgaaatatatgcagatatctgttgggcgtagaccagtcactggtctgaagctatgcctggaaggagccaaacagaatcgtctggctattcatttgcagcaccttggctcattgccaaaaatatttgtacctcattgggattcccatatcacaattggaccgccaaagtggcaaggccctgaagagcaggatagccgctggtttgaaccaatcaagtggaggaattttgctcatgtcagcactgcgcccatagagtacactgaaacaagtattacagacctatctggtgtttatattgtaacaggagcacaactgggcgtgtgggattttggtgcgaagagtgtactccatcttaaactcttattctccagagttcctggatgcacaattaggagatcagtgtgggaccatagtccatcaagttctttggtccataggacagatgaagcttcatcatcctctagtgataatgctaaacttgtgaagattgttgacatgaccgagacattgaagggcccacaagatgcacctggccattggctggtaacaggagcaaagttgggggtcgagaagggcaagattgttgttcgtgcaaaatactcgttattaaactattgaccaaatgttgaaagcattcattcattcactctgctatgaagcatcctgtttaaagatagcatatgttcttttgttcatcatgtatggtttttaatgtaacatcatatggattcgtgcttcttgttgattctgtgagggattagcgcctagatgtttgtgtccgattacaaaatatttgacctggtctcagtgatctgttaaatcatctctgtgtggcagtagaagatgtatattagtataaatttttgaattggtattttgttatgcgaagtttaacccagtggagttgaactgggcaatgctttttttccccttgtgatatcatgatatgcaatcaacattttatggtgcttatcaaattctatgtgatctgtgcatcctgggtgagaaattccttgaagttaagccaattttatctactgcgtggcataaacactctgatggacatgatgacagttttgtgaattctgcagatgtttggcaaagttgaggcacagcagctgttatggagcatcgatctccagatttgttctgccatttatagcgtggaccgagaaatgcatcactatcttttgtacgtttgtgcttgtgtcagcaagcctagtagtagatcataaacaagctgttgatgttgtctcccgttcatttggaagcctgtacggctgtacctgtctgttgcgatgcattcgtcctggaagagaacaaagtaagaagtggtcgccatcgacgtaaatacgaggacgcatgctccttcctgaattctgatgcggcttctacttctgccattgcaataatctttttggtattatggtatatgattcggtggatatcagggcagcttccaagtggaacgaatggaagctattaaaatcgacttcttttccattttcctcccgtttggattttttttcctaagcaaccatttgcaaaatactttctccagcccttttttaaaaaaaaagatcgtgtagaaacccgaacagaatttcttttgagaataccaatatcagcatcttgactattcacggttgttaggaattaagaacatctgctgtgttcaagttggggcagttatcaagtgattccattcgctgatcccttgtgcgctctgacttggtatttccgcagggacattcttggcgcctccgtggaatgttgattagtttagtggtgatgtcgaaggagatggagatccaaacataacagcgacttagttggaagttggaactggtaagtagtgcactagtgctcaaatcatttgcccagatactgtatgtgaacaacttaaaaatgctttggtttgatcagccatagcaatacacgacattgccatagatagtgtcattttcaactctgtcgttcattctgaagttgatctgttacgtgtaacatagaaggaaacaatttcgtttactttttttttaaaaaaaaggatataagaaatgaaatcatcttatcttcttttttctttgcaaggagaaatatcttgtccctggaaacacatttgtatgaatgattctctggatggcctaatgtgtacatgcaaaaccaactggaaccagtggcaaactaccaaaggtaaatgcaagtgtgaacggatgaagctaatgaaatttttttatgtactgaatcatacacatcgaccaagttatgttaaagaaactgataatctaatacgtcatctgacagctgcaaatcatacacatcgaccaacttgtgttaaagaaagaagatttctctatcctatggcggcctctcttattagttttataaccagattagacaatcctcggaggacccgttcaccaagcaagatgctttatatggccaagcaaatgcgccttctatctgtcactcgatccacctagagttcttggccaaaatggtacgctcatttactgtccagcatttccatcttctcattgtgtcgatactctcactgatgtgtggtttttcatgacatcttaataggaaaacgaggagatgagcaaagtaactcaagctaatggaatagactccagggtatctttcttggtttagctattatcttttatttgaaattgccggtgcctatcatttagtgtagtaacagcatggaaatgctgtccttactatttacatgcatgtagtacataaactaatatctaaatagatttatgcttgaaaatagattgctacttccttcttgttgcattttgatccaatgtgtaagttgtatgaaagctgaacataaacgatacaaagttaactgtgtttttgcacggagctgtattagatattcagatttttttagataatgaaagtttttattgaacccaatcaattatatcaaggtgatacaattttcccgagaacacttctagcatccgcatagtttttttatttttttttagaattgtacagtatttttacctggtctttacatccaatcggatatatgcagctttttttaaattatgaatttagcctattaaagagggaacttagccctcaaataacccaatctgaaattcactcctatggagatttgaactcagaaccttgatatgctacttaggtcactgcaaccactagtatttgtatagttaaaatgcacacaaccggacacacacaaccacactcaaaaaagaaaaaaaaaagataacatggaatgttgagggtcatcgatcctaacactaagtcgtcaaccgtgaacacttccttgaacatcttctccaaatacacagagtattaagagccaacaattctaagactgatcgccagcctataacgctgggtaaaaaacttcttgaccaccttctccagatgtaaacatatcacaaccatcccatatcccatgaatcaggcttctttaggatatagctcatgtacgaagccaatggttgcttattagatattcagatgaggattgatgaatcatttctttctcagtggttgcttatttcttaaatctttatcatatcagtctttctcatttcttgttattcttgaaattttgacaggaacacaaagggcagagcatagcagttgaagccaacagcaaagtaaactcacctaacgcttactatttcgtatctactccctccgtcccaaaatataagaatttttagggttggatacggatattaagaaaataagtagaattaaatgggagaatgttatgattggttgagaagtggaggtagatgagaaaattgaatggtggagagttgtgattgttcgagaaaaaaatgttggtgaagaagttgttatattttaagacaaatcttgagggttagaagttgttatattttggaacggagggagtagtagtttggatttgacttgttttttttttaggaaaattggaattgacttgttactaaaataaataaatgatcaatagggagagactcgtgaagtcgttgaagggaaggttgactggaggggaagacctgcaataagagggagtcatggtggtgttgccaattctttcttcattcttggtaaatttttgccataaacgcttatcacttctcttataaagataaagaaaatgacatgttaagtctttgcagttcataaaatatatttgcattcaggttatttagtacttcagtcttcagcaatgtgcctcttaaaactaaatgagaatccatatagttcacttatcatcatatcatgtcttggtgtataaccaaccgaactagtggtatttataactatgatcaaataaatatcgatctgggttacaataatactctctcgtttttataatataagggattttaggtggaggacgtgacaggtaggacggagagtagttaattagcatatactatgggtcatccgtgagacagattctagcaatttttgtcgattatggtactgtagccgcatgatatggtgtaatgaagttttataactcactaattagcaagcaaaagaactgaaaccggcccggtgagtgatctttgttggttggttatattggccattgcagtgaactttgggctcgagaaccttgcctcgttgtctctagccgtgaaccttatcatctacttcatgacggtcatgcacattggtctgactgatggctccaacctgctgaccaactacatgggcacgagctacatggtcgcagtgctcatctccgtcttcgcggacactttcattggccggtacaagactgtcatcatatcgtcagtgatcgagctcgtggtgcgaatttttaccatcatctacatgatacagttctttgcaacaattctacagcttaattactgcagcaattggaataaactataatactgtagtaaacattcctgcagggcctgctgattcttacactgcaagctcactccaataagctgaagccaccgtattgcgtcttcccgttcgaccccaagtgcgagacggtgagcggcgacggcaggacgcacctctacgtggggctgtacctcgtggcgatcggctcggcgggcatcaaggcggcgctgccggcgcactgcgccgaccagttcgacgagaagcaccccacggagaagctgcagatgtccagcttcttcaactggctgctgctcagcctctgcaccggcggcgccatcagcgtcacggtgttcgtgtggatccagagctacaagggctgggacaaagggttcggcgccgccaccggcgtgatgggcctcgccctcctcgtcttcatcgccggcctccccgggtaccgcatctccgtcgtgcagggcagcaccgcgcttcttgaaatcttgcaggtcgatcggaacgttcacgttgagcatcgcaacgactgtccagtgacagtgcgacacggttactcacaagttctttctttcttttttttttctctgcgttgttttcaggtgtatgttgctgccatcaggaacaggaatatgaagctccctgagaacccagacgagctgtacgagatcagcaagagcaaagctccccctgacacggacttcatggctcacagggataaaccgttcaggttgttaattgatcatgcatgccattttttatgatgcttgattatgcattcgcatgacacttagcgcgttgtactgcgtgtgtgcaggttccttgacaaggcggcgatagtacaggcgccaacggatgaggcgccgagcccatggcggcagtgccgagtgacccaggtggagcacgccaagacggtgctcgccatggtgcccatcttctgcagcgccatcatcatgagcacctgcctcgcgcagctccagacattctccatccagcagggcgtcaccatggacaggaccatcggcacgttcaagatgccgccggcgtcgctgcccatcatcccgctcatcgtcctcgtgttcgcggtgcccatctacgagcggggcttcgtgcccttcgcccgccgcatcaccggccaccccaacggcatcccgcacctgcagcgggtcggcgtcggcctcgtgctctccatcgtctccatggccatcgccgccgtcgtggaggtgcgccgcaagagggtggcagcaaggcacgggatgctggacgcgaatcccattctcgggaagcagctgcccatctcctgcttctggctggcgccgcagttcaccgtgttcggcgtcgctgacatgttcaccttcatcgggctcctcgagttcttctactcgcaggcgccgccggcgctcaagtccatgtcatcctcgttcctgtggtgccccatgtcgctcgggtacttcctcagcaccatcatcgtcaaggctgtgaacgccgccaccaggggcgccacggcgagcggcggctggttggccggcaacaacatcaaccggaaccacctcgacctcttcttctggctgctcgccgtgctcagcttcctcaacttcctcaactacctcttctgggccagctggtacaagtacaagcctcagcagtcagcccacgtaccagcagagcacaaagtatgatgatcatccagcgtctcgagaaccttggtaataaaagatgtgcagttgttgctaccatttttgcctcacgggtgcacggagtaccaacgtggcaacgtgagtttcccataaggggaagaatatataggtatacggaacttaattctaatcagttccagtacaaagatcatggaattgcatcgtcggtgtgtataaatgtgatattttgaagcacaaattttcatggggttattatagttgggcagcgctgaccgtgagtccgtgaagcgtcagtgcccaatggctccaagcgcccgcgcgcgccaccagctgtcgctgcctctgcgtcgcacatctgccagtgccacctacggcgcatgccgtctgccacgtagagcccaccgtgcccctcgtgtcgtgcagcatgcgcgccaacttgacagcgtcgcgccctacaaaacccaccggatgcatgcgcgtagcgtatgtgacggcattacggaaaacccccaccagcagcagctacgcgaggtcggatcggatggcgtccagcaacgagaagccactgcccacaccgatctctgccgccgccggcggcagcggcggcaacgcgccgccggggaggccgacgacggtggattcgatgctgctggacaagggcgcggcgatgctgcaggcgctgcgcccggtgaagcatatcaagcagcacgtgtgcacgttcgcgctgtacgcgcacgacccgcgccggcaggtggagacccaccacttcgtctcccgcctcaaccaggacgtcctccagtgcgccgtctacgacgccgacgacaagcacgcccgcctcatcggtgcgacgccgcgcgcgcgcgacacgctacatccccgcatgattacagctagctgctaacgagttcgtgtgtatgtgtacatgtgtgtgcaggagtggagtatatcgtgtcgcggaagatcttcgactcgctgccggcggaggagcagcggttgtggcactcgcacgcgcacgagatcaaggcggggttgtgggtgagcccgcacgttcccgggatgctggagaaggcggagctggagaagatggccggcacgttcggcaagttctggtgcacctggcaggtggaccgcggcgaccgcctcccgctgggcgcgccggcgctgatggtgtcgccgcaggacgaccccgcggcggacgtgcgccccgacctcgtgcgcaaccgggacgacaagtaccgctactccacgacggagctgcgggcggcgagggccgacgtcgcggtgccggcggagccgcgaccggggcaggccgactactggctccgccaccgcaagggcttcgccgtggacgtcgtgccgcacgagatgaagtgccacgcgccgttcccgtaagctgtgaacagtacgctggcagagctgtggcacacgactcgtgtacgtgaacgtagtagtgtaggaacgaccgtgggtcgttgtatcgtgtgtacggctccgtcgtaaactcgtaacaccaactgctaccacgtcttctgggcaaaaaatggtgcgtgacttgacttgagcactttcatgtcttggatttcacacagtttttcttttagccagttcaacaa

SEQ ID NO: 93663 - DNA, 1174 bp, Oryza sativa
ttcctgcagccccgagaaggaggcaatccggtcggctcatcaaacacagatgcaaattcctacaataagttagcaactgcagctggcatagcttgctctactccctgggattcaacaacacacaattcaactgagtgaacaatagcatgacgatgaataagtcccttcagctgattaacatacacaggaggacaagaagtcacatctggtaacaccccttgcaatcgcacagtgcgattatttagctcaaattgcaattgtttcctcttccaatcaatatgcataggactgtgacgttccaaccaatccatccccaaaattacttcataacaaccaagaggaagaatcttaagatttgcacagaaagactccccttgagtccactattgacaatcaagcatttcttccccacattgcaacagacccccatcagcaatacgtaccgtcagtggcttaacagaacgacgacaaccagctaaccgatcagccaattgaacactgataaagttgtgtgtgctactcgagtcaacaagcatgagtacttcatggtgctgaatcaaactctgcaaccgtactgacttgggtgactctgtgcccagaacagcttcacgagaaatagtcaacagagcaccctcctgctcaccaatttcttcaggttcagtttgcaaagattcagcagcaggttcatcagacacaggttcatctacagaaaaaagttgcagcaattcctccacaacatgaagttgaacggtgggtccacaacgatgctcgcgactccaccgctcaccacaagtatggcagagacccttagctcgacgatacgctcgaagagtagcaaacttgtcatcaacagggacagcctttgagtcctcagattttacacaccagctcccccaggttgtcgcacaggttgattgacgaccggaaccacccgagagaaactgcgagaagtcctagaaatttcatgtcgtcgcctatcccgacgaacaacatcaagtacttcctcctgtaaacaagccaactcgacagcagtatccaaatcggcaggccggtgaagcaaaattgtagcgcgaatttccccccgtaacccttctatgaattgggtcacaaaaaaatgggtgttccacgaagggtgatgagcgtgcatcccatgcatcaactcattgaacttctc

SEQ ID NO: 93664 - DNA, 787 bp, Oryza sativa
aattcctgcagccctccgtgctctatggaacaatcacctagaagcaatgtcagaagactatcgtcgcaactattaatgtgcacacacagtgcaacagatggttctaataaatatcagagatatgttgcagtcaatggggaaagatatacgatcgtttcctttgcccgaaatagacgagttacatgacacgacaaatggtttacctagggagatcattgaagaatccacgattaaggtagaccctcaagatgtaccattatcagactccctcaacaccgaacaaagggttgcttatgatgagattctagctgcaattgatcgcaaggaaggaggcttgttcttcgtggacggcctaggaggcacaggaaaaactttcctatacaaggcgttgctagctacagtccgcaaacagggaaagattgctgtggccacggctacatctggagttgctgcttcaataatgcctggaggaaggaccgcacactcccgattcaagataccactaaggatagatgatggggctatttgtagtttcacaaaacaaagtggaacaaccaagttactttagacagcgtcgctaatcatatgggacgaagcctcaaagattcaactttagtacaatacaagtataaatgatactctagtatgggaggaagtaatgccatgtattgagaaattatactgttcagcatgttcaacgcaaatatgtgagaatatctgtttgagtttttttttacaaaatatattttcattaattaggtgcattgttcttcccgatacttggaaa

SEQ ID NO: 93665 - DNA, 863 bp, Oryza sativa
cctgactagaataagaggaagaacattatcagaatgtaccataaatagccatgatgcattttacagttccttaacaacaatgtcaaatttctaaaatgtgccacacaaaaaatcacaaaggtgtatgacattgcacctgatccaaagctcgtttcatggctaaggtagcacctctaccatcattttgtggctgagttatgtggtgtgcgtcacctgaaagagtcattcacaatgaaaggcatcctaacgacagaataaacaaaactctttgtggaataggaggataccagacattccatagcctctcacttctgcataaatttttgccccacgttcttttgcatgatcaagtgcctacagaagagtatatggttaaccctcttaaggtcaaataagatgaactaaatgacactttccagacatagaaaaaaatgcatacacgatagagaaaaagaattagaatattaagggatcaataagtggatatgtgagtcaaactgatcataagacagatcaaagtattaaatggctgatattaaactacactcaaccagaaacttcagaacgaaggtgtaaaataccaacatttttctgaactcacctccaacaccataactccacaaccttcaccaatcctattaattattttgaaacaaagataagaatagccacacatgaaaaaggaaaaaaagaaagggggtatgatttgataaaggatgacatacacaaatccatctctaccacaatcaaatggcctggaagccgcttgaggaagagagttatattttgtagacaatgctcttaatctgaaaaacaaataacatcacaatgaaataagataaggttggccacactaatcagag

SEQ ID NO: 93666 - DNA, 1780 bp, Oryza sativa
ttcgtctctacaggatctgacaaggccttatcggctctgggcgtccccagccgaagatcccttaggttcctcagaggccttttcaagacggcgtaaagggacataaggacaggtttcaacgcgaggtgtcatcagggtaagggatcatcaggcgaaaacactttgattgtaatatgggcctaaaaataggcttcattgatactgtaaggtgtcttacaggtatggatggtattgactcatacatagaatttacgtagttggtcaatgttccaagaatttgctaactcgcgaccgtcgccgtctgcgattttgaatgcgcctggccacaagacttgtgtgatcgtgtaaggtccttcccattttggtgagagtttgtttcgccctgcttggctttgaactcgttggaggacgtagtcgccgatcgaaggtatgcgtgctcggatgcgcttctcgtggtaacggcgaagggcctgttgatagctggctgctcggacggcaacctgttcacgatgctcctcaagaagatttacatcgatgtcccgctgttcctcctggtcctcatcgcagtgcttctgtactcgtgtactctgatgtcgtagctcgccgggaagcatagcctcagagccgtacacaaggaagaagggtgtttccttgttagacgttgtcggtgtggtgcgtacggcccatagtactgatgggagttcttcaacccattttttgtcgtgtgacatgagtctgtcgtagacgcgggtttttatcccttgtagtactatgccgtttgccctctcgacttgtccgttgctttgagggtgagagaccgaggcgaagcatattttgacccctagcccgatgcagtaatcctggaaatcgacgctgatgaactgggagccgttgtcagttatgatgcggtgcggtagtccgtatctgcaaaatatccctttgatgaatttgatggcgttgtcggccttgatttcccccgtgggtactgcttcgatccatttagtgaacttgtcgatcgccacgaataggaatctgtagccgccctgccctcgtgggaatggcccaagtatatctagcccctagcacgagaacggccaagttagagggatagtctggagcgcttgcgcgggtagctttgtgtgtttactgtggaattgacaggcttcgcatcgctagaccatgtcgcatgcatctttaagggcggttggccagaaaaagccttgtcgaaaagctttcccgaccaatgtccgaccggcggcatgtaacccacatatgccttcatgtataccgaggagaaggtgtctgccgtcgtcggtcgagacgcatttgagaagtaccccgtttggcgctttcttgtatagatcgttgccgaccatacagtagatctttgctttacgggttattttctcggcctctgtatcgtcctcaggcaactccttgctgttgacgaatttgattagtgggatgcgccagtcgtctgtggtctcgatgtcggcgacggcacgttctaccttggtgacctctgagctaatgtcgggggtgtccgagctaacttcgccgctaacctctttcactgatggcttcgtcaggatgtcgagaaaagtgccaggctcgagcgattctcgtctggacgcacgtcgtgctaggtcgtctggctcaatgttgtccttgcggtagacatgtcggacctcgatcccatcgaaccttttctctagcttcctgacttctgcgagatacttggataactcggggttagagcatttataatctttgtgcacct

SEQ ID NO: 93667 - DNA, 1236 bp, Oryza sativa
attttcacatgattttagagcagaaagtttttgattggaaaagactatacctactacgtttttcttactgaactcttattagcattgatgtgtcatgctattaatatatcctagattttttataatcccatatagttaaatcaatcggttgagataattgagggttgagatcattgagggtaagagtttagtaagaaaattttaattggtgtagcagtgctcttttgaatttattgtttgaaatagcgcgtatcgacgaacatattcctacaaatttgagatgaaatgttataggattttcagaggattcagttcggtttccgcaagataagcatgcagtgttccaaaggataactaaagagtagattacttttgcaatgagtttacagttcaactagttactaactagtccaatgctacaacgtcgcaatggtcacttgccagaaaatacaacaactgttctccactgtttaaacacaatttcacatctatatatcactggatagcaattaagctccccaaattattattgaatcaatcagaagtacccaaaaaaaaacagagaatcccaaaacatgactactgtacagaaatcagtcaggagggccactgcaaacaaggcgtttgcttcatgctcagtttcagtcagcacagcaagaccgacgcttcttcagtcttcacaccaaatccgggtcattcttgggtccagcagccacctcctcgacgtgcaatggcttcttgtagagctggagcagcagcgacgagcagacgacgctcaccgacgaggccgccatgcaagctccggcgagccatggcggcagccggatgccggtgaacgggaacaggacgcccgcggcgaccggcatgcccaggacgttgtagcccagagcccagacgtagttgagccggattcttgagagggtcttcctggagagatcgatggcagtgatcacatcctcgaggctgctcctcatcaggacaatgtcggcagcttcgatggcgacgtcggttccagccccaatcgccaggcctacgtctgcagcggctagagccggcgagtcgtttatcccgtcgccgaccatggccaccgtcaaccctttcatctgtgaacaaatgatgtgatgtaagttggaataatggtggtaaaatctgtgatctattccaactttgtttttgctgcaaggagaaaagattgcacctgccagtccttgatcttttcggctttaccacctggat

SEQ ID NO: 93668 - DNA, 2591 bp, Oryza sativa
ttcctgcagcccctactctgtggcagagcagacgatgatccgcatgtccggatgccgcccacgctgacgcccacgacatgctcggctcatcaccagctcgcgatcgaggcggcggcgacgacgccgaggcctccgagcagccgcagccgcagccgcagccgccattgtcgccgcgcgcggggggcggcgaggcgagggggctcgtgctcgcgtgcgccgacctcgtccaccggggggacctcgacggggcgcgccgcgtcgccgaagccgtgctcgccgccgccgacccacgcggcgaggctggcgaccgcctcgcccaccacttcgcccgcgcgctcctcgctctccgcggaggaggcaagggtggtcatggcggcggcggcggtggcgtggtgccgtcgtcggcggcgtacctggcgtacatcaagatcgcgccgttcctgcggttcgcgcacctgacggcgaaccaggcgatcctggaggcggcggcggcggacgccggcggcgcgcaccggcgcgtgctgcacatcgtcgacctcgacgcggcgcacggcgtgcagtggccgccgctcctgcaggccatcgccgaccgcgccgaccccgccgtcggcccgccgcccgaggtgaggctcaccggcgccggcaccgaccgcgacgtgctcctccgcaccggcgaccgcctccgcgccttctcgagctccctcaacctccccttccgcttccaccccctcatactcccctgcaccgccgagctcgccgccgacccgaccgccgccctggagttgcacccggacgagacgctggccgtcaactgcgtgctgttccttcacaagctcggcggcgacggtgagctcgccgccttcctcaggtgggtcaagtccatgaaccccgccgtggtgaccatcgccgagagagaaggagtcctcggaggtgacgtcgacgacgacaacgtcccggacgagctgccgcggcgggtggcggcggcgatggactactactcgtcggtgttcgacgcgctggaggccacggtgccgccggcgagcgcggaccggctggcggtggagcaggagatcctcagccgggagatcgacgcggcggtggcggcgcccggcgccggcggcggcgggcgcgctcgcgacttcgacgcgtgggcgtccgccgcgcgcgccgcgggcctcgcgccgcgaccgctgagcgcgttcgctgcgtcgcaggcgcggctgctgctgcggctgcactacccgtcggaggggtacaaggccgacgacgacggcggccgcggcgcctgcttcctccggtggcagcagcggccgctcatgtcggtgtcgtcgtggcagccgcagccatagcaatggccaagctcacaagtgatcaaccatggtgttcgacggttcgacctcgagagctccatcaatggcgtctagcttgctctcaagctaaaggtaccccactccatccatcgatcgcattggcaaaaaaaagattggatcttacgaaggatgaactgatcatagtctcagtgcttcatgtatcgatgatctagcattctagctagggatcaagcaatgatcctagctagctaagctaagctacctgccatttttcatggcaactcgagcttggatttgtgatggacacgttgcatgagaaggcgccattgttgggagaagaaaaagaggatcttttgggcattcaacttggtgagccagcttccttctaccactagctctagcaccaaattcttttcattttttttttgcttggcaaatcttgatttttttttcctttagttactcctacttttgtttagctttgatacccaaatctgatattggtggagttgttatagattgttggttttgacactactactactacataatatctagatttctagatctgtgttaattactatgttaaaagggtttgtgcatgcatgcacgctcttgcaaaattaggtcatgttgcatatacaattggtttctttgatctcaaataatgaagatgatctccctattgtggctcaatggattgggctcatttttaaattttatccttgcatttcacttcctctctctgctgtttgatgcgcttgtttgtattataactaatcatgctttggccaccactagctataaactaatgcaatttggttggtctttgttttacttaggggggtaatgaacaatgatcactcttgtgtgctgcgaaaggccagtgcattcttgcacactgtagctagtaattaattactatatttataccactcttgtgtagctaagctagctagtataattctcaaatgtgtgctagctaagctatagctgctgcattaagagaacaaaaaatagtagaatcatgtctcctgctgcctaattaaggagaattttattgtgttcttgtcctgtgtcagtgtgtctatgccccagatatgctgggaagctgtccttgggagagcatggaggaaatggcatgatcccatgcatcaatggcaaccctaattcctgccccctgtcccctctaacaaaatcatgggatttctcaagcccaagtacccccttttggtggcacaccctgcaatccttaaatct

SEQ ID NO: 93669 - DNA, 5690 bp, Oryza sativa
tatgaaagattgagatattttcttttgtcaaaggatttcaaaattggaaaagttgacaccaccctttttacaaaaatcattgatgatgatttctttgtgtgccaaatttatgttgatgacatcatattcggttctactaatgaggtattttgcaagaaatttggtgatatgatgtcgagggaatttgagatgtccatgattggagagttgagcttcttccttggacttcaaatcaagcaactcaaggatgggacgttcgtgagccaaaccaagtacatcaaggatctactcaagaggtttggcttggaggatgcgaagcccatcaagacacctatggcaaccaacgggcatctcgaccttgatgagggaggtaaaccggtagatttaaagctttatcgttctatgattggtagcttgctttaccttaccgcatctaggccggatatcatgtttagtgtttgcacgtgtgcacggtttcaagccgctcctaaagagtgtcacttagtggccgtgaaaaggattctaagatatttaaagtattcctctactattggcttgtggtacccaaaaggtgctaaatttaagcttgctggctattccgattcggattatgccggttgcaaagtggatagaaagagcacatccggtagttgccaaatgcttggtagatcccttgtgtcatggtcatccaagaaacaaaactccgtagccctctccaccgccgaggcggaatatgtttcggcaggtagttgttgtgcccaattgctttggatgaaacaaaccttgttggactatggcatatctttcaccaaaacctcactcctatgtgacaatgatagtgccataaagatagccaataacccagtctaacattctagaaccaagcatattgacatacgccatcacttcttaagagatcatgttgccaagtgtgacatagtcattagccacataagaaccgaggatcaactagccgacatttttaccaagcctcttgatgaaacccgcttttgcaagttgaggaatgagttaaatgtcatagacttctctaatatggcttgagatggtgcaccatggttgcttcttttgcatattgtatatttgctcctatttgttcttatgctttggatttattgtcatttggttcttcattgcgaaatggagcatgtcacattaaggaggagtcttgcactcttgcatgtgttccacttccttttatatgtgagcaaatcaactaaaagtgctagtagtgttttcaaaatgaccaagtcaacataagtcaaaacttctgcaaaatcgatgcattttgaaaactatctcttggaaaatgttttaaaaggttccctatatgttttccaagcctcacattgcaagaaaaatgatttttgaatgaaaatgccattttggccctcttttgaagaaactagattcttagttttggataaaatgagatttatccccaaaatgagattgagaaggaatttgaggaaagtttcaaaacaaagttggtagaggagaagttttgaaatgtttttggtgttcaaacctatttcaaaaaccaaatcattcaaaagttatttgaaaatcaaattcgcccaaaaacccctatagaccataaaaggtcacctcctagcgctcaagtgagttttgttgcaaatcttcataattttcaaatgttatgaatggttggcaatattttaactcacacatttcaaaattgctccaaaaatcaatttttttattgaattttattgtgtgggggtagccgaactgtgcaagggctatgcacagtcggctgggggccaggcggtctgaccggtgctatatgcacggtctgatcggcctgatggcggcggtctgaccggccacttgggcccggtctgaccggccgcacccttgaggtctgaccggccgataatagccggtctgaccggccagggatagtgggcccaggaatctttctttttcttctctcttcttcccctacctgactccatctcctcccattcagctttcttcttccccaactcgaaaaaacacctcctctctcttttcccaaaccctagtcacctccctctaccaaattccctcggtctgaccgtggatttctctccggttacaccgtaagtgattctcctccgcttcctctctctattccatggattggtttgtgtttttgttgaagtttttgatccatggcatggaaccctaggtgaagcacgaggtgttcttcgatttgcaccaatagtgggtagtttcttggtgtgattcaactccttcaaccggtaaatcactctccctcttgcgcattatctcaaatcggtctatttcaatctctagggttttgggtagtttcccccattattccaatcttgatgaaataggccataccctttgatgttcaagttccaaacttgtgcaatattgttctagcaatattttagactcatttgtgtgattgttggaaggatttggttgtgctcctgtcagtggcggtctgatcggcaggcggtctgaccggcaccaaagcggcggtctgaccggcctagggcaggcggtctgaccggctaggggccgtcggtttgactgacttgacgccggcggtctgacagtccctggcccccggtctgaccgcccctgacaggcagcacccccattccttcctcttcactatgtggcttctaaaattgttgcttatccatcctttgctccttgtttttcagctatgcctccccgcactcgccatggtcgtcgtgagcccatgcccaatcccgtcaatgagaatgaggaatcaagcggagatgagtatgttcaaagtgatgatgacaatatggaaaatgttgagggtgatgagatggaagtaagtgatgatggtgatgacaatgggagtggcaatggtgaagatgatgaggcaagtgatgatgggagtcctctcgattccaccatccaatttgtgtttaatttgaggaatgctcaacaatacactatcctccgtcatcatgatcaattccggaggcctaacgattgtaatgatccaagatttcatacccagttccaaaagtccgtgtatgaacaagtgtatgccaacaaagccttcgccgaacacaagtggatttcttggaggcacattggtgagacaccggagtttgaagatttgcaagagatgttctggaccgttgggattgatagaattgtcaccatgaagcaatcttttgatgaagatctcatccggcaattctatgccaccgtatgggtgtccggcgattgtgatgcaatgaagtggatgtcggggacccttcaatgctctatcaaccgccgtgaattcaaggagctcttgcacattcgcttcaacaatggggatgaccttcatgatgagcacacccacaaccccttccccattgatcacttttctcagatttatgaagacgggggaaggcacacatatggaaaggtggcgggttagagggctctcccaagtgtgatcaaccacatagtaagggccaccatcctcccaagatgcggcaacaatgatgacatacgcggagttgcttggcatgtcattgatgccattttggatggtcgtcggtttgatgttatcaaccttatgatgaaggagattgccatctcaaaggggactattggacaaggaatctattatgctccctacataatgaggttgattcaaagcaagttgggacaaattggtcacaatttaaaagaacataaggagtacaagcctcgtctccaactctcctcccctaaagctcctcgtgtgcgccaaccaacatttgatcaaggtgcaagctcaagtgcagccccccctcctcctcatgggtctgatccaagtgcttttttccatccacaatatgcctactttggaatgcaacccaatgaattcttcaacccggtccttggggctattaataccctaagtgaaagcattcaacgcttatccaccgggcatgaagcattgcatgaagatgttcgtggcttgcgcaccgatgttggcaacttgaatacttcggtgggaagattgcatactagggtgggtgtattggattcttgagtccaaaccttggagagtacccaagcttttggctatcatcgtcgccgtgatgcttctcatccttccacttcggcgcgtcctccttctcctccgcaagagtgaagacctttttggtgcttgatgccaaaagggggagaaaagtgtgttttatgttttgtgggttgggactagtagtagtgaggttagtcacctcatatttaataggttaaggaggtttggactatattttgtatgggtatgggctattactctatattgtgtgttctttgtcgttttgttaaactctctatgtcatttggacccttcatggtcttgtaatagcctacatttatttgtgagcactttatgtggtcttgatgtgaacttgtgctatgatggatggttggtgtgacattgatatacttgtgaccatcttatgcattcggttgattcatatgtgaagttcacattataatttgcatatgtgttgtgctatgttgaattgtgaaattgaaatgtgcattggctccatatttgctatttgtgtttgttatccatatgtttagggggagcttttgcttgtcaatgcaatatatgtccatgtgctctatgtttgattatatatatttgtggtgttcgtcatcaattaccaaaaagggggagattgaagcatctaggcccccggtgttaattttggtaattaatgacaagcgctaattgtggactaaccgttgtctttgagctatacattttaagtcaggtccacgttatatgtgcgcatggatgattatcgatggattaaaattgacggcgcaaagcaaagagaaagaagacggtaaaactagtgctttaatttagaattgatcgaggtgtagggcgatcaaaattgctagtttattttctagtttcgcagtactattaagaggggtaattacctagcaaagagatgattgaattaccacattatgtcattgcattttcatttgtgctctctttttcatcacacgcacattcacttgcaaattcactgggttcggcctgaccagggggcggtcataccgcccacttgggccacttggccggtctgaccggcgtgccctggccggactgaccgaccccaagcgggcggtctgaccggcgcataaggccggtctgaccggcggcacttgcccgatcagaccggccccctggaggccgagatgatgctgctcgggatggccgaaacagagccgacggagccgtagtcggtctgaccgagccgaggccggtctgactgcccactcaactccggtctgaccggccaggccgatggggccctctgacagcacttcaacggctagttttctagccattgcagagtagcacggtctgaccggccacatacctccggtcaaacaggcagagcacaaagttgggggatttcgcccccaacagctagttttggcgggtgggagtataaatactcccccaccagcagcaaggggactctcttggcacccaattcaattgcatacatcccttgcacgtctctcacacccacttgagctttgtgttcatccatctagtgtgttaaagggttgattagccaagagtcaagtgcattgcttccatttgtagacctagtgtggcacttgattgatcatct

SEQ ID NO: 93670 - DNA, 772 bp, Oryza sativa
ccagatccccttccctctgccgcggggccgtcgccgtcgagggtcatcgccatcggagtggcggcggggtggccagtccggcatgggctttccggatctagcctcgggcagcaacggcggtggcttgctggcgaggtcagcgcccggtcgccctcctcccgctcccctctctccctccagccgtcgccgtcgccaaccccagactccgccgccccgtgccgcctcacaggtcacctcgccgatgactccgccgccctcggcacccccgcccagcgccgcctcgcgggtcgcctcgccgatgtctggctcgcccttctcctcttcaaggccgccgagctcctcctcgccgtcacgatggcggctggtggagcggatcgacgagcgggcggcgccgtgggagagaggcaagggtaggagggggatttggggggagcggcgaggagacaggagcctgcagtgggtctcctcccagggacgagggttgtgtctctgcgaaaagtggtcgctccttgcaaagacccgcgttcctctgcttggcgccacgttcctagcctgggagacgactcacgctgaaaaggggatgggaggcaaacggccgtttgcgagggcacgggtcgagggtagggatggcaacgggtgcgtacccattgggttcacccaccccatacccacacccattgaaatgaaatacgcccgctccaatacccacacccgctcacgggtgaaaaattcccccatacccacacccgcatgggtgacgggctgcaggaat

SEQ ID NO: 93671 - DNA, 1180 bp, Oryza sativa
ataagtcttgatcaaaccaaatttagagctcttttcgtctaaaacaaatatctttgaagattccatgctctatcttgatgccatccatctacatgtttttacagggtgaaggctacaatgtcggattcggaacctgcactgggaaggttctgcctgcacttccatgatccaacatatagaggatagcctgctttcatctcatcagtgtgtcaataatctctgaagaaagcatgcaatgaggcaatgtatctagctagttacatctatattttagtgcttagtgatggtaaaaatactaataaggtatgcttccctgagctttacagaagggatgtaattaatgttctccagttacaataagaacttatttgaagtcgtcattgtctcagtgattttggcatgcaatgctggatgtgaaaatcgatgtaatgttggtcgcatgatcgaacggttcagaacgttgaggccaaaattttggtttggattttggaggtgagctggtgaaaccactcgtgcatgctgcatgtattgcagggctatgctagtacgtggtagcaagctatctggtaaaagcaaaagtaaaaacacaacaaaatgttttactgggtgcaaatcagggttcgacttaccgtcggtaaccgcgcggttactaggtttaccgcgggtgtatggtaatataaataccgcggtaaccttcttaaattcaaataaatttaaaaaataatttgaatttttgataaattttgcatggtttttcacggttaactgtggttaccgcgcggtaaccccggccccggcggtttgggaaaccctggtgcaaatcaccttttgtacgcacgaatctcatagcaattcctcttgtttgccgattgaagaaagccttgtatggtctcaaacaagcaccgagaacgttgatttgcaaaattcaagatggccatgatgaattaagctagatttagacagagctcatgtgatcattctttgtttgttccttatacggcttatggtatggttatttttatattttgtacgaatcagatcagtttccatccgaatcagaatcagaaaaagaaaaacatatattccaaacaaataagaatcaaacaaaaaaataattgaactgaagagattaaactacgacaactaaacggataacaattaattaattaatcaattaacg

SEQ ID NO: 93672 - DNA, 1348 bp, Oryza sativa
cgacgtgatggtcaccttgtcgatcaccacgttcttgctctcgtatatgttgaggtggaagaacttgctgttcttcagcgttatccccctcactgtcacgttcgtcgagtagtcgatcaccaagctctgcatccatccattgttttaattaattgcccattattagtcatacagagaagcaagaagataacaatacaaattactatcacagcattggttattttgcccatgtcaattaattataaatggactgtgatactcaatagtgtttgctggttaaaagaccagcttaggctatattcagatgtggaggttggaaactccaccttcccaaaggcaaaatggagtgatctattagcatttgattaattaaacgttagctaaaataaactttaaaaatatattaatataatttttttaaaaaaacaactattttatattttttataaaaaaacacaacgtttaacagtttgtaaagcgtgcgcatgaaaaacgagagagtataagatttattcgaaactaattaattcgatgttataggtgttacttttttgtatatacaaatttagctgaatttaaataagtttgaatagaaaaatagaactactttatgatatgaaacggaggaggaggtagctatagagagagacgatgggggtgtgggttgcttacattggggaggatcttgcagttgtagttcttgttgcactggttgtgggtccagacgagggggccctggccgtcgatgatgccgtggccgttgatggcgaagttgtcgacgtgctccacctcgatccagttggtcttgtaggcgttgaggtcgccggtgccgaggaggttgccgtcgaggcggaggatgatgctgctggtgcacggccccttgaggttgagcgcgccggtgaggtagttccccggcgggatcacgatcttctgcgtccccgtcgcgttgcacgcgttcttccacgcctgcagcacgaacgccgtgctgtcgctcgtcccgtcgcccttcgcccccagctgcgcgatgtccagcggccccgccggcaccgacggcgccgcccccgccgcccccggcgtggccggcgtgtacggcgccgccggcgtcgcccccgccgccgcacccgccgctgcagcccccggcgctgccggcgtggccggcgtgtactgcgctgtggcgaacgccacggacaccatcagcgccgccgccgccgccgcgatggcggcggcggtggtggcggatagagacgaggtcgtccttctcgtggaggaaaccatgttgatatcttagtaggtacggcgctgtcgaggaggggcgcgccgccggattatatatacggcgggaggggga

SEQ ID NO: 93673 - DNA, 1644 bp, Oryza sativa
ctgttcgcctgacaaagttagaaaaaagttaaggttagatgacatgagacagcaaactaggaacatcacacgacattcaacaaaaattattagcatttgcatctaagaagccaacctctgcaccagcagccaaatcacacagctctagtagcggtatcttggagaacacctttgtttgaacaacagaaggtttaccgacagtcagcgttccagttttatcaaatatgatagctttaacctgcacataaagaaatacaaggaatagtttagtgtcacaatataaaaaaaatagaatacatttgatgtgagaaaaaataatacatgacatagaaatcatctcagttaccttgtgagctttctcaagtgcattgccacccttaataagaacaccttgagaagcaccttttccagtggcaaccataacagcagtcggggtagccagtccaagagcacacgggcatgcaacaacaagaacagatattccaaactgcagagcaagctcaaagctatccattgcctttggaatccattctcgagggtatatgtcgaattgcccagctacgaaccagccaagccatgtaagaaatgcagccaccacaaccttaaaatgagagggaccaatatgagatgaagaaagagacgatctcacagaaagtatgcatgagaagcatcaaaagtagttaggaaacatttgcaagtatcaatcagggtaacatttctcataagtaaccagctgtttacagaggaggtgaacttggtaaggagtagagttaaaactgctactccactaaattgaatataatttgctctacgattctacagtagaagctggggtaggttcaagaaagtttccagatgaatgctgactaagtctagggtagaaataccaagaaattattagtgcgataactagtgaccagtacaggtaaagtttccagtgcagttgactatgtgtctactgtctaggataaatacctcgattacctgcgtagccagttgttattaaccagtagctaggcaggtagaatatagcaatgttgcaattttgtaaacgctggtgggaaatagcacgaagggaatttgcaggagaaaacaagcgaacctaccgttgggacaaaaaaccgtgaaatcctatctgccaacttctgaactggagcccttgcaagttgagcagcttcaactaactgaactatctgtgacaaagctgtttctgacccaacatgagtgaccttaacaattatacaaccattgtcatttacagtaccaccaataacctgttaaaaacaagtcaattgaaccatcaggatactagttcataacaagagcaaatacaatcaggatccaaaaaataccaaccttgtctcctggtttctttgcaatgggccttgcttcaccagttatcatactttcattcacatgactttggcctttgatgacaacaccatcaacagggactttttccccagggacaatcttaatgacatcatttctctgaagtaactgagtgctgatctccgtttctgaaatggcatttccatctttgtccaaagtaagaagacaagctgtttctggtgcaagttcagtcaacttcgacaaagcatctgatgtctttcctttggccaccacctccagatatttccccag

SEQ ID NO: 93674 - DNA, 589 bp, Oryza sativa
tagtgcttctggaggtcatgtagagggaaacttttcgcctcatgaagcatttgcaattggtgggacaaatagtgtaagaggatatgaagaaggtgctgttggttctggccgctcatatgctgttggtagtggagaagtctcttgccgcatggtaggctttgtcactttttatggaatgttctgtctttagtagaaggggcttaacctgaatcatcagtacagtaaaatatatacttacatacacaactacttgttttcccccataaatacctagttgataacatggatatgcatacataaaagaaaactaaaaatagtagtatttgagattaaaattattttgcaacttaagatgaagttatatttgttggactggatgtatttaagaatatagttaacttggtgaggacactatgtgatgcacaaaatggcaaatagttgtatctataccaaatatttcatgagttgtatcactctaataatatttttttcctttgctttagacgggtatggagaacagtatattaatttctataccaaaattgctctgtcatgatgacaagtgcatattatgacctgatgcatgatg

SEQ ID NO: 93675 - DNA, 1059 bp, Oryza sativa
tcttcatgcaccctagctactaccttagctcgcattgatccatccatccatccatccatggaggactacgcccaaaccaacctgatctcgagaggccatggccatcatcatcaacccgagctcatgaaggaattccctttcctcagcctcatttcatctacctcttcttgcatcagcagcagtggtcagcagcagcagcagcagcaagatgatgatggccatggcggccatgatcgtcatcagctgctccggtacggttgctgcagctgcaacaaacagcaggaggaagaggaggaggaggtcacggttgccttgcgcataggcctaccggccgtctcgtcggcgtcggcgtcgccgtcgccggcgatggcgaaccatggggctagtgcttctagtacaggagttgctggagatgatggcggcggcggcgccatggccggcgtgggtgtggaggtggagagcgtgcggaggagcggcggcggtggcggcggcgggcagtactggatcccgacggcggcgcagatcctcgccggcgccacccagttctcctgccccgtctgccgcaagaccttcaacagatacaacaacctccaggtatttatacgtgcaaaaaacacatatatacttaaataatggagtatatgacaagtgtgttttaaattcctactccgatccccatttgatctatatggtcataaaaagatataccaataaatttctagcaattgagcatatttatgagttatgatcagctatcttatgaaactcccaacaatcgatgaagtttatcattagtcattataatgtgtcttagtgaatgtgcatgctcttgcttacgtcgtggtgtgtttgtgtaattaatgcttgtcatagtggagagtgaattttaaactcgagagacgtcccctcgttgcacttaaatagttataaaaaaataagatgatatattaacatgtgatatatcacttcataaatatgtaacttaaaatttaacttgtacgtgtaaaaaaaaattaactgagaatatatgttaactagctataatttaatttgattttt

SEQ ID NO: 93676 - DNA, 687 bp, Oryza sativa
ctcaaacttcacatctttcaagcccacaactagatcacgttttgaaagtttgctcaattgattcatgccaacatgggctagccttctatgccaaaggcaacccaaagaagtttttgcaactaaacaagttttcaaatttgcttcactagaattgaaatcaaccaaataaagatttccatatctaaaacctttgaacacacaagacttgtcaagaaggctagaaacaataacttcttgcgggaagaaagcacatgacaagccaagatcacaaatttgagcaaccgaaagcaaattaaaatttagagatttacaaagagagacattgtcaattgacaaatcattggagatagcaattttacctaacctaattacctttcctttgctattgtctccaaatgtcactttctcttgttcattccctcctacttcaaatgtggtgaacatagccctatcaccagtcatgtgttgagtgcatccactatcaagcacccaatggctcccaccggtgtggtagttcacctacaaaagaagatcaagctcttttaggtacccaaacttgtttgggtccttgaaggttagagaccaaagctttgggcacccaaatggcattctttttaccaccgagtataggggaacccacatatctagcaacaatgctaccatcatgagccttcctaatcatataat

SEQ ID NO: 93677 - DNA, 706 bp, Oryza sativa
ggcaatatcatgacgaaacactgatgtgtcttgtactaggacaatgcatactgtctgcatagttattgcagaaattctgtgtctcaaatacaaatttcaacttactttagctatattctaatacagccgattttgttcatacatgatttcagatctcattcttgaagcagttttatgattctgttggtaaacctgattatcaagtacttagatcagcttttgttcaggtcagatgcatctctgagtaacttcagctcaatcataagtgtcattgtactatttttgaagctaataggacataattttttccccagaggcactacccaaaccgtcctgattttgatttccacaagtacatggttcgtgctcttgagcatgattttaaagaagtagttggaatcaggttagtatcttggttaaaatactaactttacttgattaaaaactacatcatctttactgtatctaatgctatgcaattacatgcagctggtacctatggcttttcgttattgtcttcctgctactgaatataaatggtaactcccataaacctaaaaacaagtgccctcatgtaattgtttggataactgaattccatcacactgatatctacttaaattttcttttctttcttttttttcttttttttttgctgggagatatccacttaagttaccatacgacttattctatttctagtacc

SEQ ID NO: 93678 - DNA, 860 bp, Oryza sativa
acaggaagctgaactcagcaacttactaaagaatttattgggttcccatctgctgaggtttctataccaggttgaatcaactcctttagtactcctgtagagaattgtgaaaatggttatatagatctttgggcagtgcacattgtacattcattaatgcagtgctaaaacgagctgagaagtataatgggaaacgcaatggtcatcatttaaagccatgccattttcctgtttagctagatgtaatggttccgtcctgattttcctttcattttttttggggcatgtaacagataatttaaattattagaagtattcttatgcaaaaaaatgtaatttgaaagctattgttcctacagtacagatttacaatctacattacggaaaaagtagtacaagtgaaaacttgaaggggcaaatatttaactaaagcaatcaaactcattatacctctacattgctgctaaagtgatttcatttcacatcaccagatttaggaaagaaaatcgttattggtcaaggataggtaaaacaagatgatactagatactcatgaagaagcatgtatgggatatgtttgtgatcacaccttcaatgtcatagagaattagataattaatcccaatagttgagaaccagcgtaaaagttgcttgaccttcaaagcattctttgcctctctgctatctactacaacacccaagtatgcaagtctctcaagatgtagatttcggtacttgggcaacaacttgaatgaaatgagatagcattctagatcattcttcagatgtgacaatgaaccaaagaagctgatcaccaagtggacaaggcaccacagcaaccctaagatgagctttaaaat

SEQ ID NO: 93679 - DNA, 770 bp, Oryza sativa
acccctatacgattaggcttatccagatttgtagtactaggtggtgcctaatcatgtactagtatttggggatggagggagtaattagttttctgcagagcctggctgattatgctgggtgttatatgtaattgcctccatcccaaaaagaccttattgtgcatagcaagaaatgaagtctttctgggaaggaggtagtaatacttagaaatcctctattagtgaactgttgattattgaactttgcgatctgaagtgctcttagttgcagtaattttaaatgcttgctcgctcctacaattgtggctgactttgtgttctcttgttcttaaacagttcgctcccaagacgtttattcctgcattgtttggtcatgcttcaaatgacatgttcattcagcctcaccactgtgatcgtattcaccaggcgtatggggtaatgcataatgtagtttgttttattaatgccactcaaaatcaaataaataatacataaatcgctaattgactgttcctggcttcctgctgaagaatacattattatttgtttaaaattaaatcatgtttattgtacagggggataaaagtataataaaatttgagggtgatcacaactccccaagacctcaatcatattatgattcagtttcaatgtgcttctataatactttgcatcctcctcaattgcctgtgaaatgctccaataatctaggtgctttcaaagttggcacggtgaccaatgaggtaaagcttcttaaaatacgttacaaa

SEQ ID NO: 93680 - DNA, 1893 bp, Oryza sativa
cctgcagcccctataatgataaaaggtgatggtttgatttgaaccacaattaggtgatgctgtagaggctaatgcagtcaaatctgtctttggtgaccatgcaacatcaggtggtcttgcattgtcctcaacaaaggtatagcccccacactcatgtgcaactaattcatcacaattccttcgtctcccattcacgacaaatggcacaacattcttcagggagcaattggtcatctgcttggggcagctgggtcagtggaagcaatcttcaccgtattagccatccaccatgtatgttgtctacagttactgaccaccaacagtttgagttcaggagttctctgcataacattttatcttcgattttcagggcatcgctccaccgacacttaatctagaaaaaccagacacgctgtttgaaggcgcgttcatgcctctatcttccccaaagaagatgcctatccgagctgccatctcgaattcctttgggtttggtggaaccaacacgtcgctgctgttctcgtgccctccttagttgtttctaacagcaccctgtctgttttgcctgaagagctgtagctgaacatccacagagattttttttttccctgcacaaacaccgggaggcaccatccgcgtgcactgagcagaagctgagatttcagtcattttttcaccctgtgtgcggcatgccccattgttcttgtgtttgctaattttgtgactcggaggagtatctttttttttttgttttcaattttatcttaagttaaatcataaattcatatattgtctcgctggattgtgaattacctcgtacatagagatgatgtatttgtaattttgttttacatgtgaggctgaaaatgcctgagactgattttgcaacaggcagactggatgacagaagtgtttaagggctagattgatgcaaaataaactttttcaaaatttggcaatgacaaaatttttgtaagttaacattatcaaatttcagtagaatagattaaatgtgttattgtcaaaattctgtaggcattaccaacgtttggtaacaaactaaatacatccatatatttgtcattttttttgaaaaaatgatatggttcaaaacgacgtccatcttacttcctccgtttcacaatgtaagtcattctagcatttcccacattatgacttatgttgtgcaacggaggaagtaacaggctataagttgaagttggctatagagcgtgccttgccaaccatacaagactagatcagagtttgttgctggggctcgtttggttaagggcccttttgaaacgcaggataggaaaaacacagaaataggaaaaacgtaggaattgaagtggcgtgttttcctaatcctacaggaatggaaaacacaggaaatatgaagagggtccctttgatagcaccataggaaacaaacaaagcaaaggatagttttcaagaggttgaacctcttgcttattttcctatgaaattgagctatatgaatacaatcctaaggaaaatttcctatactttcctatgaatcaaagggtttcataggaaaaaattcttagaaaattaaatcctccaaaatttctatgcaaatcctccaattgaagggagccctaaaaggaaattttggtttggtttgttgtgtggatgatgatatcttctagaagaatctggacacgtaggctggctggctggatggatggatggatcggatcgccggtgcgtgtggtgccgggcggttggcaacctggcacgtcactcattcgtgctgagccctcacatgtagccgcgatttctctctccaagcatgggagaagaaattgtttttcttttccttctaaaacagttcatgatgacccctttttaaacgaaaaggttttacaa

SEQ ID NO: 93681 - DNA, 6895 bp, Oryza sativa
gcacgttctttgagattgatcgagaggtttagcaacaacaataagacagtggaaggcaactcgatcaaaatggtggcatagggtgggtgtgctgaacaaagcgcctgatcatctcatgcctcctacgaagttcacttcgtgaaatgaagtgaagaagaagaagaagaagaagaagaagaagaagaagaagaagaagaagaagaagaaaggcttcaagctagctggagacctgcagttttgtgcacaacggttggtcatattgggagatggacttttgaaacagatactgctcattccgttttatattataaagcgttttgattttttttaaaatttaaacttttttaagtttgattaaattcgtaaaaaaaatatagtaacaaacctaaagaattttgatttaaaaaatcaaaacaaattgtaatatgagatggatggagagcatatgacatttcttcgccgatctagaaaagaaacaatgccccatctcatcatagggccccgttctcaagaagcactcgcattggcctggccagaattagcatgacatcactattatgtttttgcattgcaccaccattgctgtgtaaagttcactcaactttttgttgttttgacggaggaaaaaaaaaggatattgcaggctgtatgatattctgaaaagcaggtgttatttctgaatttacagtctaacgagttactgttaaattcatatgtttatatatggttacctcatttagcatagccgacatggggtacccacgctagcgttaaggatcatactattgctctattcgcacttcttaaagatatcaaagtctagtcttcatcataatttttctcttgcaccattggagttgaactcctactgatggatagtagttcattcattaatgtgtgttacacattaattgatttccttgcccagaaaaaaactaatatatacactagattttcagttggttttagactgatggggtaaaaagaaattcctagagctgccaggttatattcataagcgcgtatctgaccaatttttattcccgttcaatgatggggatttgaggtaaacaaggttacaaattgacacatgcacatcttcaattgaatttcctgaaaatgttttcgtaaaggttaagatgatgcattgaaaatgagaactgtcatgtgctttgcatgtgtttttaaactatatatgaatgaatgtaccatatctgaatatttgatttagatgacgaaaggtatcgcaaaatcaatatccaggacaccacattagtgccgcttcgtaagggccatcactgtcagttttggaacagtgctaccaataatgttgagaaatctagtaacaccaacaagatttggctattacataaccaaatatcggtagaaaagttcatcgtcaaaacacacacataaactatttttggtcttgctcaggttagcattacacaaatttgtttagttttgttacggaacaaaacaaacacacccttaagcctcaaaccaacaaatgtcattctttccatctaatataactgaagatatgccaaaatttcgacaaaggccatcatttcaaggtgaaagaacaggcttccaagattgttatctggtgccaatcttcatagagtgactgtatttagtactttacttgtcaagcttcatgcattatgcgtttggtatctggaagctcaatcccagggctccaagcagcatttcttctatgaggtttcatggtacgtcaaaatgaactcacataaagactgactgccagcgtcatttccttctctgaggatcccgagtaaggccgtgctttttcaaagttgtgatatagcttcgcatcagaccaaacttgttagaacctaggtggtgcaagtaatcccatgtaaagatccctgtcttgtgcagatcatcaaacaatatcctgcaatacaaatactaggtcatattatagacatactgtattcttgcggaaaatcaaacaagaagtgcatataaaaagccacaaagaattgcttactatttttttttacgaaacaggatcaattgacattatgtgggggaaaacctccacgaatttgataatgcaagaaacatgaccctcaccgtactccgtaatttcctactgattcagctgacattattccaacatgtcgccgcccaaatataacctgatcaaagaaatgcagattggcataatttccaccgtaaaaacttagtagaccgaaattttctagggcaccgaagcgatgccaatattaaagatacagagttaaggtctctgtccggctgctcagctttccaaggctaataatctacaaacgttcaaatttattcataatagaaagtgtagccctttagaaactataaaatgcacgacagctccactgtgaatggatataacgagtgaatgggctgatctgatacaacaagtgaatgagtaaaaatgcaccacattggccatccaacaagctcagaagaccatgtgtgccactgagtacagaaagtgcatggtgcattaccttctcaccagctactgatctgattttgctatcagctgctgggctgtacactctaagaaactcagcaggcagatggaatgagctgccatcctcaaattcaacttctacctgacaaaaaccagtagcacatagctcatgtcaaaagacacacaaacccataccctaatcaacactcatatgaacaattcgagaagaataatggtttaatgataagttgagaaatgagagttgaacattttttctacaaccaattgtctgtttaattgttcctaaaaaaaactaatcatgggatcactacccataacatttcaaaatttaggcatgtaacattagaacacattagaattacatggtacatacgaacaagaggagtacacatattgcacttgaacacaatattacaacctatgctgctcagctaataaaattggttttctcatgagaaattttttacttgcttcaatcatgcctgatggcaacaaagttcttatgcatccttaagcaatcaagtacaaagattgtcatataccctcgtaatctcgttcaccagcaagtcgccgcgacgttgaacaagggattggaacagtgcaactgcttttgggaggggaaggaactcacgaatttgggcgcgcgaagcgcgagcttcgtcagccgcgggggctgcgcctgcgcttgcgccgcgtggagccgccggaccaccgccgcgcccatcgctgcagccatggacggccagccggtgaagcggccggacctagcgggaggaggggcgatgtcgcgaggggcggaggaaggtagggagaggggcggcgacgcggccgcggcgtcgatgcggctacggtggccggcgggcagcggatgcggcggcgaggcgaggcgaggcgaggcgaggggcgcccggagattcgggagggagaggggtagcgatggtgacgtggcgagagaataattggagtattgatttggaattttggattaaaatcataacgggaaacgctacacgagaacttttatttttcttacaaactcttactccctcctttttgttttatatattatattatttgttttgattttttttcatagttaaacatatttagctttgatcaaacttttagaaaaaaaaataacatcatttacaacatagtttcattaaatgtaacatcggatatattttgatactatgtttgtgtgatgaaaatgcagctatgtttttctataaacttagttaaaattttaaaaaattaactagagaaaatttagagcgacttttaatatgaaacggaggggtatcaatgttgatgtgttttcttgggagcaaatctattcgtctagctaaattaaatgattatttaaaaatttgtttcttaaaagttttataaaattttagtagtaataaatcataatcgtgtttattttccttttaaaaaatacactttgatttaacatgtctcgatttaataaataaattgaattttaacatgcttcatgtaaaattttgtttaaattctataggaagtggggacatatttacgcatttcaaaaaaaacattctcaactttagtggtgtaaatcatctctcctctaccaaaattatacatgtgtcatttgtcttttaccatcttttaccttgataaccattgtattatcttgtttttaacatttcatatattttatgtagcattttagatctctatggatttcttttatccttttctcgaatgttgtttttgatgtttgttatagtgttgttttttaaagtgctatcacactaaaatgcgttgttttagcgtcacaactattgtgacactaaaatagaagccattcaaatttcctattatagatatctaagaataataggttatctagtgctagtcatgcatggttacaatggtttacatatattatgttcttacattcatcaattcacaggcacattttaagtgaacttttttttctaccatgttatcatcatcacacggttcttaataaaaaggcaacgataaggcataatgcatagtgaattccaaattgagcgaaggcggtcactttgcgatattgtgccaattccagttttgaacgaccgcatacttgtttcatagctttcaactgagcggtagacccgacacaactgacggataagcggattgagcgcaaaagcgcatccgttttcttgctccttggcttcaagcaatcgattgaatctggattcctttgcttatcctttctggctataatctctcttgttccgttttcgcaatgtgttcgctataaatatcatataactattacgaataaacaacatcaattggtttgccaaaatttaaaagcctccatcaacaaataagcgtagtaatgcataatgtttatatcgtctcaactgactagggaatttggagatgcattgagacgtctatttttcattaatttttagtgaattttgacaaatttcaaataaaaccgttagagatgcacattttaaaatttgaacgtgaaactcgtacgcaattcgtttaggctgtgagaatcgtacctatgcgtaatacttctacaacttgtgtcaacacggttaaacatgcttcaaattaaattatactcaatacacaagtttgaatctgattcgaatataaattaaaaaatatcccacgtgtaaagcacgacaaaacgttttaaacttgccccgacaaattttgttttgttcaagagacaaaaaaaaaaaagaaaaagaaaaagaaaagagaaagctattcccagtttcccaccgattacctcggcttcgttaacgttctcgtttcccacggctattgcctcctccttccctctcctctcctcctctcgtctcgccctcctcctccccacctccacaacccaaccccacccccacccccacctcctcgcggagatccccctcctcgccgcgctccccgccggaatccgcggcgagcggcgagcgtcccgagccccggatcgccgggaaccgcgccggatcccgcgggggctcggccgccgcgagcgagctctccccggcggcgtttccccggcagatccgatccgaggaatcctatcgcgagggcgttggcgctgttgggcggggtggggggaaaaacttctgcagaggaggaggaggaggaattggggggaggccgtggcgacgcctaggtcccttgcgccgtggacgccatgattgagcagttcgtcaatttcgtcatccggccgccccggtacccacattccgtcgcccttgtttgcttgtggtgtgaatttggcatggttggtacattggcatgtggccgtacgtactgttgtgaattgggagatttgcatgattaatgcgagcctcacgtacatgcagcttgggttcctcgattgctagtagattaggtagaatctaggttgttttgagtttatgttttattcgagcaaaggggaaccacgggcattatttattgaaaccagtcattagttcgtacagaaccatggaagcaagatgagcattcaagctactaggatatgctggaagcgccaagttctagctcgaaattcgatacattatgcctccgtaatccatgctagagaaaagaagcaaagaaaccaataatgtgcttgaaagtagcccaaagttactttgacatgtttcagtaaaatttctgtagaaaagatacaaaggaaacaaaaaggtgcttgaaactagcccaaagttacattgtctggtttcagtacaacttttgtcaatgcaatatgctggctctgaagcctccaccctgagcagtttgtgagggaggctgaaccggtcatgctaatcttaccaatgattcatttcaaaagtttgcatgtcaagtgtgagaacgaggatttgtacctaaggatagtcatcttggatatgatggtacattggcccttgattttctttagagcacagtaacctgcttactgttaacagaaacctgataggagtacatgggctcttgatgttgtagatcggtaccatgtgccataaaagctagagttaggtacaatggaatggtcattgcagttggcattgtgtgggtagttgtgcatgtatgggcatgctctataatgcctataacatataccattaagaagtagctttagtgtggcacgataatctagcccatgctcacatgacaaatgtgggcaacctgctgagtggagggataacgagaaaactgttagcagttgaccttcttaggtgtcggattttttcattctggttgcgaatattatggatatgtctttttcaaacttatctttgtttaaggggaggtgttttttgcattgagttttgaattggaacatctgcacatggaaatgttttctcttcactgcatttcaaagctgaaaaatctcataataggtgt

SEQ ID NO: 93682 - DNA, 1365 bp, Oryza sativa
aagtttgactgcaattatggacatctttgttgatagccttattctgcctttaccagcttacgaatgcaagaggccttacaataaaatgcagccactatgttcctgctttcattccagagaatacttctcttccatgtgtgatttactgccatggaaataggtatttaccttgtgtgctcagtgctagcatattagtctgagtcgtgttttctttaacattcagattagtgtattttgatatattaatatgtgctcctaagcctttggaaaccaaattaatattaagttagtagcacacgttatgagctagcatttcctcttaactgatgagattcatctcaagcaatcaccgatatcttttggaatctttaacaggcttttgctttgactcaatgcagtggatgccgggcagatgcaaatgaagctgctgttatactgcttcctgcaaatatcactgtttttacacttgatttttccgggtcaggtctatcaggtggagattatgtaagccttggttggcatgaggtatataatcagtatcacttttgttcttctacatttatatcatggataattacattattctgaaattttctagaaagaggacctaaaatgtgtggtgtcatacctacggaccactaagcaagtttcctgtataggcctttgggggcgatcgatgggtgctgttacaaggtaccttttagtttggatatactgcatgctccttttacttggtggtggagatttatttatttcacttcacgtgacttgattgatatgttacaccaaacagagatcaacattgaacaaaattatctgtacttaagtggcctctgattctcccgttttgctctttgataatgtgctttagaaggtttttaggctttgagttcatgtcatgtataagatgtcttaaatatgtgatctttgcgtaacggatccatcccaattcattcgttgttttgtgaactaatgtaatacagcctactctatggagcagaagattcctcgattgctggaatggtattggatagtgctttcactaacttatatggcttgatgatggagcttgtggatgtctacaaaatccgggttcctaaattcacggtatgcacatattctgtataaagttgcttttgttccataacaaaatgacatggaatgctgcaatattgcattggcataatttgtagggtatcatggcttataatagctatgattctttcttgtttctttttgggaaatcagattgttctattgtggcttaatagctcaatatttgcccatcgaaaccatggttttactattcagcactcagtcacttagctcttagttgcaattgttattttttgagcaattattcaa

SEQ ID NO: 93683 - DNA, 1102 bp, Oryza sativa
tctattgtaatctacaagttttatggccttaattgtaagatattatatcttgctgttgtcactcaatgactttatgatcatcatattattctgcaaaaaagtactatctttgcttcagttatgtgtcttcgtttcttgatgctatgttaagttgcttcgaagtagtgttgtagaaatttttgctctgaaaaaattgatacaacacaaagcatataagaggccatttgcttcataatttgcttcatacatctaattgttctcctgacaaacgggtttatatatgtttcttctctttactttatgctgtcgcacatgcatcctataatacagataagagataattaaatcttactactacaatataatttgagagctaatttgctctgaactgtactccaaatctatgcaaaattctggaattttccccacatatctgacctgcttattaccacctgataaaaatggctagctgccacatgttcagatgatatgctgattgctgaattctgaatatgatctagtatgatgaaaaagtttagaggccattcatttgatcgaacaaactcatcatgggtgtttcagcaacacacgtttttttttgttcagttttacaaaactttcagaaatccatcgcgccattgtaagtacatttatcacactcacgctcgctgtcgtcatcaacctctgcaaatctcgacgagctcttccgggccgtcggattccgcggcggcgatcttggacgccgccgacgagaggaaccggaagccggcgtcgctggcgctcttcctcaccgacgccagctgctgcgacctcttgcagtaggcgatcagcccctggatcgggttctccacctccgagctcgcgctgctgctcctccgcagcgccggcgccgccgcgccgccgtcggactcgctcgacgtccgcaccgacgaggaggaggagcacgacgacgactgcggcgcaggggacgtcttgttcgacgtcgagtaccggacgatgacgctggagaaggacctcctgtggccgccgtggtcgcgctctttgtgcttccctcctccgaccgaaccacggccgccgccgctctgtgaggaggcgatgcacc

SEQ ID NO: 93684 - DNA, 755 bp, Oryza sativa
ggcaagccttgctgattctttcttagcggatcttgatgaactttcagacaatgaagcctatcctgtgagttggtttcagttactatgataatacagattttacaatgatttatttattgagaatttgttaactaatcatcaaatttcaggaggaagaaaatgctgaggcagtgggcacggaagagattggtgatgatgatatgcctgacctcgagtctcttaattatgatgaccttgatagtgtttcaaagcttcagaaaacacaacgttacaatgacattatgcaagtatgtgatcaagctcaaaatctcctttttcttgaagatggttttgtcctcttgttttaattggattgttgtttgacttctttcttctagttttctgattttgaagccctgtactgtcctattgtcacaagaaggctatttgcagtcaaacattaatgggtgtgttttagagtccaagacatgtttaactatatactcaatgttacaaatgctttgcgcaaaaagtacaatccttctaaatttgattctaaaggggactgtcatttgtatttttaggtaacaaagccttatgtttccatacatggcaacttacagaatcactctttgtttgcagaaagttgaaaatgcacttcagaaaggtacagatttttccaatcaaaggtcgatcctggaggaagatccagaataccagctgattgttgattgcaatgctctatcagtagatattgagaatgagatcattataat

SEQ ID NO: 93685 - DNA, 1287 bp, Oryza sativa
aatatcagagttgatatgcgcctgcattgtaacatatttgcaattacatcgattagtatttttaatgtaacttttcttttcatagttaactgcgtaggagtcctctcgtcattttgtttttctaatgctctattatttgttttatcgtccaggggatagagttgtcaaatccacaggcccacggcaacctgcttggaagtggaactcagagcacctatttttcagagaccgggacgttctcgaagatcaaaaggacctgagctgataagcaaaagtttcttcttcccatcagcccacagacccgtcataatcctcaggatgcaccgatgaatccattttgtaatgtactccaccttatacccgaattcagcagactttcgtggtgctgtttgcaatctctagaagttcgctaacttccatacggttcaagttaattcgacatgctgcgtttgatctgatgccgtctttgcgttcaacacaatttactgtttttggtaggtgattatcttatctgtcatctcatctttaaagtgtaatccctcttgtttcttacaaggtgctagttttgcgtctagaatttctgaaacaaagataagcatcagttggtgttcccaacttcccaatgttcccatcagtccgctatcaaggcagcgtacacgcaagtggattttacataaaatctttgaccaattaacggcgaatagtctcagcataacctctatgtgatggttgcatccgtatactcaaaacatagccaaatgccaaaatttacatgtacaaaaatggggttgctcacactggttcaccctacagagaattgtaagacagaaaactgtctgaaccgagcaaccaaaaatggatacaacgctgcaaacaatgtaaaatgactattcacccattctacaaaaagaaaaaccatcgggatttttacagggctactcgataaagttcgtttactcagcagttcgctgaataatatgatctgctggatatggtgtacgacctagcctttgctcagcctaactcgcaggtcctattacttatccactttgtacagatagtacatctcgagccatcgattcattatgctaacacgaacagaaaatgatctttaagctagtaatgatttaccaaaataaatgctttttgctcatgactgaagaagcccgtcaccttcccaaccaagacgtaacatctgatccactaccttcaagctcaactgcaacattaccagctctattagaacgaaggttaagtggcaaggtagtactttatgggggatccact

SEQ ID NO: 93686 - DNA, 1120 bp, Oryza sativa
aatgatgttctgggcgagaatgtcatgtatatctttttttaatgcataataaaaattcgtactaaaatttaccttcatttggtgagtgataataagcgagatcctactttgtctaacaaatatagtaattttagtccaatgattctccctttaagtggacttgcaaaaaacacttcatgtggtccttaatttcttggttatatcttctattctgtctgcctgaaaatgtcaattggcaatggtatcctggacatggtacagataagtcagtcctacaaattttaggggctaccacattattttcttcacagaatacaactgttatacatgttcctttttctgtttattttcataatggctgaatttgagtaattaatgttccatatcaggtctgatgtgttgggccaggtcatgcctttagttggacgagattggagtcagtctggtgttgctcgtcttttttctgcaataaaggtgtgcttcagaatttattttagtttttgtttctctttattttaggaggatattctacccagttttgcaaatatgggtttctgatgttcttttattctcccaatcaggaaaatggatatcaactattattcctcagtgctagagctatagttcaggcatacctgaccaaaaactttctattcaacctaaaacaggtaaaatatagcatctgtccgttgaatgtgttacctaccattttcatctttagtgatttaatcatatcttcactagaactgatagtaatttttaattctatattgttggtatgtatataaacttggttatcccttggcaactttgcaggatgggaaggtattgcctaatggacctgttgtgatttcacctgatggtttatttccgtcattgtaccgggaaggtaacatcatctctccaatatttacatatccatattcttctattatgacttgctgaataatgattagccttcactgaactactaggatggtctgtataattcaggctcaggttcaacaaagaaaagtagctaacaatgatcaacaatactgttactttatgtactgtaataaaatttgtttaccatgttctaatgtttcctttgttcttctcagttatacgaagagcacca

SEQ ID NO: 93687 - DNA, 3015 bp, Oryza sativa
aattacactgtaacttgcatgtaattacactgtaactatcatgtaacttgtatgaactttcaaaaatctctctgtacatgttatttcggtaaaatggaggtcgtgggaacaaattctttcacatttatgtgtgctatgatttgttttcttcctcaccaaaacaaatcttgtaatagatctaacgattcaaaattatgtgaaacttacatataagttacactgtagttacatggaagttacagtgtaattatatataagttacagtgtaattacactacgattgtattataattacatctgtcaaatttttggggaaaaatttgtcgacaaatatatatgtagtccatttcttttcacttcttccacccatctccctcagtttgggccgttccggcccacggctgccgttggcccagccgaggcagcagccgctcgcgccgccctgcaccctgcccgcgttcgcacgcgctagtcgggtcgcgtgcagcctcgctcctgcctgcgctgctccatgtgccgccccgagctcgtaaccgcgcagctgctcgttgccaatccctcctttgttttccctccttttccaatcctcctcttcctcaaagcaaatgagcacagaagtctgaatcacttctggtttcctctctagacctctaagcgctaaactcgttctattccaaaattttctccagccatagccaagaccggccgtgcgaccaatccgccgtcgtcgaccttctgccgccgcaccacagcactagcaggaccacctctcgtcgaccttctttccctgcttgtatcgagttcctagcatgtttctgtccgccgccatggctgccatcgtggtcggcttcttcggcacctcatctctatcaacaaaccacaaaaatagtatccgctcgtccgggatcatgttttgacgtgctcacccggccacgttcatgttaggaaaccaaagaatcaacaggatcttgaacgaacactctgtgggtgtactatagcgatccggcaaatgtggagaaacgtcatatatttcaagtttcttgtagtgcgtcatctatcataaaatttgttgtagcacgtatatgaattcggagctattgtagatttatatatttcaagttttgaataatttgccttttgctatttactccgccctctagttggtttggtaattttgtcttttgctattagtctctttcgattctgatgctctgcagaacgccacacatcatatgagaaaaattatactccctctgccccaaaatataaaggatgttaggaggatatgacacattctactactatgaatctaatgtgaccatcaagtataggcatacaaccaagcataagaaatataagcattgccaaagaatacatttgatgaacaaaggacctataagatattcaagtccaacgagttttggaatccagttcggcctccgaacacagtactgacttcaacctgacctagctccttgcgtgatgttggacttgttggaaagcttatcttgtcacctttcaaactcatccagtctcatatccaaaattatccgaagtcaacgggaatcgacaaaacaagacagtgttgttgctaaaaccgaacttgggccctagaccttgtaatagactagggctatcttggaagtgtctctctccacctccatgaaccaacacctaatcctagctctattttcctttataaatgtctatgtacaccctctagaataattgggttttgtttagttgaattttactaagtgccattcatcttgtctctagtcctcgctcgattagtcggcgactatagatccagaccccaaatagttggtgcattgatttgttgggtcgattagttcttccacattaattgcaactatttctttgtgcataattacctattcgcaatatttagattgcatcttatcttgttcttgcaatgttctctcgtttgcattgcaagaatcatcaatcgtgcatcatggttggtacgacattgtttgtggtgtagcgattgcacaacgtccttgtcacgcccataaatttagcccaaatttccagactattttgtgtataaatcccgatccaggaatcaagctagggtacacaaaacaacaatttaatatacagatccaaacgtaaataaagcgtaaatacttacagaagaggcacttagtcctcacaccgaatgaaaacagcggcataggcaaatattcagctgttctctaacttcatcttcagctcaaaagcactacacttctgaaaaggaggaataatagcaaggttgggtacaaccaccgtactcagcaaaccacaacaacgttgcattcgtgcagtgggatataaagggaggtttgtgggcatttgcataaggcggttgtaaacatttaaagttgaaaacaataaaaccattgattaattacggcaacattaaatatccactgaacaatgctacaccacgttgaacaggcccaaccaaatcacctgaactacactggtttattaagtcaaattaataataaagtgggactaatcacggtgaatctggttgatcgcccataaccactgttggtaattcttatggtcacagataaaatccgcaaagcacggatataccgatgtagcacttcacccggtgttggtaatttcagctttctttgattttcccgtagtggtatgtactttgacaccatgtagtttactatgttggcataccatgggttggagtcgcgcaccatcattagcatgtcatctctcaagaaatcatttattggctgttcctgtgcatcagtaattcgtagctagacaaatgatccgctacggaattttctactccctttttatccttaatttctaaatcaaattcttggagcagcaaaatccatcttcatagacgtggtttagcatctttcttagtgagcaggtattttagaccagcatgatcagtataaattattaccttagctcccactaagtaagacctaaacttatcgatagaaaaacaaccgcgagcagctc

SEQ ID NO: 93688 - DNA, 1464 bp, Oryza sativa
atgtcgccggagtatgcctactgcgggcatgtctccactaagtcagatatgttcagttttggggtcattgttcttgagatggtgaccggtagaaggagcaacgggatgtatgcttccaccaagtcagatacttatgaatctgccgactccacgtctctactgagctacgtgagtacatattgaggactaatagctttagtttctaactatgtttagagaaaaacgtacgtacatgctctagcttccagttcatgaacaacgagctccatcattgtgcaggtatgggagaaatggaggacacgatccctagctgacgcagtggacgcgtcgttgggtggccgataccctgaaaacgaggtcttcagctgcgtgcagattgggctactgtgtgtccaagagaatccagccgacaggccggacatttcagctgtggtgctaatgttgagcagcaattccacgtcgctgcagactccttctaagccggcgttcttcttcggctctggcagcatcgcaagcttggatgctgctggtggacatgcatttttcggtggccggggttcagaagttgcggccatcagcagtaacaagatgtccagtaaccccgtttcagagaatgaggtcacgatttcagagcttcaaccgaggtagaagaacaaatgcgtctgcatcaattgtcagtattcaggacacttgatgtcccccgaatatcggtggtaatatggcaataatgtccaacagataagttagtgttcagcgtataaattattacactaaagcctctccaaatctctctaagaatgcattcccggtatgaaactaatggaaaagctataatgatatcgattagatcgcacattttgatattggaactactgaaatccttcaaatgatctgagtcgcaaatctcctcgtacgggacatagatgtcatgtccataaattaagccaatttttagactgtcttgtgtatgtctctattcaggaatcaaattaagataaacaaaatgataaattaatatatagatttaaacataaataaaacataaatactttacaaaagaaacatttagtcctcatccaaaagaaaacaacagtacaaaagggacgatttaagcgggcttcagctctactctacattaaaaaaaaaaaactcaaatagggtataaacattggtcctctaaatccttctatagcttagaagcacaagtcttctgaaataagaattaatagtaagattgattacaaccatcatacttatcaagcaacactaatgatgcatacatgcaagggaaggcaaaggttggttatcactatttgcgtaaaggccgttgtgaacatcttttagtttaaaatagtaaaatagttgattatttaaggcaagattaatcttcactaaacaatgctacaccacgttgaacattccaaccaaaccacctgaactacaccagttcactaagtcaaatta

SEQ ID NO: 93689 - DNA, 772 bp, Oryza sativa
gttatattcctgttaatagtgaaatttggtaatcggcaaagacgtcatcggcttagaatcattatcggctgtagcatctcggaatcagccgatgggagttatcaagtcgccaatagtcggattcctgctatatttggttaaggaaatcaatctactaaaggaagcttattcctaagtgaccgagtttaaagagggtgcggcatggcagtttatctattaattaggaacagtttgttagtttccttttatctttaggaaagtatgtttagtgtccgataaggactttatattttcattttatctttaggttagtttctttcttgtccgacaaggacctgtatcaacccatgggtataaatatgtacacccggggtctatgtaatatatcctcacgatcaatacaattcggcgcatcgccacattttaccttttctactttattttatcgtccggcgggacttggcacctgacgcggggctgcatcggtgttcgatctccggcgaaggggtaagtccaatgtttcgtcggcccaggcaattctcatctacgtcggcgtcgttcaaggctgcatcaggacattcgacctcttggattactctggtttggataatatatttgcttggatatttatcatatgtctatgttaatccagtcctagcatctcaatttagctctatcggctgtctctcgctttagggtttctgccggtatcggttaaatcgccttgctagattagattagcctaggcatctaccaccctgaaaatcagtca

SEQ ID NO: 93690 - DNA, 5026 bp, Oryza sativa
ggggaaatagagccagggaccacgtcgagcacttagagtgcaatgaacagtgctattttctatttaacccgattttagtttatcccttgtataaatttcattctataaatcctaatttttacataaataaggtttgcccaatatatgttttaatttagatgaaagtttaccaaattttaatataacccatattttattcttatatatatatttctattgtattatttaaatgaggtctaattctaaaattagcctagataattttggaggctttgagggttctaaaatatcctagtgtggcccttattattacaatagcacattgaatgaacttatatcaatatattttacacggataggttgaatctatttattctataaatagtatattaagactcggtacaacattaatctaattttaaacactcacatattcttgtttatatataaggattaatttatttatatgaccattattttatatgagtgattttcatgtcatgagtaactcggcgacatgttgcaagtatcaatctatatattccggtgaattacttatttataaacacgatcactatagtggtgatcatcatttcatgtgttcttatatttcatgggagattcgattcaaatgaattagatttaatcttactatttctttagctaattgtgacatcaagctatcaatcatggttcgaatatttaatacctaatttgtaatttgtaatagaaattaatatttgacttaactatcttgtgcataattatttgtaggattaaatatattctcgtaaatcatatctattgcttaaatgtagttcttttctttaccttcttggtgatcatttatggtttggcaagcaataggaatcataacaaccagcatgatgcaaaagttttaaaaagttcgaaattttagtgatttttattgttgggaatttttaggatgttacacgagaggccgaccgcgcgggagtgatctctccggcctcgggctgaggaagaggaagaagagggcgcgcccggagtcccctttccgcgtccatgaacgcaccggctctcccggcgcttggcgatggacggcggaggcgaggcagagcacgggagcagcggccacggtgaggaggcgaatgggagaggaaaggaagggagggggaagaccggcttaaatgggcggcaatgtcggtttgagagaggggaaccgacatgggcggtcaagccggcgagctggcgctccggctagcgtccaaagcggggacaggaggtgacgccggcgagaggggaaaaaggggaggaaaagagaaaagagggagagaaagggggcttgcccctttgccgattcgggaaaaagggggaggggagcggcggcgacgcggcagagagaggaggggcgtggcctcctttccttggcggcttgcgcgcggagtggcgggggccgggcggtgacgacggcgatgaccgggggatggtttggagcggcgcgacgacacgggcgacgggaccgggcgacgcggacggcgcaaacgacgcggctcgggcgggaaaccacgcggcgcgcgcgcgagcaacggcgcgcggggccggctttgcgagcggggagctcgcgcgagagaagggggcgctcggcgcgggcgactcccgcgcacgcgcgcgcggcgcgcgggcggagcggaggggagcagagagagaggcgctcggcgcggctctcgcacgcgcgagcagcgagggggggaaaacgcgccgggggggagagagagagagagagaggggggaagagatgggccgagcggaattcggcccatcgaacccgggggaggcaaactagacttttgcggagggattcgatttggaaggaattggattcggaattgatctcgacgatcgatcgcggattgagatcttgagatggcacggacactagacaacaagcaaagaaacaaatttcgcaattagggtttttaagagataattttcccgctaggcgccacgacggaacgggcgctacacttgggctatgctcggcgcccaagttttctaacgttcactctctctttttcatgcatacgttttctaaactgttgaacggtgcgactttttttaaaaaagaaaaatataggaaagttgttttaaaaataatattaatttatttttcaaatttatttaagctaatactcaattaaaaatgcgctaatggatcgacccgttttgcttgctggggagtggagctctgaaaaactaaagatataaggcagtcaagcggcaggggggaaagaacttacgccaccctgccctaccagcagagcaagggctcttctccctgtctgcaagcttcacccttagactccagaatcaacactccaacagcatacaaaagcgacaagattatgtagtgcaccactatctagcaaggtaccggagatcgaggggatgactggagttcgtattgaagaagccttgatgcaggagaagacaatccatgcaacaatcgcaaggaaacttggagtaaccttcatctgtcaagaaggtgattctcacataaaccgttatagcacttagaagaaattatttccatttggttaggtctatctcactaatgaaagaaatgtagccaaagtgccaaaccattcactttgcaggactccgatccgagaaaataataacactagattgaagcacaggttttgggttaaatctaacaacccaatacttgagagtatcactagggagtaggagcacctacaacaccataacaagctcgtcaccgagcatcatgtccggccatggcctatgtcaccgtgattaccttctccatccaaccagccataggaccaccagtccaccacccggccggcagctagcttgaagttggggctgcacagggagtagtacgagagcagctggcgtcggcatccgtggtcgccggcggcagccgtgctgcagagtagagtttggagtagccattagcagagataggcgaggccccgtttggtaggaaaccaaactccaatttctagctctaaactccactctaatgggagccggcttgagtggaagttggggactagctgaagagagaagagttaaggagagagaagagtaccgtagttttggttcacattagtgtctgcacagctgagaataaagtctagcttaaatcaagctcttaaataatctggtagtacagctttcccaggttaataaaatttctcagtattatcaaagcatgtacaatatatatcaaatcgttgtttagataaactttcctaacattttgtaatttcagaacataatatagcgtatggaatatgctacacggatgattgattgattgcagccgaatttaatttaattgggcattgatcagctcaggcaagtctctctcaatcccctgttgatagtttatggtaattttatctatgctaaaagtatattttaaaaactataattcaaatgtagtgttaaggccaaaataattcaaagtaactgtgggtgaagtggtatgagcagcctagtgctaaaataaaccttcgtcatttatgcttgtgtccaaagtgaagactatggagaactaataattattaaatctattcaatgttatgagtatagtttagttttataaattcctttccgtttgacaaaatatacatacaattggtaacagtgtaggatataagtgtagtatataggttatcatattattaatcactcgatccatatatattttaaacatactatttattattgaattgctgaatacgaaagttgtcacccttactgtgtaaccctatataggtttcatgcgttacaagtataagacattgaaaatatggctataacacttgatgtcaaagttatattaaaggtagtttttagctatttgtataatcgttctctgatgtggcaaaacaataatttgtttaatattaattcataatctgaaacattgatcttttgggttaaaattgtggagtgtgatactcgcccatctccaatgctttgtttttcacaactacatgtccagatagctatatagcaaatgcaatatatagtacctttctatagacaccgaaaaattgtgacctttgctgtgagacacctgaagatcgtgtatttgctcgtggacactgtaaaaaagtggtaattagctgctggacactcctcccattattttattatttccgatcaaaaaggagagagaaactttggttaaagacaagtttgcccatgggtctacttgtcaatctctctttctctgttcatcttcttcctctctttctctgttcatgtcttcctctcgctgtcacggcacacctcgccgtccggcctcatccgccggggagacgacttcttctccctccgcgacgagttcgtccgctccgcccacgccgcgctcgccgacgcgttcctgccctgcgacccgcaggactgggagaggaagcacgatgtggtcgccggcgtcgtctcccacccggtggcgcgccgtgttgaggagctccgcgtcgccgccatcaagtccgccgacgggccgtcgtccgacaaggaggtctcggagatggaaggggagttccacctctccctcagtggcagcacccagccgtcggagacgctccgcgtgctcgacctcaccgggtgcggcagtttctccctctccgctggcatggtgttcccgcggctgacgacgctgcggctgcggctgcggctgtgcgtcgtgcaggtcaaggacctgcagggcgtcgtcgactccgcgccagcgctcaccaccgtgcacctcgagtccgtcttcctcgccgggccgaaagaagatggctgcgccagcgcccgcccgggcagtgcaccacgtcggcgtgcgtcgagagagagaggaaaagaaaagaagagagagagagagagaggaaggcgtgtgctgggatgccgccgtgcgctgtcgccgtcagagtgaaacccggcgatgcgccgccgctgccgtcgcccgtcgagaccgagctggctgccgtcgcgcctctgctccgctgcgaggaagaagggg

SEQ ID NO: 93691 - DNA, 738 bp, Oryza sativa
cttggctattccctccaagatctcatagggattaaccccgtgctttgcactcatcgtatccctattgaccccgagagtaccccctccaagacggctcaataatgcgatgcgtgaagttgtaatgaaagaggtcctgaaactcctatatgccgagattatttatcctgtaccatacagtgagtgggttagcccaatccaggttgtgccaaagaagagaagaatgacggtcgttgcaaatgctcaaaatgaacttatcccacaacgaatcgtaaccggatggaggatgtgcatagactaacaatgctacgaaaaaggatcattttccgctaccattcattgacgaaatattggaacgcctagaaaatcattcctttttctgttttctttatgggtattccgggtatcatcaaattcccatccatccggaagaccaaagtaagatgacgttcacatgtctgtacgacacctaagcttatcgtaggatgtccttcggactatgcaacgctcccgcatcttttcaaagatgtatgatgtctattttttcggacatgatcgaggatattatggaagtcttcatggatgacttctctgtctatggaaatgatgtgaccatggctactacggatacatccgttgctcaacgtctcgtacggttgtagtcggatcgtcaacgtttctccgaaatcgtagttatcatcaactcacagaaagatcaggccaacaacagccttgagtgtc

SEQ ID NO: 93692 - DNA, 2956 bp, Oryza sativa
aagttgtcatattttcaaattcaaactcaaactgttcataagaaatgttatatagaaaaatgatcaaaataaaagttgtaaatcttgataagttatacaactttgttgttgataatttttctatttgaaatcatttagtatttgaaaatattgattgaagttgtcatattttcaaattcaaattaaaactattcaaaaaaagttatatataaaaatgaccgaaataaaagttgtaaatcttgataagttatatagctttgttgttgacaatgtttccatttgaaatcacttactacaaaaaatttgttttgactaataaaatgaattattatactacagttaattattttgcacaggtcaactcacaaatataaacatttcatatgaaaaatggaaaaaaaactaagtcatctcaattgggcataagtacagagcccgtcacgaatgagtcatctgtgacgggcctaattgttaccgattgagatataggcatacatatatgttagatgggtagtaaagtcaggcccgtcacggatgacacctatcagtgacgggccgtagtttaggcccgattgagataacattacatttctcaatcgggccctaagttggcgcccgtcatggatgacctaaactaaggcccatcagtgataggtgtcatccatgacggggttgacttttatgcccatctaacatgtctgtgcgacaatatctcaatcgggcgctttttcggcctcatctgtgacggcctgctaattctagtcatgttagctaattctaggcatgtcaggcgctaaggttctgtactagtgatctaatagatcatggaaaatcgggcgctctcctgtagctgccttatatgtgcatgttggctctctctcactctgatgcatgcatacatatgtaccgcctccccatatatgattgaccaccatacattcatacagttcttgctccacaagttctttctcctctctccgtacacaatttaaaccaaaatcatagtttcttttaaattaattattgatctttaatctaattacgtagttgtatttgatgaaattaaaacgttacaatcaaatctcacaacactatatttcaaataaaaatataattatattcttaattgaaacattgtttcatcatacatacaacatgatttatagcaggtgaaacatcacaacatttttttaaaacatccaaagaatacaacgtgcaacatttgtaaatgagctagtgaaacatcagataatatttattgcaatatctaaataacaccacgaaaaccacgtgcaacatttataaatgacatagtgcgacatccgaaattcttattgcaacatccaaataacaccatgtgcaacaaacaaaaatacatttaaaaccttaaagtgtgtgtaacacactgaaaattttgaatttcaaatatggaaaacaaaaattttgaataattaaacacctttctcaaaatttcttcatgcaggttgttgtcaattgacaactgcatcacgtcgaaggacatggttcagttaacaatagttggaaagtaaaagcagccaggcccacctgtcaatggttgttggaggcgtatcacgaggacctttggccgggcctaccgaaaccagaggtgatcaaaagtgcgagtaggaagaaagcggcgaagatcggagaaactgcatgggcaaaggtgatatggcgaaagcagtaacatggagcctacaagctttgccaaagacagacctcgccatggggagacacggtcgaaggttcgaggcaaaagccttgccacggagagcacgagtttcgccaggcatcaggtctcaccacaaggaggcccaacaggccgacacacccttcgaagctttcgccaaaggccgggctgaaacactcaacccattaagggcccatataagcaaaagacacaggatacccatggagatgtccctatcataaggctaaccatgtaaattcccctgtaaacccaagaccttaaaacggagagtctgtaatagggctataagtagccccctaggacaatgtaacaggggatccaaaaaaattttactatgcaatataattgtctttacttccaactacagttgagagatccacgcctttcgacgtgatgcagttgtccattcgacaacagctggcgccgtgtcacaccctgaagttcttttcccaagcctaaattgaatttataaatgacctcaagaaaataccgatgtaaaagcaagagcgaaaccctaataaattaatgcaaataataatcggaattggcatgtggaatttatcttgagttctacatgtcgaaatgtgctaacaagatttttagtggaatttttagagctctagaaataattttaatcaattaaaaatgagcacaagcaatatttaatccctggaaattcatttcctcctttttctttttattttccctccttttccttttcgaataggccgctggcccattctcttcccctccccgctgggccggctgaaggccaaggcccagcagccggccgccttcttccttcttcctttgggtcgccgacaggtggggcccacctgtcgggcccgtctcccagcttcagctcccacaaccgccggcccgctcgctcccgcacctcccgggccacgttggccacgtcgccgccttgccccggcttccccgcgcccactccctctctttcccgcccgcgcccgcgctcgagacggccgggattcgaaattcgaatcccgtctctctcttctccccacctctccccactccgccggcgaaatcgcggccatcccggccataatcgacccccgcgggtctatataaagcgcccccgtctccccctctctctttttcgttttgaaccatccactcccgtgccctccacagccctagtgccgttgcccttcttttcgccgccaccgccaccgctccggccaccgctagccgccgtta

SEQ ID NO: 93693 - DNA, 1129 bp, Oryza sativa
aaaatacaagcacaaacacaacttctccacaggggaatatctcgtctctgcatccaagagccgacgacttaaataaaatacaactctttctttcccttcaagctcctgaatcaagactgagccgattgacttctcaccagctgatagatataatctaaaaggtaatcccttttgtggaggaatcaaaactggaggagagctaagatattccttaatactatccaaagccttctgttgcactgcctcccaagtaaacttttggtcggctttcaatcttaacaatggtgtaaaaggctctaaccttccagacaaattagaaataaaccttctaacaaaatttatcttgccgatcatctcctgcaattccgtctattttctggagactgaattttcttgatcgcattaacactcctttgagttatctcaatccccctctcatgaacaagaaatcccaaaaactggccagccgatacaccgaaagcacactttgttgggttcatcttcaagccatatttcctagtcctctcaaaaaccttccttaaatcggctatgtggtcctctatctctttagacttaacaaccacatcatcaatgtagacctcaaccaaccagccgatcggatcatggtatatgtaattcatggcccattgatatgtagctccagcacttttcaagccgaaagtcatcgtaacccattcaaacaagtcgattgcaccaggacacctaaaagctgtcttatgtatatcttcttcagccatgaagatctgattgtatcctgcatttccatccataaaactcaatatcttgtgccctgaagcagcatcaaccagctgatcggctactgcattggatactcgtcctttggggtagctttgttaaatccctgaaatcaacacacaccctgactttgccgtttttcttgataactggaattatactagaaacccacttggcatatcgacaaggacgaatgaaaccagcatcatataaacgtttaatcttagccttgacaggttcgagcatgtcggctttgcatcttctcggaggttgttggtgcggcctaaaccccggtttgataggtagccgatgttcaacaatcgatcggctgagccctgacatctcataatac

SEQ ID NO: 93694 - DNA, 2037 bp, Oryza sativa
  unsure (1)..(2037): unsure at all n locations
tgtgaaaaccatgttaaccgatgcagttacaacactattccctttagccaatctttttgcttcatcggctgtggcttcatcggctgtaggaacttgattcttaacgcgccactcctgctgcggcttcgttttcttcagccgatggttgatttcttgctcaacctcttccctgttcctcaacctttgaacccttctcttctgattctttgtaaaaataccagaaggacaccattaagtcttcctaccttcattgtcctcttggtcacgatcttgatttactgggcccaacctttgatgaacaggaacccttgcttgccttagccaattgcctttattatatgatcggcttgaacttcctgcaatattgctgtacctaggacaatcctcattggatggcagcctcataccttcattccaacagaatctaaagaactcacaaccccaatgaggatcaagaccgctatcatcttcctcataatacttttcctgatgctaatcatatttcctctgatacttattgataatcataggcgagttcatttgaaaacctcgagcttttccttcatcggctgttcgaccagctgtatgtactatattgacacgaaaaggattgncatcaaccttcatcggcttattggaatcatcaaacttgattntgccttcctcaatagccgcctggatctgctgtctaaagactttacaatcattggtagaatgagatccagaattatgccacttgctatatctcctcttgcctaactcctcagccgatggaattgtatgaccagcaggaagttgaatatgtttttcccgaagtaacaaatcaaagatcttatcagccttggtgatgtcaaagtcatacctctcttcttttcagaactcttcacccattggcatggtataaccttcttgctcctaacccacttggctgctgctacctcggaatcatcatcatcatcatcagatccatatatgtaggtttccttttgtgcaagatgtgacaaactatcaaagtcctgggatgagaatttctccctgattggagctatcataccctaaaaagccaaatctgctaacatcagtcaagcttaagttgtagcacttattcctcatctctctaaacctctgaatgtagtcttgcacaggctcatcatgcctttgcctaatcgctgttaaatcagacaatttcatctcatgaaccccactataaaaatagctatgaaaattcttctccaaatcggtcaactgttgattgatccatatggcaaagaagaaaaccaagtaaaagccgatccagacaaagactagggagacaacctaacccttaaggcgtcgacagtcgatgctttaccacactgagctaagaatcggctagcatgttcataggttgagacactgtctgcctgagaattttgaaaaatcccgaaccttgaacgggttaggcaatggaaccctctcaaaccactcaggatatcgatgccgatacaagtttccagtgtcttttggcttgatcccaaattgctctctcatcacatctgcaatcatatcggcccatggttcctattgaggcaccccctgcacttgctgtggcacaggctcgaacgagttgtactgataagcgaattgaggctgagtcgatcctccttgttgatactgaacttgcggcgatggaggctgatactggtaattcaaattgcccccgtgataattctgaaagtttggctgtatattgcgcaccaaatgttcgggaataacttgaggtatcaccgattgatctggttgcacattatgaaccaaatgctctgggacaacttgatttgcagcgtgctgcctcggctgattgtcgggcgtcctgaacccagccgatgcatttaggaaaccttgctgctgaatcggctgagcaacttgctgcctcggtggcgtctgctgaatcggctgctgttgaactgggtcagcagtaggctgagttggtaaaaacatagctgcaacttgctcttgagttagccgattcacattttgtccactatgctgagactg

SEQ ID NO: 93695 - DNA, 2982 bp, Oryza sativa
acaagatccgtgtgaattgcatcgcgcggggcatcatcgatacaccccttggtgatgatgtacgtttaattctccacacatatgacaccaatttattgcgaaggctggtgcttttgttaaattacatatatttgttccccggttttagattttattttcacatcaaagttctgagttattaattgaccctctacttttattatggatatatatttatttgtttcactcaagaacaattgttgatgctctcaaccacaggtcaagagcggcaataatcctcaccttcagggtgttagcgggacggacttcatacaagacgacatcgcacgaacgccgatgcggcgtgtaggcaagccggaggaggtctcatcgctggtggcgttcctctgcatgccagcggcggcatacatcaccggccaaatcatttgcgtcgacggtggccgcaccctatcttagcagagtatgtttaattgccctaaagccctaaaccatataaagaattagttcctacctcacgcgttgctacggaacaatcgtgttaattgaaggatataatttcagagctagcattgtgtatactctggctaaaacaaaattaaagagcatcatatatattgacgtgtcctttacaatttacgttattattatatactaaaagtctattaaattaagcttcctataaacgctcacgtggcactcctagaaacactcctaggccatcacaaggcattatctaatcttaccatcaattttcacttaaattagtggactcgttattttacatcattggattaaatctattattaaaaaataataactttctccttttatacgatacaagcgctattactgttgttatgtacgtacaagtttatacggtacaaactatgtccttctcccgtacgtatttacgtacatgaaaacaaaacaatagctttacataaaacgccggaataaaaagaaaaaaccatacgcatatacataaaaaagagagcaaaaaaaattacatccaaaaaaattgacaatctttaaaatatgacaataccttactttctgttcgccggaaagaaaagaagaaaccatacgaatgtacataaaaaagatagccacaaaattacatccataaaaatcgacgatctttaaaatatgattttctaaaatatatttcttttttatatataaatatatataggcaaacggagagctataataataatattaagagatcccatcaatgttctttgaaccatcttttaataatttttaaattatatatctaatttgtgattccatggtattcctttaattaaattataaaaattgtgttgcgatcctaaatatatcacaacacatgagggcgtcatataatagttagctggttaatattttttaaaaaagtcagatcatattttggggtgtgaaatatcacttcacaaatatacaacaccattttaaatctacatatataaaaaaataaaaaaaagacaatttagttgtgttttttcaagtagatctgatttaattgtaatttgtttgagattaagattctcaaacttttttttgacattttcagaattattttattggtatttgagaagtgagcagcatacatagtacatagatatgaaaagaaatatcaaaaatagttccactcaatgatctttgctatgattcaaccccttaaatcatcatgtgatttatggtcatattttttctttgccaaatagttttgacacaaatgaacaatgaagtaacatgcacaataaactactcatgatatattttcttgtacttaaggaatttcaatatattagacataattgatggatatttatcataaactccactgacatgactgtaagtgtactccaataaattatttattgtaaataagtttagaaaaataaatatagtcttcaaattagtaaaagtgcctcgtgattatgaacaataggtgttgaaacaaactacgcgctaaactatagatatttgtcaaaatattaaaaataatattgtgctgcggaaattatcgtggtagtatgtctctttagcaataattcttttaaataatgttgaatgattaacctctctcattttcaaaagcgagttttctgtctttatcataaaattttgagtagtattgatcaacgccataaacaaactatgtctaaaaaaactattttgatcacttccatcttctctttgttcttccctaaagggcaacaaactgaaaactccaaaaatatgatattctaaatatttaaaacaaaacacacatagtataaatggaagatttttcactgcaacaaactccatagttatgacacaatattttgcacgattccaattttcagtttagaaattatgtgttgcaataattggaagaaaatcataaccaactttcgaagcaatcctaaacaagtttagaatatcgctacagaaaattgggaaagtcactcacacacaaagtttcataatagaaattcaaccattgttaaataatggtttgtttgggagatttatggagtatcaaccgaattattcgtaacacgcttcaaaattataatttgtgtaaaatactttcttaatcggtattgcttaagtaaccttttttaagctatttgttagtcgtatgctatactatgtaatgcacttcataatcaattatctatgttccacttcatcatctaaaagaaaagtagacatactttgttttgaaaatagataattgtaaattaaaagtaggttctttcgctttttaatggaatggccagggtctctagatctccttttcaaataatctcaaactatattattgataatttatgttttacatcaagttagagcgctctctaattggttcggattgacataacttcaaacatactagcatgtgaaattaaaaatacataggagcgacaaatatatatcgaccctactttatatgatgtgttggacccatattatttttttaagaaaaaa

SEQ ID NO: 93696 - DNA, 4010 bp, Oryza sativa
cagtcgcacgcatattttcgatatgcttctccaaagaacgttttgcttcagatttctcatgtgacaaagcttggctaaaacgttcaacagctttgcgataaaataatctagcacaatccttttctctaccatcagcaaacttaaaacacaactgtaaaagataaggtaggacgtcaatccattaaaagaacctaaatattctatgtgaatgctaacactgtaactcaccaaaaattccttcagaatagttatccttgtatgagcagaaaagttgtgataatgagcaatgacaactgcttcatcctcaggcacctgtttgccatgtttatccaaaggtctatatgtgccagggtagtgagcttttataagacatgtgatggtagatgaaacattcttcttcataggattcgtaatccaagcactagaaacaacatgccatttaccaagttaggtaatattagtgtaaaccaatgaaagtgataaaaaaatatgttcagccatcataatattggatttataggaactatgcatctgtatttcttaaaatttaacatggagtttacaacaagattttcaattattaacaacaatgatatacatattatatggagtgtgtgtttgtgtgtgtgatagacagtgtgtgttttaatataagcagaaatttagagtgtcaacttactctttattgagtggagttatcactgccctatctttctctggaactggtgccatcaaaacatttggaccacgaccacccttactttcttttgttgaagtaaccaaagaatttgaaggttcatcttgtgttgaatcctcaaaatggtcttcaacttcaggatccggataatgtcgatggcgtcttgacatagtacttaactagtaaaaacaagggttattttgcaagcaaatgtagtcattgaagaatagataacatagtaaatttgtaataatgccactgctcatgagaaaatgaaataataatatcacacacacacacacacacacatatatatatcaattgtttagtcactagaatcactatcattgtctgagtcattatctgattctattggcccttcatcttcactgctgcaatcactgtccatggcaacataactctctatgttctcatggctatttggtctatttaaaaaatccatatcttctggatcaacttgctcaacaatatttgattcatgaagcaagctttcatcaccaagctcctgtgaaatgtcagctccaagctgctctccctcttgataatattcagaaactacaggaggaagcgaatcatcaacttcatcgtccactgcaggaacgggtaaagtaccaattggatttgtcttgaatgcaacccaccaatcttttctttcacgtggtggcgatggatatggtgtataatatacttggtccacttggtatgcaagcacaaaaggctcatattgttccaatcttgatgtatggttaacttcaactaggcctagtgctttgtcatacttcactcctttcttaggatcaaaccagacacacttaaatagagccacctttagatcactatcactgacatattccaactctattatctcctgaatagtgccatagtagtcaggcccttggttatcaaaccaatttgctgacacacaaactccactatttgtcattgtcctcgatgatttcttttgttcatatggttgggtacgaaaacgaaacccctgaacatcacatcccttataacacttaaccatgtatcggggcccaatggaaagagcccttacttgttcttcaactgtttcatcttttccagcctgtagaatcaattttcatgaatcatgcattaaaataaataataatccatcagatattacatcatgtattcttaccaactcacgaacccaggttggaaaatctttctcatgcatctcttgtaattgagttgtagtgatgttcctgttttgttgtttcatccccctatcaaatttcctgacatttattgcaataacataaatgtaatatgtcatattcacaaaaatagagcccaagtaataaaataggaaaacagaataatatatacttacaagacatatttgtcaacttctgcacaattgagtaatgcatataccctagcagcctgccattcttctcttgataagttacatgatgtgctctttccaagagtgcgatatgggatagagaatatagatagccagtcagtaggtgctctgaaaccaccatcatcatgtctagggacgcgagtgtgctttgttcgcacatgatcagcaaagtacatagaaataaaattagagacctcctgtactctatacccctctacaattgaaccttcgacacgtgctttgtttcgaaccttcttgcgagcctcatgtaactccctatgaattgagcagaaaacataattatgaaattaatatacaaattcacactttagtacttaaccaaagaaacatacctttcaaatacatacatccagcggtaagctacaggccctccaattaaagcttcataagctagatgcaccaccaagtgttccatacaatcaaaaaatccaggaggaaaaatctgttcaagtttacacacaatgactggcacttccttttgtaggtgcttcatttgttctatatccacctcttttgcacatagttgcctaaagaagtagctcagttctgctaaacacttccagatgtgcttggggaggaaatcacgaaatgccacaggtagcaacctttccatgaagacatggcaatcatgactcttcattcctatgatcttgcctcgattaatatcaacaccctgtgctaaatttgatgcataaccatcagggaatttaagattcttaacccattgcagtaccaatttcttctgtgccttatctagactataacaagcttttggtttcacccatcgacctatagatttttgttgcatatgaagttctttgcgattgcatatattggctaaatcaaattgagccttgacattatctttagtcttctttgggatatccatcaaagtattccatatattgtcaaacacattcttttcaatgtgcatcacatcaaggttgtgccgtactaacaactcacgccagtaaggcaactcccaaaagatagatctttttacccaattatgctcctttccaaaaccctcaatctcttgatttcctgccttggtaccaaatgtaatttgagggagagatttaacacaatcatacacttctgaagatgatcgatgaataggtgggccatctttctcctccttattctggatgaacttgtcttttgcatgtctaaaagggtgtccctttggtaggaaacgcctatgacaatcaaaccaacatggcttgcctccaacttttagccaaaatgactttgtgtcttccatgcaaattggacaagctaattaaccgtgtgtgctccagccgcacaacatcccatatgcaggaaagtcacttactgtccccataagggcagctcgcatgacaaagttctggttttttgagcgatcatatgtcacaacttcttcctctccaaagttgcaaaagttcatcaatagtggatggaagaatacatctatgtctttccagggtgcgtaggccctggtatacccatggtaaggaaaatattatgtgccttcatgcatatgctgggggcaagttatatgggacaacaaaaacaggccaccaggagtaaggggttgcagtttgattaaatggcgtgaatccttctgttgacacccttaaccgcacatttcaggcctcctttgcaaaattaggggtactttgaatcaatatgcttccatgcttcactctctgctgggtgagttaactttttctttctgctttcattgttgcccctctctgattcaagcccatccttgtggtatgtcatgtgtgttccagtgcctcgtgacatgtagagcctctgtaggcgtggaatgattgggaggtagcgaagcaccttctgtggagtgcccttcttattctcagggagttctaa

SEQ ID NO: 93697 - DNA, 1643 bp, Oryza sativa
atgcatcggctaaaaagccgttggctcaatagttgaagcaggtggaccatggtggctcctgcaactttggttaaacctgatagtcatgaacattgtcaatcgcccctctgtgacagaagctgaattcccattgccagagccgattgtgaaagatgacgaagaagagcgcacccatcgcagatgcatgtcatatggagaatatgcatccacatcaaccgatgctggagcgaagctatcggctgagctacaaaaggactggttctgcagcttctacgaaggttttaagaaagatgcacgaatctggtttccttatgaagactcagcagaccttgaacttccatcagactttagatttgaagacattaatcatcgaaaattccaaaaatccagagaaattcctatagctgcaatcagcccatgcatcctcccagtcggcattcaccaagggagaaacatccaagtctcctacgagttttatcacccaatgagcttggccagacgacttggattgggtcaactcccaatcggcttattctttgccgacaatattcagtgccgaggacaaatcgcatccactctaatgatggatcggctacttaacctaccaggaccccctctgggcagtattgataatattgagttggcaggatttagaagcaaaaattttgacagatggtggggtgaatggaagctgcatctatttcatcaatcggctgcaatgtatatgatagatctattcaataacgtcataccccaggtaaactttgtcattactaaattgcataaccagttagccgattcattacttgactaatctcttgctcctgttttgcaaacaacagagtcctcccctccacatcaaagtaatagtagcaagaacattgaatatgcttcaggtttaatctgaatggaggtggactatctcccactctccttcacggcctaactagggaaccagccgatgcaggcaagaaaaggaaaactagatcatcagccatgagtaacttagccttggctccaaagaaaaagaccaaattcaagaaaactcaaccacaaccaactgatatgtcgactgatgatctgcccgccttggatccatctattaaacaagctttagatgaagaagaaattggtgaagatgttgaccaagctgtagccaaaatgagtgacacagaaagaacaccatcggcttcacccaagcaaacgcctccaactccttctgcccccgttcattttacatgagtaagtacctctctttgacttcttctgaaattacctccctctttggctaattacccatagactttgtggttgcagaagaagaaaactgctgtgaagaaaaaaccagcagcaacaattgttaaatcggctccaccagtaagatgtccttaattcttttacttaaacaatctcaaccgattctatataacacttgtctatttcgcagcttcctcctccttctcctcctgtacagcaatcgtcaagtaatcagactccatcggctgtggggagtcatcacgtcgaagaggaagaacaaccagctgcttctgctatcccagtaagtttccctttgtctcaacaattagatcaaaaataatttacccagctcttattctttccaaaattgcctctgcaggctctag

SEQ ID NO: 93698 - DNA, 522 bp, Oryza sativa
tgttttgccatgggaagttagaatcggctatagaaggatagaattgcaagacggtttgacagtcgatgagtattataatcttatggccgatgagagggaggacttggttcaatcgcgtttatgagcccttgctaaggtaccaaagataaggaacgagttgctaggcattataacaagaaagtagtgcctaaggattttttggaaggtgaacttgtatggaagttgattttgtcgattggaactcgggataacaagttcggcaagtggtcaccaaattgggaaggaccgtttcaaatctataaggttgtgtctaaaggggcatatatgttgcaagggcttgatggtgaaggttttgttgggggaaccgggaaaacccggggccccttgcaaaaatggccaaattaaaccctttttttggaaaaaaaagggtaagaagggttattttttaaaacccccccccaaaaaaggtttttggggtttcgggtgacgcatgatcgactcggttgctgatgcatgacagcc

SEQ ID NO: 93699 - DNA, 909 bp, Oryza sativa
taacatatgctaatcacttgtgttttttttttgaaacggtagacggctggagggctaccggttatattagaaggagaaacaagtgaaacaagagttattacaacgtaataagggagcattggggataatacaactcagggataggcagaaggggaagggaggctagttatgggggcttgaaaacaaaattccgtaaatctatgtcttccttgattagcgttgctacatccacaaaggaattggatgtttgtttgaaaattgttgtatttctttggttccaaatatgccatcaagttgagatcagggcattgaattttgctttgctttgtgttgcatttgccgaagatgtaagaggggcaatccactcaggaactgatccccgtggggtagtaggtagaccaagcattgttgagattgactcccaaacctgtcttgtgaaggtacaatccctaaaaaggtgaacagtgtcctctaatgcccgtcagcagagagagcaaatgcaattacaaggttagtgtcttatgagtagattgtggttgtaagtgctttttgatgtaagattagccatccgtgaaaatgttgtttaggctacgcatgagcagaccaaatgatcttgaaagaggggttcatcactgatcctagaaaatgtacttggtaagcacttcttgttgaaaaacatcttgaagaattcaaggatgatgatatgtcatcttcagtgttttcctccagagtgattagagagagcattgttcctagttggacaagttcatgaatggactccacatttgtgatctgcctgaaagaggttaaccaagagtttttagagagttatgttgcaacagttctgctcttccgttgcactagtgagaaaagatctggcaaaatatcttttggacattggtcttgaag

SEQ ID NO: 93700 - DNA, 659 bp, Oryza sativa
catcataacagacaatggctcccagttcattagtgccgacttccaggattactgcatcaggctgggagtcaggatctgcttcgcctcagtttctcaccctcagagcaatggacaggtcgagagagcaaacgacatagtactacaaggaatcaaaacccgtgtatacgacaggcttatgtcacatgacaagaaatgggtcgaataactcccatcggtactatgggccgtgcgcaccacaccgacaacgtccaacaaggagacacccttcttcctcatgtacggcttagaggccatgctccccaccgagctacgatatcagagtatacgagtacagaagtactccgacgaggatcaagatcaacagtgaaacgacgacgtgaacctactcgaggaacaccgagaacgagttgccgtcagggcagctagctaccaacaggcccttcgccggtatcacgagaagcgcatccaagcacatatactttcgatcggcgactacgtcctccaggaggttcaaagccaagcagggcgaaacaaactctcacccaaatgggaaggaccgtacacgatcacacacctcttgcagccaggtgcattcaagattgcagatggcgatggtcgcgagttagcaaaatcttggaacaggggtgcaggaacaagat

SEQ ID NO: 93701 - DNA, 611 bp, Oryza sativa
tttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttaacctcgtacgttgtctcgggcaatttgtttccccccggaagaatgttcttaaagagtttcaataaatcgccaaatgccttgtcactaaccccattttttgccttccattgcaacaactccagagtggtatccaactttttgtgcccctgctcgcaacctgggtacaacgaagttctgtggcctccaacatcttgtccaatttatgggcctccttttcactttcgcagtcctccctagcgtcctgcaacatctgaccaagatcatccgcaacgtcgttaccatcagcagctatttcctcctcgcccgttcgatttccttcaaatccaacatactgagcaaagtccggaatattggcggcttccacttcatcttcttccatttcaacaccttgctctccgtgggatgtccaacaattatagcttggcatgaacccc

SEQ ID NO: 93702 - DNA, 5557 bp, Oryza sativa
ccgccggctcctccccgaagtcaccccgcccctcgccgtcgccgacgccactgccaggacctctcccccctcgccgtcgccttcgcccgtgccaggtcgccgtcgccgccgcacggacctctcccccctcgccgttgccatcgccgccgccatgtcgtccccgccgtcgctcggtaacatttacttttaaaaaaagaaatgtgaaatgtgcaactgtggattgtggattgtttaattgtgcatcgtggattgtgatatgtgcaattgtggattgtttaattttgagaaggtttaattgtggattgttaaatggagatttatgtttaaattgggacttatgttaaattgggatttatgtataattgggacttttgttaaattgagatttatgtataattgggacttttgttaaattggcacctatgttaaattgtgacttatgtttaaattgagacttatgttatattgggatttatgtataattgtgatttttgttaaactgagatttatgtataattgggacttttgttaaattggcacctatgtcaaatggagatttttgtttaattgtgactgatgctaaattgggacctatgttaaattgggacttatgtgaaattaagttattgggacttatgtgaaaataagttaaattgtgacctatgttaaattgagatttatgtataattgggacttatgttaaattgagatttatgtataattgggacttatgttaaattgggacttatgtcaaattgagacttatgtgaaattgcgttaaattgggacttacgtaaaattgggacttatgtcaaatttttttacgtcaagttggaagatgtcgaacgaaaaggttccatccaacgcaccaatagcgcctcaagaaggtaacgctcctcaaaattccggtagcaataagcagccagacgcttctagtgaagaaacgtggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaacctaatggtgtatagagttacctattctgtgcagatggtagtccgacgccgctcgaaacgtaaagccgggaggaacaggacagagcaagaagttgagatggacacccctacgtctgcacctgaacgtacggagacatctacaagtgcaggcgggagtgggaaaaaaagacgtggtgagagaagcaagaataaattacccaaggaaacttacaacgtgattgctctcgatcagtatgggaagcccgtcgagccaccgatagtgcggtccaagttcagcaacgcctgtggcactctagtcaggacacgttgtcccattaatgtcaagttgtgggaaacagtggacgacaacatcaagacacttctctggaatgagttgcagaagtattttgtgttccctcctggatcagagatcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcagatcatacaacagctgaagcattggctttgaggaaaaaaatgtccgagctcgcgaagaagaacagatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgacaactaattagcagcagatagtcgagaaagaaagatcaggacagttcgtcccacggagggagcgagatcagcttactgcggcgttggggacggctgaacactctggacgtgtaaggggtttgtcctcaaagacaagttagaaggtcgggtttccacaagatgcaccaagttataagaagagagacaaatacaaagaacaactatcggacaagatctatgcgcaagtgaaggaacacttctactcgttggcagctgaaaacccgacagcctttccaaggttattccctgatagccagcaacccacacaatccgcatagcaaacaactaatgtacccagcagtataggctcagtgcagacaactaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcctgcagcaggatcttcaaccccatcctcatcgcaggcaatgactgctgccgctcctgccccaccgtcgcctcctgaaccaccgtcacctcgacatccgccgtcaccaccaccgcttaggtcaccgcctcgccaacctacaccaccaccctccccttctcaacaaccgcctctcccggccccgcaaccagttcaagcctctcccacctccccagctaaacagcatgctcccccggctccgccctcagttcaaacctctccacctacaccccaatctgctctggtagaacaagtgcacataccagatggtattacatccgaaccgaagtctaatactttggaactgagtcgtataattccaaagttgatatcgacatacgacccaaaggagattgacaaggataaggagaagttcatgttttcagctttcaggaattctgagaagagaaaagaacttgctcacgtcttgtcagactcccagaagttagtactagcggcccaagatgaagtgcaatcctggttatctgctgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatggaatattttttatctctttccaagacctttacgccctctacaagctagataaaatggacgttaatctcgttgcggctttctgtctgtaagtctgaactctttattacatgttgtacgtttcattcgaaacaaataaaccaaatctcatttcttctttattcattgtatagtatgcaattccacgaagctgatagaactggagcaaaggttggatacgtcgatccaacaagaatatgcaaaacacaacacaccgtagagctgagagaggactgcgagcaattggttggcaagaccccggaagaaaaggaagaatatgtaaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttcttcaaacagagcacacaagtactaccgcaaaagaggtggaccagtacatattccatcccagaagaagttatccgtcaggactggctggccggtactatcaaatttataccaatacaactaattatcgaacagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccattttattttcctttctgtgtgcagatccccgaaatcccatatattgcacaacgattcaacgacactactatcttgaacgtggccgctgacctctgccgattcatccgtcgcgatgtctgcaacgcaagaggtctcttctatgacaaccagagtgaactcgcaatggacgacaaatttaaacctctcagagagtgggagaaagaacatatacaataacatgtacactacttatacatatgcaataacatgatgaaaaaactgtgccacttgctattatatatttgtatgtaaattacgattgaattaatggttatgtattacatgtttgttactgcggcacttgtcttatcttatatgcttactactccgaaatacgataataaatccctcaataatttaatattaattacgaatcaccaaaatgctagaataaatattattttagctattcggaaattgaatttcgcatacggtctacttaagacgcccgcatgcgaaaatagatcttcgcatgcggtcttcttaggtcgaccgcatgggaaaatatatcttcgcatgcggcttcttatatggaccgcatgcgaagatctattttcgcatgcggccgtcttaagtgaccgcatgcgaagatcgatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgaacctgcagccaaacgcaggtaactaattaagcgactgcattttactagttctttcttttgtgttggttcgatctaagcgaatgcatttcttcaagagtcgagggatcgatggatggacatagtatatctagtttccatgtcaatggatgatttttaaacttttgtggaagtttagagacgtaacttcaactttttataaattatttgcaaatctatatatttattgcggtggcgtattcctcgtgatctcttgcatgtgtactgacatataattaatcaatagatcgagaaacaaatgggtcaattgaacacattatttctgattgattagggcaaattaatggatgcttccgcggtttatttagtttgatgagcttaaacattgaattcttgcttcccttcttgatgttgctctttattcacttcgaacaggcactgctgtagaattcgcacatcaaaataatgtcacaaccaccggggtgca

SEQ ID NO: 93703 - DNA, 766 bp, Oryza sativa
gtggctcagtatgggcagaagagttatgcagataaccgacgctgtaatctggaattcgcagtggacgattttgtgtaccttcgggtcacgccattgcgagatgtacacaggtttcagacgaaagggaagctcgcacctcggtttgtgggtcctttccgtatcattgctcgacgcggggaagtcgcttaccagttggagctgcccgcctccttgggcaacgtgcatgatgtgttccatgtgtcgcaactcaagaaatgccttcgagtgccgtccgagcaggccgactcagagcagattgaagttcgcgaagacttgacctacgtggagagaccagtgaaaatcctggacaccatggagcgcaggaccaggaaccaggtaatccgtttttgcaaggtccaatggagcaaccacgctgaggaagaagctacttgggagcgtgaagacgagatgaaagcagcccatcccgatctcttcgccagttcttccgaatctcggggtcgagattccgtttaaggggggtaggtttgtcacgtcccaaaacgactctaaaatatatcctctaaattatgcctagaataattaaaatccgtgtgaaagcctccaacaattaaaatgtgcaaagttaaaagtcaaataaggcttggaggatttttgtatatttcctaaaaagcctaaaatgcgtaaataaattttagtggaattttcagagcccaaataataattattaagaaataaacaaagttaaaatgattttataaaaagaaaa

SEQ ID NO: 93704 - DNA, 4370 bp, Oryza sativa
cgatgacaccgacgagatcgtagtcgagttgcttcgactagatcacccggcgacttggctcctgtaggctccggcttcgtaggctgtggtggttgtcttggctatgagattcgatgccttaggtcctcccggggggtcccttttatatcgcaagccaggtggtttccaagtagaacttggagacatcggaccctgcacggtatagtgacgacccagtcctatacgagtaggaatctttccatcggtggacttcgtgatgaatttccttagcgtatacaaagaacgtccgtacacgtgcaaatataccatattgccgcatagcgtatatccaaaggtagagggtatgccttatccgtaaccctaacacatataatagcacatatgttttctcaatgtattatttaaatatattaaaataacaatataattttaaattttgtactaactttacgaaactactaatgtgtaatattcatattgaattttatataagtgttagtcattaattatttttaatatcaaattttagttatttgtaaattatattcctatatagactctagactcgtctttcaatatttcttctttttaattctgaatttttgttatttgtaaattgtatttctatatagactctaggctcttcttgcaatattatttatttttaattctaaatttttattatttctaattatatttctatatggactctaaactcatctttcaatattctttaatttttaatttcgaatttcacttacttctaaattgtattcctatattgactttagactcttctgttcatgttttttttaatttcgaattttagttatttgtaaattgtatttttatacaaactctaaactctacttttaattttattatgtttattgcgaattttagttagttttaaattcctatatggattctatactctacttttaatattccttgtttttaattccgaatttctattatttcttaattgtatttctatatggactctatactcaacttctaatattccttatttttttaattccgaatttcagttatttataaattgtatttctatatggattccaatattccttagtttttaattccgaatatcaactatttctaaattgtatttttatatggactctgtttttctttttctccgattaatatgagaatttctaggccgtgagagcgaacgtggaggctcatttttctattcctttaataagttaatagatgttttaaagaaatgcaacattcaacaaaattaattgcgacaccaataggcaatatgtgaaacatcgaagaaacactactataacactgtgaaacatcaaagaaatgcaatataacattaagaaaaattattgcctatgcacaccaacaacaaggcagtgcacaccaagcaagcatgacatccagtcaaatagggtaagacacacaaacacagtaaagtgcaacaaaataagcaaggatttcgaaaaagaacatcctcaaaagacctccagcagagttctcataggccccaagactcggcaatgcagccgcacaaggttctacgtctgccgctggaactcacacccttgtatctactacagctatgtatccatcggagctcactgctgcctcgctcatcgccgacagatcgtgtgttggtgtctcatggggaggatggttccggtgctggtgatgcaaccggatggtagatctgaagtggaaatgagaagggaggatgaagcgaacacccaccatgtgcaaggagggatgatgcggtgctggacgaatgatggccaagggggattgagatcctctgcattgaagaagaaaatgaaaatgtagaggcgctacaatatcttgcattgactcatgttttgatttgttggatcttcatcgaatggtacaaactgttctttttttaagaatgcggtacaaacggtttgctacaatacttttccttgtattatagatgtaatttacatcctatgttcaataggggatggatggatggtatgctttgtatgtagaaacgtaataatgttttgatttgagaatttggatttcatttgagacaactaattttctttccagttgtaactaagtatggttttttttcccttccttgggtgagttcatgcatacttctacgggagaataggtgggaccgttggaggactaatagtttttatttccaatgataaataatatatgttttttagttagtatacgtacacagaagtttgttttcctttttttctactatttacagatatttttgtattcagtgggaagttaggtgggaggcattattttttattagtagatctaatctaatggtttaaaataatgggtcaccaatttaattgaaaattcagggctggatgtttttcttttttctcataatttctaagattttctctgatttattagaatgccatgtggcaatctagaagcgtttgtagcagtgccacgtggagcgtttgtaggaagttttattgactagtatataatagatcaacatccgaactataacggtatgcatgctaacatcttttattttgtttaccgacatatacatatgtacacattattcaaatgatacaatattatgtttgtaaaatataacacaaacacatccataaaagatttacttttagcatttgagtctgcatagagcacaccaatactatcactaacaccatccataatccaaacatatcaatgagaactgagcattgctcagtttatgtgctggggggatgttcacccagccagccaacctagctatagctaggttcaggtagcctctacttgggttcaaatcccgaacttatgtgtgtttctcatggggattttgtgtgccccgttcttcttaattcacagatagccagctgcgctcctcctggctattaacatttttccagcaaagtggtaggaagcaattgccttctcttgtaacttaccatcagttccccatggggctcaggcacaaacttggtaaagtcagatttaggcaatggagacaacaatctgagctcaaagtttctcagcaaatgactccaaatcgctttaatctgcatgtaagcatagccctcaccaacacaaccggtccttccgccgccaaaagaagcgtaagagaatttcccgccaaccttgtcctcctctctccctgcaggaccaaacctgtctggatcatacagatgaccatccttgtagatataaggtacctggttgctgatcactatagggcttgcaatggtgtgccctgcagggacagcatactcatggccttctctcgtccggacggtgaactgcttgtgcgccgtcctgactagcatgggtacaggagggtgcagccgtagggtctccttgatgcagctgtgcagcgtgcgcatctccatcaaagaaccgtagcgatcatccgtgattctgccgccgccgttgatgttgctgtgttctctggcgatcttatcctgctcgtcgacagccgcggtgaggaacctctcgtggctgagcaggcgagcaccggtccacacgctggtgtaggcgctcgtgtgcttcgcggcgaagagcaggcagatcatgagcgcggcgacctacgcctccgtcgtggcgcgaccgtccgccttgtacctagagtcgatcaggctttggagcacgtccttgtcgacattgtctccctcccgctgcttgcgagatctcactatgtcggagaagatggcgtggagcctcttgcgcgccatgtcgcggcggcggttggaagggatgagtggggtgtaggggaagaagacgctcatcaggttcacgccgccctcgatatcgcggaacaggttgcagacctcgtcaaacatcgtccccatcacctccttgccgaggaggcatctgccagagatcaacaggagtagttgctccagttcacgtcttaggtcaacggtgccatgttgcccccatttcgcaaagtaatcctgtacaatgcatagatgatgccatattgtaagttactcaagtttctgatgactgggtgctgtatttttagatgttggtataattaatcatctcaaaagtatcacccaataagatattactccttctggttcaatggttcaatgattcttgatattttggataacgacatggtttatataatatattttcactatgattttctattacaatatataaaaagtaaatatttatctaaaaaaaactttttaagactaatctatatatcatgttctagtgtccttaagttaaatatatatatagtctctttaaattaaatattttaaaagttataaatagtcaaaattctaactatttgatcccaatcttacccaaaacgttaagaattaaaaaccggagagggtatg

SEQ ID NO: 93705 - DNA, 3440 bp, Oryza sativa
tgttcacgattgcatgaaaattgatgaaggcatgcttagtgtgattccaccaacagtgcgccacttgtctgtctcaactgattattttccacagctcaagagtaagtgtaagttggaaaggctacggacattattagttcttagaagctcttcgttgtcattgagtcatcttcctagtaaatttctatctgaatttaagaacttgcgtgttcttgatcttagtgagtcagatattttagaattaccagaaaccattagccagttgtttcatcttcattacctagctttatgccacatgactagcaaacttcccaaatgtatatacaagcttgtacagagtggtgtcctggatatgcctatactgctatttcttgatagtcatcctagaggtatgagcaaatttgtcacacagaaaacatcttgaaacttgttgcaacaccaacaaggggtagtcagactgtatcaaggcctaattttgcttccaataaaagcagattattcctaaagaatatcaacaagggggtgtggttggtctatgaaggctgtgcataatgaagggagttgccatttcgtaggtacaagagatctggtggactcaaatctgtcagagactttcagtgtgtgtgcactaatttgttgtctgatcaacggaacaactaaccatgagatagtattctaatttggtggatcaagtctttccagaatgtgataaagcaaggatctggttgcacacatccttcaaaaggttgaagtatttcctgttggtgttttgtaccaatgttctccaggtcaattggcagtatttcaagccttgtatcactggagtagctacccactttgcttatatttggtattctgacaagatctgtacagtcttctctttctattttcattttcacattttgtaagctgttgtactttttatttcactcgggttgtccactactgatctttttctttcaaggaaagaagaaaaagaatgatgatttgagactacatttttgttgcatgttgctgtaatggattgtgcactccattttatgatggtgtgcattggatttcagtacctcattagtctcaatagacgatataccgtaagttctgatagatgggggaaacaggtacaagcaaagtgaaacttggaagcataaaccacatttgctatctctgtgcgtctttctgtataattcctgagtaaatcatgtaggtaacaaaattgaaatgcttatatgcagggaagataaattaattgtgatttagtttcatagaaattcagcttgtgatttaatctcttgattttgctggggccatgggaaggaaagcaagtagaagtaggccttggggggttgggttttgggagtggcggcgcaacttcggggaataggattggtactctctcatttctaagttgatcattatataatcgcatggacatagatttcatcagaatataattaatgcaacataggagaatatgtgcatgctaagtatttcatcagaatataattaatgcagcataggagaatataattaatacagcataggagaatatgtgcatgctaaggtgtaattggcatggtgttttaatcaatgcatgcattgtggaagaatgtgtgcatggtgtcttgattgatgtgatttaaattatccttggttttggtgcataaacttatatgatgatcaatttagaaatgatgaagtattatatagtggaatatgatgatcaatttgggaagtagggagtattacatagtggaattaacggtgaggttagcattgaaatttgatttttatccctaattcccctttttgttacaagttaccagaattattagagtttacattagagacttgactacttgagcccttgtttggagggagcatgggattttgagtagctagctggagaggatagggaatagttaggtttctagcttataacttctaatttattttccgaattctacagctatgattcttgaaatctgcgtggaaatttatactttttgaggagctatagattttgaaagaagctacatctacttaaaaactcctccaaacgatacctaaatcttatgcaaaaatggaattgtgggatttgtctaaacaacatgaaaaaattcccttccaactcccacacccacaccatttattaacctcaaattcatcatatccatgatccatatcaacaaaaatcccataacccctaatcaaaggaagcagttaatagcctttcctctatgaacatttaattcctccttaaaaacttccccaaacctaaggcaaccaaaagtggccgacggctgccaatcacagtttatgcataagtttgtcatagctcatctgtacgagtagtatttctgttcaaccaatttgaagacggaaagatatagtttctcacggtagaccgatattacaattgttcacagctcagtaaactgaagcaagacagtatttgaacatgcgcaggtgaagtgcaccggctaacgtaggaaaaaaaacgaaacatatttcaggaaatgtgaccagttcactacaaatgcagcacatacatttacagacagtacacaattgttccagccagaaaaatctgttggggttcgtctggtatcgttcatcttgcgtgccggaaattttgacacaattggccagtatcactacaatgaaacagagatacatctcattgattgttaaaacttacaagtacagtgaaatgtgcatatgctaatggtatcaaacacacctgcaaaattagcctctgaagtctgaaccctgatcagtggatcagtttcattgggatcgaagctattttatcccattctggtccatccttattttgtagttggctcagcaacgttggcttgcaaccaatcagatgaacaacctgcagtgaagatgggaagccacttggcaaggactccaatccagtgcagttcattatgctcagttttctcagagaggttaagctgttgaagttggcagggaaagattctacggtgaccctggagcaattttcaatcaacactgtttcaagtgtggcaaaactaggcaatgaatgcagagaagacaattgggggcactgccgaatgtttagctcatgaaacttcgtcaagttgctcgggttctcaatctgtggaagagtggttattttactgcagtggactatatccagtaaggtcagcgattgtaaaccttgtaaacaagtacccaactcctcgtcagtcatctctaaataagatatttgcagcctcttgagggaagtaagtgcatgaagctcttcaaactttacatcttggcagtgcctcaaggtcaaatcaacaatttcctgcacttgttgctggtggaacaaaccattggtaaggacagcggcagaacatgtttccaatttaactttgttggcttttgatgatgaaaaagaagatagtttcaggtgtgacaca

SEQ ID NO: 93706 - DNA, 1424 bp, Oryza sativa
ttattccttgtcccaggaggcaaggtacaccaaaagttgatacatttcagagtttatcaattctggtcaattctggtcaattctggtcgtgacaggccataggcacggcggagcggcggccgagagaggggaagggaagggggaaaagaagcggcggtccacggctcaccctaggtcgacggcgacgacgaaaaacgcggccggagcggaggaaggtggcggcgcggttcgggtcgacggggtcgacggcgttccggcggtcggcgagcgaaacggaggggtggacgaggtcggcgaggatgcggcgaagccgaaggaggcggcgccgaggtgggaggtggtccggggcgacgacggcggcggaccggagctcgacggcgacggcggagagagagcgacggcgcgagctctattccggcgaggaggaagggcggcgagaggcggaaacggacagaggaggtgcggggagggtttaaatagggttggaagggggagagagcggccggcggggaaggaataggcgcgggaggtctggccgccatcaatggcgccggcgatatttgcgggggcaaatccgcccgtttgaacgcgagagagagaaggaaaaatgggggaaaagggagaggggatcacggggagtgatttccccctctttattgcacgtggagacggcgggaggcggcgggattcgcggcggcggcggcgctagggcgcgggcgaggcggcgggagcggcgggaggaaggggatgacgggtgggccccacccgtcagcgagggtggcgggcgggcccgcccgtcagcggcgcgcgcgtggggagaggccggatgggccgcggggagaggagagggagggggaggtagatgggccgagccggcccaagagagagagggagggaaaagggactttttagagcttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacatggccgccgccggcgaccataggggcgcgggcgccgcctctcgctggctgcgccggcttggccgccctcgggcgcgccgagtggctgacgcgtgggacccacggcgccggtcggtgtgagcccgggtgcacccggtccaccgtggaccgtgaggctgccgcgtgggccccactcccgtggacccggtccgcgcgccccctcccctcggctgacgcaataagcccttttaaaattaaaatttaaatgaagaaattcgcaaatattcattt

SEQ ID NO: 93707 - DNA, 5071 bp, Oryza sativa
tttcccacaaattccaactcatcggggattctttatattgatgcagagctgagaattcctacctcaaactaggctgggtgtgtcatggatcttgttagcatttccatttacatgtgggccatggcagccctttgtaccatcatcactgcaatggtgaccaccaaacttgcaagagtaagaagaccaattaccctcaatccaaagagcaaaagaccacttccaccggtggtgaatgtcattgcccttctagagcacttacctaggctatgtacaaagggtgtaattccggtgtacaaagggagtgtgttcacggtaagtctgtttggactgaaggcaaccttcttggttggaccagaggtctcggctcatttctatcaagggatggattcggagattagccagggcgatctgtatgaattcaccgtacccttgttcggcaaaggggttggctttgacatagataatgctactcgaaccgagcatctccgtttctttattgatgcgataaagacgtcgaagttgcgaaaccatgtcaactccatggtgcaggaagtagaggtaagtcagcaaatatgtccggtataacttttttctataaccttactgcaaaaacatgcctgaaggaacttaagatttttctaaggtactcaaaaaaaatgtctagactgttattttttttaagaaattgaaatactattttcatataaatcacttctatttttttcccagatccgccattgtgcatgctcgtgccttttttttgcttgaatgcatatctcattatatatacattatacatgcaggactattttgcaaaatggggagaaaatggcatagttgatataaaacatgagtttgagaagttactcatgttgatctcaggccattgcctactcgggaaggaggttcgggacaacatgttcgatgaggtcttctcattgttccatgaacttgacagcggggttggcttgggcagtgtcatcttcccatatatcccaattccatcgcacattcgatgcgacaaagcacacgccaaacttgcaaaaatattctccaaaattgtgaggtcgaggagggactccaaccgaccagccgagcaggatgtactccagtacttgatcgattccaaacatagagatggaaactccactaccgaacaagaggtcactgggtggatcatttctatggtttttgccggaaaacacacaagcacaaactccactacctggactggagcatgcctactaactcatgacaagttcttgacagaggcactcgatgagcaaaagcatatgattcaaaaacatggagaccatatagattataatgtgttgttagatatggacatcttgcactgctgcatcaaggaggccctaaggatgcaccctgtggcgccaataatatatcgcaaggcacaaaaatcatttgttgtaaggacgagagaaggcgatgcatatgacattccagaagggcataatttactgagcccaatgatattcaacaacagactaccctacatttataaggatccccatatgtatgacccagataggtttgctcctaaaagagaggaggataaagttggtggcatgttctcttatacatcgtttggtggtgggaggcatatttgcattggtgaggcttatgcttatatgcaaattaaggtgatatggagtcatttactaaggaactttgagttgaaattggagtctcctttccctaagacaaactggagcaaaatcctgctggaaccttggggaaaagtaatggtaagttacaagaggaggaggctccccacagcttagtagagaaattaatatacatggttatccgtatgtcttgtatttttgtcatgtgtcttgtttgtaatacccatgtaacaagaataattccgtatgccaccacatggctaggtgtcgatgtatgtaagggtgtgtttggataatgaaaaatgtggaatgggattaggattgcgaaataaatgaagggttaggattaaatggaagagggataatgaatggttaggatttaaagatgtcttttggtgggtgggaaatcatttccctatcccattagccaaacactacctaaatgtttataattgaaatttgatgtatttcttatgcaattgcaactgctctagtaggaatacatgatattgataatccacaatattataataatggcacacccaaagtaagtgatatggtttctacatatctagtgtcaagaaagagcatccacaatgcacgtggttgtcttgttggtttgaagagaaataatgctctaatgggtgaacacaacttatcaggctccgtttggctaatgagttatgcccatcaggaaatggaaatgatatactggtagaatgaggtggtagattatgtgaagggaaattatattccatgtttgatttgatgaatgggaaatggaagtttctagattaatgaccaaaatacccctcacaataagttgtggtagatgaatcaacagattaaaagggtcaaaatggtgagggcgatttggtaatttctcctagcactctatccaccccctcaatccagcaggattgcatatcccattcccgaactacccaaataacggaaatataaaatttggaaataatgtccatttcccattccctttatccaattttccaaacgtagcctcatagatgaccttttctaggcccgctggcaagggtgagcgagcggctcgattgcacagggccggagactttgaggggcccataggccgtcggagagcagcccattaggcctagttgctgctgcaacactaccttcaggccttcagctgggtagcctgtgaatccctatcgatcgcacatccgtgcacggtgcactaaattggctaggccgagaggcgagacaagagtaagcgccaagttcatcgcctgttcgtcacctagactcccgacgtcgcatgttcgtctcttgtcaagacgtcatgtcgccgccctagtcctcccagtcccaagtaccggcagcaccgctgcagcatcactggatcagcagccgggcacatcaagatgaacaggttctacttatcccaattctgatttattttttaaaactacaatcataaggagtcactacatctcagtccaaatgcgttcatataataatctgttaaatatgaattgtgattattcttcttggccttagaacatgttcatgtcaatccctcaacttttagggccataatttgcattttttttctagggacctaattttgtagagatgaccctgaccttatctaatctaaaaacgcctattaaagatgaggttatgagagatgacccatcacaggtgtagcgtcatctgtgataggtcatacgtcatacttgtgactcgtcatagatacacatgtgacgggtcacagctatagcctgtcacacaatactattgtccaattcatatttaattttttttcttatattatcctcaaccatctttcaatcttttcattcctctcatttaataagttgtacacactagatactccctacatctctaaatataggcacaaccaccttaacctaaagaccaagaaacactcattatcacattctagtttgtatcaccctaataaatatatgcatgcacctaataaattagagatcttaagggtggaggatttaaaataataataatttaataaagaagagatgctaattaattgcatgcatgcatgtaaatcttatattatgaaacatctaaaaaaatagttgtggcttatattatggaatagatggagtatgtattggcaggagttaggcccactaccgatggctaatctatattcagcccaataagtgatccgatgggattacgctgaaattatgcctctgtaacagcggaagcgatgagccccatacttctgctccacatctacgatgaagcagacctacgatgttgtggtgcgaccgtgcaaacgggctttatcttttcgcttatgcttttgtttatcagccaaaatttgaattttcaactttaaatttgaagccgattttaaggttttttatcgaagtttatttttcagcatttgcttttagattgctaagaacacatatataaaagttttatttataaattacttttcatttatgaatatgccgcttggtttattccacaaataagtcaaacgatgaggctaaatttctacgggcctcagcctaaatggatgttagttcgaggtggctactatcgattttccatgtccatcaattattaaaggcacgaaccaacgaatccacacatgatcacctggtcaatccattgaaatttgatgcaaaatcagtccttcatgatcaggtcctctgacgaactgttgatggtagcgttgcttttctgccactgaccaaagaatttgcagccggccggacatgccagtatgtcctcttactcaacgccgcatctccaacagcctcttcacattaaactctccaaacactcgtatagctaactctccatctgatttgactagtcaacctagttactcgttccaacagcctctccatctaccatccccattataaatctatgacaaataggacctatatgtcagcctctgatacccttcttccttctcttccaccccattttccccgcccatacacgaaggcggccacgtccatgagtgcgtccacggcgcaagcaccggagccgcccggcgcaagcaacggacgcagccacctcgagcatggcatggggcggctccggtgcggcaggctcctggaggggctgcgtcgggggcgggcggcggcgacatgccctgccccgggaggtcaacgaccacggtgaggatgccgcggctaggccaagcttgtccacggcgtgggtgacggacgcagccacctcgagcagggcatggggcagctctggtgtggcgggctcctggaggcggaggaggaggatgatggagcagctccggcaggtcggcgaggccatcggcggtgtcaacgccctcctcgcccacgcctacgctctcgccttccacgccgtcgccgccgtcgaggtccgcgcccgccggcgtaggtgatggcggcggc

SEQ ID NO: 93708 - DNA, 2502 bp, Oryza sativa
acttgcctcttgacttctgctaattcattggctgccattctatacggtctcttatggatcggagttgttcctggtaccaaatctattctaaactctatatcccttttaggcggcataccaggtaaatcatctgggaacacatcaagatactcccggactataggaatctcttccaaagttatttggttcagtcttgaccttaaagattcagaagacaatgcatgaatagttacaactcgaccatcattgctggtgagagttacttttctgttggcacagtctatcacacccttatacctggctaaccagtccatccctaggatgacatcaaggtctttggattctaacaggataagattggccagaaatggtacgccttgaatttctattctgacagaggggctacgttgcaaagagagtgcttgattgcttggggtactaaccatcaaaagacgtctaagatcttctacttccataccatgatttcccgcaaaactcatagataagaatgaatgtgtagcaccagaagcaaaaagcactgttgcaggaactaagttaacaagaaacttacacaaaatcacatctggagcatcttgagcttctgcagcagcaacatgattgacacgggcctttgatgctggtgtggtagagttgctctggacagggacaaccttcacgcgtcggggcttcggacacttgtcagcgtaatgtcctgggtctccacagttgaagcataccacgggcttgctgccttgctccctcttggcaggttgttgctgtgtcgaggctgcaacaggacgtggagcttgattacggatgttgttgcccgcgttgttgttgaagaactgacgctgcggacgaacaacagacgaagaacctccctgtggcctggactggggtcctaaagtaagacgcggcctctgactattcccctgttgtgccttgaagtgagcaatccggcgtttcttctgctccatgcgattgtacttgtcctcctggcgaatagtcttatccactaacttctggaaatcaggataatccccagtcatgagtgggtaagaaagctcatcattaagtccttccaagaacttctcctggcgctcttcatcagtgcgtacatcttccggagtataacgagccagacgattgaactcgtgcagatactcggtaacagagcgagacccctgagtgagcgacctgaattccttcttcttgagagacactactcccgatggtatatgcgtcttccggaaagcagcggtgaactcaagccaagtgataggttcagcagtagtcctattcagacggaagtgatcccaccattcagaggcagggccatgcaactgatgtgatgcaaatgagaccttctcctgatcggtgcactgaagcaaatccaacttcttttctatggcatgcagccaatcaccagcttcaacaggattagtggtgctagagaaggtaggcggcctcacacgaagaaattccgctaacttgttctggggaggtgcatggttatttccctggttctgctggttctggagttgctgcatcatcatgttcataagctgtgcctgttgggccaggacctgggcaagtgtgggattctctccattgttgttgttattattgttattgttgttgttggggccattcccgttgctgcgagtgagcaccatctggcatggacaggagcacaagaagagaaaccaggggaaaactacttaggaccgagaattaatttaacttttattgatcttaagtgagtttcattattacaaactgaagactctcacaccactaaactcaccaactacctaacactcgaaagcaaacaaacgcacccacttacatcccccccactgatgtaaatcacatgcgagacacacacaaccaaacttaaaacaagcaaactaacacaacgatctaagacaacggcttgacaagacattctaggtcttccgagcatcggagttgattgaaggctcgttcggctcgtcttcatcatcttgagttgctccccactcgatcttggaatgggtgcgcttggattcttcttcttcatcatcacttataatgataaccggaggatctgctagggctggggtaacttctttctccaccacacggacctttggcgccaattggtagcgagggacaaatagagctctcttccttgcggtaagatgaatcctggccttctgcggtggtgcttctcccttcaatgcggctagttccttcttcaaacgaaccactttgtcttctagcttgcaaatcttaccacgattccgatcttcacgatcttgagctgctaacacagtctctgcacgggttttcatccatagcccacagcatctcaaccaaatgccttgtggtagcatcattctcaattccttccgtctcaaggtagctggcacggtcactttcctgtggttgacgaggatggtagcgatactcaatgtcggccaactgatcactgtagcgatcacggagctcttctatggc

SEQ ID NO: 93709 - DNA, 707 bp, Oryza sativa
ccaagttatgaaagagtggtcctgccttgacgacaacatgatggcatatcgacaagaggtacgcaaattggaagacaagttcgatggactcgagctcagtcacgttcttcgacacaataatgaagccgccgacagacttgccaactttggatccaagcgcgaggtggcgccctccgatgttttcgtcgaacacctttatacgccgacagtacctcacaaagatactactcaagttgcgggcactcatgacgtagctatggttgaagccgactggcgagagcccctcatacgattcttgacttctcaagaactcccccaagacaaagatgaagccgagcggatttcaagacgaagcaaactttatgttatgcatgaagctgagttgtacaagaaaagcccttcagggattctgcaacgctgcgtatctttagaggaagggagacaattgctgaaagacatacattctgggatatgcggaaaccatgctgccgcacgcaccattgtcggcaaagcttaccggcagggttttttttgcctactgcagtgtccgacgccgacaaaattgtgcgcacgtgcgaaggttgccagttttttgccagacaaattcatctaccagctcaagagttgcagaccatcccactgtcttggccgtttgcggtttgggggctcgacatggttggcccgtttaaaaaggcagacggcggtta

SEQ ID NO: 93710 - DNA, 1977 bp, Oryza sativa
atccctttgcacgtctgcatcattggtgtggcttgctgagtacggtggttgtactcagccttgctattattcccccttttcagaagtgtagtgcttctgagctgaagacgaagttagaagaccaaggctcagaccccagttgagtttttcctgtggagtggagctgaagtctcgctaggatcgcctttttccgctgctgtcgttctgtttcggtgtgaggactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaaagaagcaggatgcagattgttgtgtaacatggccaagctaagctaaatgtggaggagcaaagcatatgctctagtctctctattgcttgatgagaagtataaagctgaaaagatcgaagatgtccccttgtgataatgagaaacttgaaaaagggatagtgcgtggcctcgtgctcgctgcatgtgcaccgtggagcggagcctcgcggcgcctgttgttggtgcgcaaggacggggacgaggcgaccacggcggtggaggagaagaacgtggcagtcttgtgcgccctaaccgggctgcgaggtggagtggtgtgtgtgatgttattatgcctactatggatataactattgttcacatcatggatcaacaagaagatatcaagataagtcgttcaagtgttgaaatctgatccggcaacctgctacattgtttgtcttcaaactgctgccaaatatgcatacgagctttgttttgggttcatcaatactcgatgaaaagctcttggactcctctttccaacagttctagtctcatctccaaactccatcttagtcggccgcaataaaaaaacaaggagttgtgttaatataatgggcatatgggcttgtaattttatctgggacctagggtaaagtagggtgcgccccaatctagtggagcatgatcctagggacccttagctcatcctcgcacctccataaatagctaggcaccccttcagagtttcttgggttttgtgtagattaaagtttagacattgttactttaccttacagttacgtgtgccggctagaccatcaaagtactcgtctctgaaaccccaacttatcctggactttaattcctatttgcaattcaggttgcttttatcttgttcttatttgtttcttcgattttgcttgcaaaaataaggttgttctgtatcagccagatcaacaacccacgaagaagtgtatcgaagctaaggcacaacacaacatcatctcgtacgattgtagtcgggttgacaacttctctcacaaatcatagttatctcaattcaccaaaaatcgggtcaatcaaagccgtgagcatagcgagtggagcttaaggaaggtcgaggctcttcagaggacaagcaacgtgagcgcgggggtgccctctaaacacaaccacatggaggagcaggagcgtgttgccccttacggtggcgacggcttccaggtccacgaggagtgccttcacaagccaactctcggcatcaccggtggccgtgaggttgggaagaaggtggtgattagtttggtggcaaggtctccgcctctggcgatgccatcgtgtgcgtcggtggtgggtttggcgatgacactggccatctagtttgtcttgtcacatagacaaaagcggcatacaattaagaatcctttttctcccattactagtaagtagaaacctaaaaatagtactccctccgtttcacaatgtaaatcattctagcatttctcacattcatattgatgttaatgaatctagacatatatatctatctagattcattaacatcaatataaatgtaggaaatgctagaatgacttacattgtgaaacgggggaagtatttggataa

SEQ ID NO: 93711 - DNA, 779 bp, Oryza sativa
cgaattatttgaaacaaagtttgtggttaaggatagagcatgtcgtactataatcgatagtgagaggtgcaataactttgtgagttcagatttggttgagaaacttgagttgcctacacaaccgcatcatcatccatattagatcaaatggttcaacttttgtggtaagttcaaggtaaatagaattgtgagaataaacttttcgattggaaattaccatgatactggcaattttgatcttgtccctatgcaagcatgttctttgttgtttggtcaaccataggtatatgataataatggatcgcataattttgttgctaacacatgcacatttagacataatggttggaaaatgaaattggtacccatgagttttactgaaattttcgaaaataatattcaaaggatgaagaatggaatcgatgagattttcagagataccaagaaagatgctattgtgatgtcttcaactaagtctgaattacaaaacgaacgtatttttgtgcctattgttttggacactaatattttgcaggcatctgagaataaccaaggtaatgagaaagagaagaaatacgaagtggaaaaagatctatctatagctccatgcatgctggaagaatgttccattgaccaagcacctataatttctaaagaggagaaaagagatactgataatggtgttataactactcagggtatgcatagttatgatgtgccaactatgtccactacttatgctatgttagagcaacccatagtggaaacaattgttgaaa

SEQ ID NO: 93712 - DNA, 3911 bp, Oryza sativa
  unsure (1)..(3911): unsure at all n locations
cagttttggacagaatcatcacctaactttatttagattttgatcttgccattttgaactttgagtaccatattattgttgaagcagcacagtagcatcatttctgtctgtcatgtgggcttttgttggaatgtcaggaaattgatcagcctgccttgatacctcacatagctgaagccaagtctcaaaaatatccatatgaagttcttttcagaagcttgcaaaaacttttgattgatacagctacttcagagtaagcctgatttcccttgtatttttattcgtaatggcttttgaatgagtggcaacctgatagatatccactaactgcaggtaccttttctctgatgatttctttggtgaagaatcactgtttaatgacatatttgcaggtttgttttgtcctatttttgaatgtctatcttatgtggatgtagtaatctaaatggagaagcatctagtgtaaatccatcgctcagttctagcatgtgaatgaacattcatatttaccatttgatgaggtttggatggatcagatttaaagggatgtgacgggacactcataaatgatggctcaaaccgcaaggcagttattatttgtaaatagtggtccatgtggctattacatcctgtttggatctgatccacctaaaattatgaatcaacccagatggagttggcattttagaacctgaagttcaaagatgcgtagatactcccccaaaccgcttttacatcgtcctttacccgtaggaagcacaatgcgtgcaaagactaccatacatttatatgcctgtttttgctggtcatactattgagacatactttgatcaatattgttctgccacagtggcttgaataactaccatacatttagtttgtcaaggccaatcttaattcagatgttttgtggttaccctgatttaaattttgctgaaaattaaaagtccagtctttgttatgaacatttctggctgagcaagtgagcataactcttctcagtcatttagaaaatgtgcaggatgagatttcaggagttgatagaaaatgagaatatgctttgcattacactagtaaccaaagtaatatactatctgttcattttatttaactttaggaaataatccatttattttatcatgtctgacatataaatgctccatgtcatagataatccaaactgattaattgaatatatcaagtcaagccattttatactattaccactgtcatctacctgaaaatagacaatgaatatgtgttttaaatgtttaacataaacatcaaacaagtgatgtctgttacttttcccttaggacctatccaagttgttgatgaacatttcaatgctgtgctcctgaactgttatgacgcaatcggcataatgcttatgatccgaataattcatcagcatcaggtacgctttgagttacctattgaagcagcttagaaatatcaccattcatgcccttgttgactgtccttgctttgaaggaggccacatctctctctctctctctccattttaggtagaaccctctatattgttatatgtgagaaatctaagtggaattgatgttttatgcagctaatcatgtttaagcggcgaatcccatgtgtggactcttacttagacaaggtgtgtgctttgtcgcatttttgttgaaattttatacttgtatcgacttttttaagggtcactatgttggatagccaatgcttcgccatgaatctttcttttgtttcaaattcatcaagtccatttgtgcacattgcacacttgcacaggttaacttatcactctggcctcgcttcaagatggtgtttgatttgcatttgaacagcttacgaaatgcaaatgttaagactctttgggaggatgatgttcatcctcactatgtcatgagggagatantcgctgaattntnnacagcantcccttcgtgccattctccaaatgtgaatatggaatggcaggttagtttatcaaattcaactcaacccgatttctgaaaagaattattgattcccattccatgcgataagcaacccctttatatggcttatgggaattgtataatgttatttatatctgcagcttgatcttaatctcgagcggttgcggatggctgttgaggaattgcttgttaagttggctaagatgttccctaaacaaaagttgcaaactgttttcctgataaacaactatgatttaacgatttccatactgaaggtaggcggtgaaagttcaagcttcattaagttgtactgtggtgcaaatctaacttagtatcnnatctttattaannnatttgttcctggaaggcttggtcatacaggaagctggcactgagggtggaaaaacacaagttcactttgaggaggttctttaagagcaatatttcagtatatgtggtatgcaatgtgccctctgagatagaaataatggaatataatttctgcgtgggcacatttcattggttttactgtgttagggggtacctgtttgcatctgtttaggggctatttggttgcatcctaacttgccagggcaccaaaccgtgatgtgttgtgtgaccacttgccgtttgtcctagtctatttattttagtacgacctctgtattttccatttgattctagaatttttacatgtccagagaaaatagtgggaggcctactgtcagtttagtatttcttttcttaggattacgaagccaatcagaggctagtcccattgatttttaatactggcaacagatgtccattttttctcctttcgtttgaactttattgacaatatttgtaaagagggagctgtgtggatagttaaaattttctaggggtaagctgatataatgaacaaatatttatgcaggaggaacttctactggagcatttcagtgatttgatcaaatttgtgaaatctcgcccgtgtaagttgatccctgttacaacatcaagctggttcctttttttgcaacggcatctcatctttatgtgtgtgttttaccagctgaagacacagcatcaagctcggacaaggccagtgttagtgatgtcgagccattagtcaaggattttgccggtcggtggaaagctgcaattgagcttatgcacaaggatgtcattacatcttttagcaacttcctctgcggaatggagatcctgaaagcggcactcacgcagctgctgctgtactatacaaggatcaccgagtgtgtcaagaagatcaatggtggctctgctctcaacaaggacctggtttccatatcctctatcttatatgagatcaagaaatactccaggaccttttagtcagtactggtcctgccatgtacactggtgtattattctcatgtaacgaaaatcctgatatatgctatgcaggttggttgggtttgacacggaactctgtttctcttgctatttggcagatgttaagaaattacacgggggtgtatctaaaatagtttttcgattgagagtaatggctgtttgtggtagatcgttgagctgattagcgattagctgcctatcagtcagccattcagatgttctttaattgtagtcatagccattcagatgttctttaattgtctggcggtgtttgggaccgtagaaacttatccccgcctgtggataagtgaatagaaacacataaattttgccatctatcaacaaatcgaaagaattaacatttctgtgactgtatccactcgcctcttgccaaagcgcccacatgtattatactccctccgttttacaatgtaagtcattctatcattttccatattcatattgatgttaatgaatgtaacattaaaaaaaacctgcacagcacatgaaggcgtccacagcgccacttgactgtcaaatataggcctaatctaattcttatcccttaaccgc

SEQ ID NO: 93713 - DNA, 562 bp, Oryza sativa
acagatggaggcctgagacacacagcttccacctccccagtggtgagatgaccatcactctacaggatgtggctatgatcttggccctcccattacgggggcatgccgtgacgggcaggacagagactcctggatggcgtgcacaagtggagcagctgtttggcattacactgaacattgagcaggggcaaggggggaagaagaagcagaatggaatacccctgtcttggctgagtcagaacttctcacatcttcacgacgacgctgagccatggcgtgttgagtgttatgcccgtgcatacatcttgcacttgttgggaggggttctgtttcctaatgctgggggtgacattgcttcggcgatatggattcctttggtcgccaaccttggtgatctaggccgttttagttggggctcagcagtgttggcgtggacatatagacagctctgtgaggcctgttgtcgtcaggcaccatcatccaacatgagtggttgtgtgctattgattcagctgtggatgtggttaagactaccgggtggaaggcctaagtagaggcaaag

SEQ ID NO: 93714 - DNA, 506 bp, Oryza sativa
agttctctctactgaaagcgtgagaagatatatgttagggtctagggtgcaaatggaaataactttgacaaatgcaagaaaacttacgactctgtctctaagtggggcgtgctccatttgatatccaactctagtccggacatcatagggattccgcccctcatcggagtcgcggtcatcctctatgtcggcttccgtccaagtagggcggaggaacagtctatatgtcctatgcagccaacgaaggtactctgagaaaagatgattttggtgtatagtctcgatgtacctgtcgttccttccagctgtcatctattcatcaatatatctattatgctctagcccccagtctttcaccttctttgttctcaccctgtcatacctagacaagtagaaggtgatgaaacatagtgagcatcgacaagggtttaaatggtacaaaattgaacattgacaatgaaagcaaacaaagataagaaatatttacttgtgtaattcaactccag

SEQ ID NO: 93715 - DNA, 4512 bp, Oryza sativa
cgctcccgcaccgtgcacccacccgccgccgcaccgcgccgccgccgccgttgggttcgcgcggccgaggtccacctcgtccacccctcctccatcgaggttcgccgccggagccccatccccgtcgtgcgccggtatgagacgccatggccaccgccttcggccggcgttcccgccctctatggtctctctctctccctctctaatcttccccatttcgttccttaggtcgtctcggaccccgtccgctgcttgtcgacctccctccatcgttcctcgtcgccggtcgccatcgtctccctccacgccggtcggaccccttcggtgaggacgcccctccttccccttccttcttcctcctctcttttccttggtagcgccgccgcttagccgtcgtcgcgccgtcgccgtttgccgaatcgtcgccgccgtccgccggtcaccaccggtgccgcgccgccgccgcgccatggtcccgggtcggcttgagccgaccgcgcgcgctggccgcgagctccccgccgccgtccgatctacccgagggtagatcggggccgtcggtccggctgcccgcgtggctgccacgtggccgctgcgtgtgcgccgcgtcggcgccatgtgtgcaccacatggtgcgccgctcctccccggtccgtagacccggtccaccatggaccaccctccctgagtcactgccatgcggggcccgcatgtcggcgccgccctctctctccccgggattttaattattgcgcaataaatcaattaagtatttttctgtttatagtaaaaacacagtgaatcttctaaaattcatatctaattcatccgtgctccgtttaagcccattcaagactcagtaaatcaaaagaaatgcatagaatctattaaaaatggttttgtcctctgtttcagtagtcttatagcctgtttgtattgtttgctttgtatgtcgcttagattccggctctcccgacgctccggtgtactttgaaatagtcgccgaggttcctccagcagcagagcaaggcaagtcatgcttgtcacttgaacatgttgatcctatattgcaaatgccctaccgttttcctttaaatactgcatcattttataatgtcactatgggatgtttacctactgttacagccatactatttttgtaccatgctcctttgttagcttggggatataacatgactagatattggactagggattgcttagtcatgcttggttcaactagcacacagtgggggaaatacattaatgcatagatatcagattctagtaatgatattggttaatgccattgctccggtgttggttaattaaaatatattaaatggtgggctgtgagtgcatggttttgctagtcgcacccatggcaattaaggaccggttcgcgggaaaccctggaagaattcctcgtacttaccacaagccagcgtgggcaacggctgggcttgtagtgtagcttttctctagccgacgctcccaggcaagggtgggcgtgatggagcggggcgggccctgcgacggcctctgtagcttctggattcacctaggcacgagaggggactgcccgttgcccgctggggacggggggtgaaacctgaggtgtggtgtgcttggctagagggggttatgcgaagggtcctgttacggcctcttttcggtatgtcgtggtggcatgtcggcgcacagaagcgtgtcttggggctgtgtcttgtgggtacagttgtacacctctgatcagagtaaaactattcgaatagccgtgcccgcggttatgggcggtcgaccagattcaccgtgattagtctcaccctagtttagtctgatggaactgattagttcaggtggatggttgggcctgttgcaacgtggtgtagcgttggacaatggatggttaatattgattaattattacagccgttttactgcttttaactactgtttataaatgctcgctttatacaaatgaaccgctctagccatacgttgattaaaccctgcatcataccccctattccggtatgacttgctgagtacagtggatagtactcagtcttgctttattttccccaaaaccccagagtttgagtatgcgtcagatggtggtttttccgaggagtaggcttcgtccgtgccgtcgaggatgcctgtggagtggtgttcccgctgcaatccaagtcaacgcttaactccagttatcttttatttttccgctgcatttatgtaagacttttataaagtttgtaagacgtggatatgtatgtcaactttgttgtttgtgtaccccggccggtcctggacggaggtttaaatgcacattctgcttggaattctattcgagaatttctgggcgtgacacggaccgccggatgtagcgaggggcgccaaatctagcgccgtcaccgccgcccccgcacccaaccacctccacgcccatccgttccacacctagctgcctccatgcccccaacccgacgccgacgccgatgccgtcacaccgtcgtcacccccatctggtcggggtcgtaggcaccgacccgcgacctcgagggagatggaaggccctgttgccgccttcctctcagccgcgtggtttccggcggtctgcgcgggcggcggcgaggcggaggagggaggaaggcggtggtggtcaccacctgtgtcaccgctgcccttagagcgaaacgggggccttctcagaagtcagaacgatgcagttcctcgctttaacatcttaaaactaatacaagtattacacgccatctataatttattatattcttgtgctcaacaggcaagcacaaaattaccatcctcatccatcatttctatagtactgcatcatccaatctatgctttctttataatttgagcttaacatgaaagcatgtcaaaatcctcattctcacaccattttgcaggtatttcggcatgtatccatagattattcctataatattacatgtatttattaatacatctcacaacaaaagcacaggacatcaaccaataatataacagagtcatcatgttttgaggcaagtggataacgactgtatttaaacatttactttataatttcacactttccacctctaaccaaaaaaataaaagaattaaggcctaccatactttcggcctaatagtcatccagctcatcaccctaatagcctataatgtgaacttcaccgataatctaccttctagcaagtatagcactatagcttctcgtataattgaaagctctcttgaaaaaaattaactttttatctagattctcaaaagctttagctataattcagaaaataaccctagaagctaaaatcagcttttttttattataaattacaccctctacttcatatctatttaaatttatagtgctagaatataccataattctagaagtaaattcctacccgttcctcttaatccaaagctcgctagtacaagctagcaatcatcttatctatttaaatttatagtgctaaaatatatcataattgtagaagtaaattcctacccgtttctcataattcaaagctgccctagcacagtctagcaatcaccctccatcagtgaacagtccaagtgaccaaccctaccatgcagtggggctgtgggaagtgggaacccgtgaggtatgaaaatgggaaaaccagcagcctgctagtagcatcagctagcatcagatgctgatgctagacacggtggatcgatccagcacagatccgcgaaaagatgagatgccattctccccgattcacgcacacgcgcctcccatgcaagcgacgcgccgcacaccttgggcggtggagccggtccatggaccaaaccacgtacacgtccgtgtgccgaatcgcttatatacaaagctgccgagaattgagcctcaaatcagcgtttgccgctggcgtggcccttgccggggcgtgacacgtcgtccggcccttctccggagctgaatttggaggctgcgcgttgcttgcttcctccgtcgttggatgcccatcgtgcgtccatgcctgcctgacgctgatcattttgcaaaaaagcccttaaactaattgataatttggttttagatctctggtatacagtttctacgttctacgttattacgtataggacctctaaaaaagaaatattctaatcaaagaagcaaaaaacagaaaataggactgcgctcgaaaacatagaaactaagggggttttctgcaacaacttgcatccctatcccggtccctcaccccacgaaaccctagccgccgccgttccgtcacctctctcttctcgctcgctctccctagaccacaccgccgcatccgcctccgcctccgaccactcttcttgcacccagccaaatcgccgcacctcccccttgccaccgcgaggccagttccggcggagggtagaccgtgctcgccggattcgggtagccacgacctccttgccggcggatccggtcacccggaggcaagggcagggctagcacat

SEQ ID NO: 93716 - DNA, 8792 bp, Oryza sativa
gcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggtagctggactctgggagtccgagaaaatgaaaaaggctctgggagccgattaatcaagtggaatggctctgggagccgagaagtaatgatctaacccgggaggtcggtgcattgccaaatgagctattgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctatataaatatatatatatagttcctccgccctgaagagaagataaagtgaagtgaagattagggtttcgtcctagttcccagccgtcgcctgtggtgttgggtattagaccgttggttccgctgctgctgttgttggtgttcgcctcgtccgtgtcgtcggttgtattctcgggctgtctgagctgcaacctaagttaagataaataagtcctctatttattttaaagattgctatgattcatatttgtcaccgtgggtaccagcactatgtcctgggactggtaccgagatcgcggtttcgtagaaagcggttcgcgccgttttccctacgacacgctcctgtcaggtgccgttgtacggtggtatcagattggggtgtgacaaacatcgactacaatccgctggtttccaccgtggtaggtcgatctgatccaatctccttgagtgatttgtactctcagatggttagctacgacaaccggatggatcatcttcaaggaggcggacaaatccaatcttctgccaacgccgcctcacgcggacgtggcaacggcaacagcaacaacttccgcgatcgtggtggcggcggcaatgcaggccgtggccgtggcaatggcggacgcggtggaggtccacaaggaccacgtccggtctgtcaacggtgtggcaaaactggccatacggtgctcaagtgctggtataggtttgatcaaacctatcaccccgaagagaaggttgcagcagtagcgacgaattccgcctacggcatagataccaactggtatgtcgactgcggtgccaccgaccacatcactggggagcttgacaagctctctgttcgtgagaagtataatcgacatgagcaagtccatgcagccaacggcagaggtatgaacattagtcatatcgatcattcagtaatttcgctgcgagaacacagggacggaagaaacaatacggacccacgaggtagtcagaagggaatggggccccaggagatcgagagactggtccaacgggtgctaaatctcaactccgtggatgcgtctctcatcccccacggtatcctccccctctgcagctacccagatcgcgcctccatcttaaccattatcacagcggtcggggcctcagaggagcaggctcctaagggctatgacagcgcaggtgggagccgccggggggatcaatctacccccggagggggtcgtgcttatgggccccgcgtcgggggctcggggagcaaccgccctaccgacgcccgggggaagaggaaaatgggaggaacacctcccccatctcctccccgagggggcggggcggtgcgtgccagcagcaggcgcccggagggggccgcgccaacctcgcagcccgagggggagcgcaaaaagaagcggctgcgcaagatgggggagacagaaccatcccggggaaacctaattttccctccaaggtggtcatttaaccgaccccctcgcaggttcgtcccacgctcattgcgaccgtcttttcttctattccaaaagcaagttttttcttacccatcctgtttgccttctggtttttctttctgcttcagtgatgtcccgtcacgttcctcccgccatcccaagtccggccaatccgaggccgaagatccggcggccgcagaggaacggaggcgagaatctgaccggcgagaggccgcagatcgccttcgggaagctgaagaggccgcccgggaaaccgcccgggctcgccaggctgaggataccgctcgggaggaggccgcccgggcccgccaagccgaggaagccgctcgggaggaggccgcccgggcccgccaagccgaggaagctgctcgggaggaggccgcccgggcccgccaaactgaggcgatggcgtctttcgaggcagcccacgacaaagctgctggcgcgtcgcttgggcctactccctcgggcgacgctcaggcgacagcctccggggcggctcgcgacgaggccgcgggcggatcgcctgggcccgctccctcgggcgactcccaggaccaaacgggtccgggggacatccccgagctcagtgcgtcttctggcgggccgagccgcgtcgcattttctccaaggcggctcttctcctcgtcttctgccgccccgctgagtgccgagccccttctgcaagccttggccgccgcaaacaccgcggtgctagatggatttagcgcccaggtggaggccttgcgagcggaacgagcggagctcgaggccgcatgggcgcgcgtcgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgccctcatcgccaccaccgcgatgattgaggcgcaggactccctccgccttcaacacgggagctgggaggcggagctaaagaaaaagctcgacgccgcccagggggtccttgacgccgccgctgcccgagagcagcgagcaacggaggctgaagcggcgtcccggcggcgcgaagaggcccttgaagcccgtgccatggcgctggaagatcatgccggcgccgtggagaccagcttggcggaccgcgaggccgccgccgctatccgggaggcgacgctggcggcgcacgaggccgcctgcgccgaagaggagtccgcgctccggctccgcgaggacgcgcttgctgagcgggagcgagctctcgaggagtccgaggccgcgacacaacggctggcggacagcctgtccctccgcgaggcagcgcaggaggagcaggcgcgccgcaatctggaatgcgtccgcgccgagagagccacgctggagcagcgggctgctaacctcgaggcgcgagaaaaggagctggacgcgagggagcgcagcggcggggcggctacgggcgaaagcgacttagtcgcccgcctcgcagctgccgaacacaccgtcgcggacatgcagcgcgccctggactcatccaccggggaagccaaggccctccgcttgtcgggtgagatagggcccggcatgctttgggatgcagtctcccggctggatcgcgccggtcgggaagcgggcctctggaaaggccagacaatttcgcgctccaccaatctggaaggcctcgccccgcaccttaggaggatggcctgggctgtccaacaactccccgaggagctcgagaagaccatcaagtcatcctcgagggacctcgcccaaggagcggtggaactcgtgttagcgagttaccaggccagggaccccggcttctccccatggatggcgctggaggagttccctcccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcgcattgggatgagcccccaggcccccgccaatctccaattttttctttttctttcttctttttgtatagatcaacttaatctgcaatcaaaaatgatgaaaaatttctatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaactgcttttattgaaatgctgaaataagaaaagtaaggctgtgcatgtgtggtagcccccggctaaccctgcacacccgaggggggtgcggggttagcccgagcccgaaacctgacacccgacccccccccctcaggggtagaagcgacgaaggtgttcgatgttccacgggtttggcagctcagtgccgtcgcccgtggccagccgtacggagcccggccgggggacgccgatcactcgatacggaccctcccacattggtgagagcttgctcagtccagcacgcgtttggacgcggcgtaagacgaggtcgtcgacgcagagtgatcgggcccggacgtggcgctgatggtagcgccgcaggctctgctggtagcgcgcggctcggagggccgcgcgccgccttcgctctttcaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgcacttggcgtacataggcgtccatttgcgggtcagagcaccggtactccttacagacctggttaacgaccagctgggaatcgcctaacaccaggagacggcgaatccccagtccggctgccaccctgagtccggcaaggagtccctcgtactctgccatattattggtcgctcgaaagtcgaggcggaccagatatctaaggacgtctccggtcggggaggtcaacgtgacccccgcaccggcaccctggagggacagagaaccatcgaactgcattacccagtgggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaattcagaaagctcgattgcccattttaccacccgtcctgtaccctctcgattatgcaagatttgatcgagggggtaagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggccgatcctctctgctaggggccgtatccccggggcgttcttcgttcaagtggcctttcggggcgcacttgtcttctgtgccgatgacctcggggtcggaggatgaaaggggcggccttccctcagtggcctcggggccgtcctgggggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcaaagggcgttaagtgcggccttcccgcagtggccttggggccctcctgagggtcgggggcacctagcaccgtctgacaagcgggcagagggccggctccggtcgtcaggggccgtaggccaccgtccgactcgggggcctctcctccccgctcgctcccgggccaagttagcacagaatgggggtgcacgaaatgaggattgtcttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccactagatctgaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgtacattctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccgacatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtg

SEQ ID NO: 93717 - DNA, 3520 bp, Oryza sativa
aggtcgtgagcacagtcttggttgtcgagcgtgaggaagaaggccatgtccagaaagttcagcgaccaatttacttcgtcagcgaggtcctggccgactccaaaacgaggtaccctcaggttcagaagctgttatatggtattttaattactaccaggaagctgtctcattactttcaaggtcactcggtaacggtggtcacatcattcccactcggtgatgtactacacaaccgcgaagcaaatgggcggattgctaagtgggctttggagttgatgtctttggacatatcattcaagccccgcacttcaatcaagtctcaagcgttagctgattttgtcgccgagtggaccgagtgccaagaggatacccccgtggagaaaatagagcactggaccatgcattttgacgggtcaaaaagactttcgggcactggagctggagtggttttaatttccccgactggagaaagactaagttatgtgctttggatacacttttcggcgtctcacaacgtcgccgagtatgaagcgctccttcatgggctacggattgcaatttccctagggataaagcgtctaattgttcgaggtgattcacagctggttgtcaaccaagttatgaaagagtggtcctgcattgacgacaacatgatggcatatcgacaagaagtacgcaagctggaggataagttcgatggacttgagctcagccatgttcttcgacacaacaatgaagctgccgatagacttgcgaactttggatccaagcgcgaagcagcgccctctgatgtttttgtcgaacacctttatacgccgacggtacctcacaaagatgccactcaagttacgggtacccatgacgtcgctatggttgaagccgactggcgagagcccttcatacgatttttaacttctcaagagctccctcaagataaagatgaagccgagcggatttcaaggcggagcaaactttatgttatgcatgaatctgagttatacaagaaaagcccttcaggaattttgcaacgctgcgtatctttagaggaagggagacaattgctgaaagatatacattctgggatatgcggaaaccatgctgcagcgcgcaccattgttggcaaagcttaccggcagggttttttctggcctactgcagtgtccgacgccgacaaaattgtgcgcacatgtgaaggttgccaattttttgccagacaaattcatctaccagctcaagagttgcagactatcccgctgtcttggccgtttgcggtttgggggctcgacatggttggcccgtttaaaaaggcagtcggcggttacacgcacctcttcgtggccattgacaaattctccaagtggatcgaagctaagcctgttgtcacgattacagcagataatgctcgcgatttcttcatcaccattgtgcacagattcggagtacccaatcggatcatcactgataatggcacacaattcaccggcggagttttcaaagacttttgtgaagactttggaatcaagatttgctatgcctcagtagcacacccaatgagcaatggacaggtggagagggccaacggcatgatacttcaagggattaaagctcgagtttttgaccggctaaaaccctatgccggcaaatgggtgcaacagctgccatcagtactttggtctttgcgaactacacccagtcgggccacaggccagtcacattttttccttgtctacggggcagaagcaatgttgccgagtgaagtcgagttcgaattctttggcttccgtaatttccgtgaagaacgctatgaagaagaccgagtggacgacttgcatcgactggaagaggtccgcgaagcagctttgattcagtcagctcggtacttacaagggttgcggcgttatcataatcgcaatgttcgatctcgtgcctttctagtcggcgacctggttttacggaaaattcaaaccacacgagatcggcacaagttatctcctctatgggaagggccatttattatctctgaggttacccggccaggttcataccgactcaagcgcgaagacggcactctcgtcgacaattcttggaacattgaacatcttcgtcgtttctacgcttaactttatcattgtatttccctattttgactgtcaaacatcaagttttctccttgaagttgtcagtcgggggctatcatcataataatggagtgtgattttttatcaattcagtttgcttacttggtttatcattgccttgtttggtttttctacttagtttgagaggactgaaagtttttaatagcttctttgggttttaggctcaacaaagcttagcaaaaacttttaagaaatcaaaaactttgcaagaatcatcaagcacagcataaatacaccagtattgtacaaattgagcctccatgtattacatctacactcagtcagagtcagtcctttcatcatcagagtcatcattactcggctggaggtcgttgttgcgaaattgctccacaacatcactcgctattttgtcagccgcagtttgcgcactactgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatatacttccggagcaacactcagcttgtcaaatatttcggttgcgtcgagtgtactcggaccaccattattgaggaacatggcttggataattggtgcagcggcattggcgacatcatctcttgctccttctagcctcttgatcttaccaaccaggacgtcgaattgagcttgagacttgatcttgcggtctacaaaacatatttatggtgagaatctgctgcattgaaaagagacaagttcaggccaatagctggcagtaccttcaacttccttcaaggccgagtccctctgcgcagccagttctacattgtctctctccagggcttcaacttgctttttcatttgttccattctggcggcttgcgctgtttgaaatccagttggttgaggatacagttatgttggcctaaatcaatggaacatatctggatgattaccttttgatgaaccacttagttcgaagtttgcatcctggagctgggcgattcggtcccttaactctttctctgtctttttggcgcactccttggcctcatgcagctggtccctaactgcttctcgagttcccaaatgaggaaccagcttttccaaagttgtggtcttggcttcattgcgaagatggattctctgcatgatggatcatagttcagttctgctaaaaagaaaaacaaagttacaggaggccgtcacttggaagacttacgtttacaatacgagtggcttctccgagcgctttcttcagctggcacacttcttcatcttctttttgacggattatgactatgccggcggcttgtgagttctcgtcccaccatttgatcaa

SEQ ID NO: 93718 - DNA, 2106 bp, Oryza sativa
  unsure (1)..(2106): unsure at all n locations
aaaacaacttcgtttcgatgaatcagcttgtcgataaggatccggagaacagccatcgtgtggttctggaaggcgatcaactccagggacaaggtggatagtgccctgaaggacatggctgtggtgatgaagcagcaggatcgcgccaaggaggcgatagaagccatcagatcattcaggcacctctgctcaaggcaggctcaggagtcccttgacaaccttctgatcgacctctacaaggtgtgtttcgttctagttctacctgcatatctcacaaaattactaacaaaatgattgctgcggtgtactgacaatatgcgggatttcattttcagaaatgtggcaaagtcgatgaacagatcgatctactgaaacagaagctgaagatgatataccttggagaggccttcaacgggaaggcgaccaagacagcacgttcccatgggaaaaagttccaggtctctatccagcaggagacttctcgcattctggtacagattaccgctccccctgttactcctactgattggtaatttggcatgtcaatgctgcattcagttacactcgaagttactgaaaccttcttgtgtgcatattacagggcaatcttggctgggcttacatgcagcagagcaactattcagccgctgaattggtgtatcgcaaggcgcaaagcattgagcctgatgccaatagggcatgcaaccttgggctgtgcctaattaagcagagcaggcatgatgaagcaagacaagtacttcatgatgttgtgcnnnnnnnnnnnnnnnnnnnnnaagatgacaaggtggtagcccgagctaagcagcttctccatgaacttgagccggtgacgcatgttacgtcgccaaataatgctgggctgagtgtcagtgaagagatcatggagagactagaccttgtgttgaacgaatggacgccgttcaggtcaaggaggctgccggtatttgaggagatagctaccttaagggaccaaattgcttgttgatccctttattcgcaaggtttttgttcttttgcttaatgtgcatacgggtgcgttgccttagaaattcatgtgcatatgtagaggctgttgtgggcttgtggcagtgcgagtaatggagtaaaggttgtgatgttcagatagatatcatatagctagagatcatgcaaagcatccaaggaatagtgtattttgtcttcatgttctatgatgcttataatgtgttgtaaacattctacagactacaagaaatccaagtgtacacttcacttggcttgttggaatcaaaaactggaagactgaaatggtttggtttcaagtttgcagcacaaaatgtctctttctctgaagtaaaaatgaaaatcttcgctatggaatgcagagttggtcctagagatgtatacttccgttatcctttttttaaaaatactaatacaaagttgaaaggaaacaaaatgatggggaaaacaaaaatcagtcagatcatatcagacaagcatttccagttcgaactggcctgtttagttccaaagtttttttctaaactaccaactttccatcgcatcaaacctttcatacacacataactattctatcacatcgtaccaatttcaatcaaacttccaaacttcagtgtgaactaaacacatcagtgtgaattactaacaacagagagcagcatacatcaaagtatcaaacagccaaacaccatctatattccgtgacagaaaggcacccaagaattggatgactaaaagaaattgcagtattattcatgaacaaactccaacattaatattcacaaattgagtatttgctttctttctgatgtttctgtcactacaccatttcttttcaagctaatagtaactgtacaaatctacttccccatgtcagagaacagagcaaaagtaagttccatcctagatgagtgaaaactcacaacaggtacaagaatgtgttaagttctgaacccagaaaattcgcgtgtcagagcactgaactactttccatttcttcaaacactgatgcgtgccgaatgcccatttccaaatggaaaattaaagagccctcgccactgcagatacagaatttacacaagg

SEQ ID NO: 93719 - DNA, 676 bp, Oryza sativa
tgccacatagaaggatcaaatcctcacgtaagtataggccattttaggcatttacaaatcaactccaaccaccttgatcggtaagtgagcaagcttctcgtccttgccttaccaggaacccggtttgtccgagcccgccccggcgttcccaactattggcatgcgaggtttccctgaaccgactagttacttagccagggtgtcccattccaccttgtggttgcactttgattaggttcgatgagtttcccacaggaatcggtccttatatgtgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcatgcaaaccgaggccaagcaagttaagtgtgtgattctaataatgcaagttgcaaacaaaataataatgacttttcaattataggagcaattgatcaaagggtgatttgccttgctcaaggtcttcacg

SEQ ID NO: 93720 - DNA, 978 bp, Oryza sativa
ctgcaccccccacgcaatcgacgtgatgcacctcactaaaaacctttgggttaacctttttgggtttcttaggggtttccggaaggtcaaaaaatacactggaagcacctaatgatctgaaccatatggaacaaccggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaacctaaagtctcatgactgtcacgtgttgatgacacaactgctaccagttgtaataaggggtatccttccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaaccgagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacgacatcacattgatactttcccc

SEQ ID NO: 93721 - DNA, 2484 bp, Oryza sativa
agatcttgtctttgccacgttggttaaaaagttaacggcgtcatacattaaaatacggagggagtagaataagtagatcttggctttgccaccatcgttgaactataaatattacattcaactcttgtttcctcttctgttcacatacatcttatgctaacaaacaaattgtatattttaaaatagacgaagtattaactagcagcatttcagtgtacaccaaccaattacaatggatatttatctcgtggagacaaacaaccaatgcacggagcagtggacgatcggttaattttgggctatccactaaaaggttggaacaataagttgttgctgggctaggtcgactcagcaagcttgaccgactgcaaactgcagagttagcccactgcaatggaaaagccggaaggcccgatgcatccgattcccaggagtggtaggccattttaattattcgtcttatttaaaaaaataagttaatatctttttttcatcattatttattactaaaagaactttagcattacttatatttttaagatttgcaaaaaaaatgaatatgacgaatagttaaagattgtaaccaaagtcaacgctgaagtatattaaaaaacggagggagccgtgatcttttgctctgtcgcgatacgatattcacctcagaaatgtcctagaagcccttatgttaacgcacaaggcacaacattgctcctgcgctaccctgccagctgatttgcttcccacttgtattgagtacagagtactcattgttagaaataaaatatgtgtggttagagttaatagtcaaatgcaaccatagagataacatacaaatatacaatcctaaagttaaaatataattctagatatagaatcttaaatataaatctgctataacttcttaggtagtctagtggttgtagtgacctgagtagtaccccaaggttttgagttcaaatctctttaggaacgaattttagattgggttgttcgcggggctaagttccctatttcatatatatccaataggatgtagaggccgggtaaaaaaatacccttctctaaaaaaaaataaaaaataatctgctataacttgtctaacttgttttgtacttcaactattttacctcatctgtactatacatatatacctcacgctcgtgatgtaaagttggaagcgttctcacctcccggaggaggccgcgtgattgtatttatattgtcaagaacagcccttgacgtggcacttacagagaatatgatcaagttgttacaacggatgttatccatctcaactaccctattatctagccagcaactcaactaactagaagataaaacgtacattgttttacactcctcctcaatcataacttggacaagttaagattgtacatgaaatatctaagactctgtatagacaaagcctttgtaaacccatcggctatttgatcttttgatccaataaacctaatatcaagcatcttatttgctactctttctcttacaaagtgataatcaatctcaatgtgctttgttcgtgcatgaaagactggatttgaggacaaatatgttgctcctaaattgtcacaccataacacaggtggttgagcaatctttactcccaattcttcaagaactgactgaacccaaattaactcagcagtagcattggccatagctttatattctgcttcggtactagacctaaacactgttggttgtttcctagcactccatgacacaatattaggtccaaagtaaattacaaaacctccagtagaccttctgtcatttagactaccagcccaatcagcatcagaaaggcactgactagagtagaactagacctcttaaagtgcaaaccaacatcaacagttcctttgatatatctcagtatacgtttcacagccaaccaatgttttgaagtaggagcatgaagatattgacataccttattaacagcaaaagccaaatccggtttggtgagtgttaagtattgtagtcctcctacaatactcctgtactgagtgctatcctcagtaccaagaggatttcctttgtgtgccatcaacttctctgtcacagctagcggcgtggaagctgatttgcaatctttcataccaactttagttagaaagtccaaggcatactttgcttgattcaatagtatatcatcagatactttcttcacctctattccgagaaaataatgtagctcacccaagtcctttaaggcaaaatcagaccttaggttcttaagcaaggctgcgactgcatcactagaggaacttgtgacaataatgtcatccacataaattaacatatacatggttattccatttttattataaatgaacagggaagtatccgcctttgacgaggtaaaacctagttcaaataacttgtgactcaacctagagtaccatgctctaggtgcttgttttaatccatagatagccttatcaagtttacaaactaggg

SEQ ID NO: 93722 - DNA, 1082 bp, Oryza sativa
gaaatcaagaatgatgtcatgaactcgacatgccttcgcctggccatattttaaatcaactgggtggatcaaacttctattgataagatcattaaaatagttctggccaacttcataggggctccatccttgtttctcatgaaccaatccttcagcaatccatctatttatcaaacgttgcttggtaaccttgtaatcttctggaaatatacccaagtataagaaacatgttctcagatggtggggaagttcaaagtaactaagagataatatctttgtcatgttcccagcatctggattgttagcaagtgcacaaccaatatcatttagcatcctgtcccattcatcttttgcatgcttgcccgctaacaagctagatactgtaataattgccaatggtaatccaccacacttagccaatatctcatcacaaactttttccagatggggattgtataattccctggaacgaaatgctttttggcaaaacaacattttggagtcagcaaaattaaggggttccatttgataaacacaaccaccatcacttgagcaatgtgatgcaactgcggcattacgtgttgtcatgacaattctgctaccacatctattattgaacaacgctaggctgacaactttccatgcttccacatcccatacatcatcaattacaacaaagtacctgtttcatgattttaacagggttattaaattatatatcatttaagtatgctttactatcctactgcaatcaggactgtataccagcatgcatgcttactctagcactcaggtcccctatgttgtaagtatgaatggagaacctagttagcaacatgggtatgtcttttcaaaagatatgtatgatcagcttctgcacaaacaaatttgcaagtgaacatgtgacaacatatctgtaatgcatgaggtttttgtggactttcagtttttcggaatgaaaaactttcacacgtgttagtttctttccggtagggattgggaaaaattcctgcactttcaaatgaggttttaacgttcacatgtgtcgtcattcgccatcaagcagtccacattagcactcc

SEQ ID NO: 93723 - DNA, 9182 bp, Oryza sativa
taagttcagcgctatacgatttggcgctgaataaaaggatcatttttaaaataagttttggctacggttcatttataaaattagtttttgcaaagagtcaaattgtcaaaatttgtgtatatagctgtctctaaataacactgcttttgttcctcacactaggtaattgacatgaaatatagacatctttttgttcattgcattaggccaatgaaatcgagttcaacagagccgagccacaatttcccgcccctctccacaacctcactgagcgtcacacccttggcagccgtcagctcctcgacctcgacgccatcgccgtcgagccggacgccgacgaggtgcttcgccggaggagccaccgccgccgccgcggtggcgtcgagccgcgccttctcctggttgagcgccacccagtatcccccattggcgtctcgccggacgttgtcggggtaacccggcaggtcggcgaggagctcgtactcgccggcgttgggccccttgatccagtaccggaacgcctggcacggcaccgtgtgcgccaccacggcgtggctcccgtcgcggctgacggccacgccattggcgtacggaagcccggccctgagcacggtcacccgcttcgtcgccgcgtcgtactttagcagccgcgccgtcgcatcggcattcatcatgatctcgctgttaaacctgcatccacatgaacacacaactcttgttagtgagatcatcaggaagtggattttcattcctcgagagaatatccccttattttacgtataccactaattaaagaagttataagaaaatttagaaacttttgataagatggatcaatatgagatatgttactatataaacaagttcaaattcaacatatataattgtaaaaaaaataatgaatattttgactacaaatattatgtgttatttgcaattaaatttgttattttttttacttgtataaattaaatttaaacttgcacgattgtgtgaagtgatatatctcataatgattatatcaatttttttatagaaaaaatagtggctatttgaattacttaaaaaacttagggatgaaaacactttcccaaaagatcacgttgttgctacgcattgcatacacatttgcatgttgcaaaaatgatttgattttaatttggatcgtgttcttttggtaattaccggcgtgggtaggtggtgctactatcggtgaagtagacatcaccggtggcctggtcgacgtcgatgccattgacgaagttgaacgggacgccgtccgcgccggcggcgagcaccttggcctcgccgccgcgcggcccgacacgcatcaggcccttgtacgcgtcggcgatgtagaggtcgcccgtcctgtcgtggaacgcgagccccagcgggcgcccgcacatgctctccgtctcctccgccggcgccaccggcgtcgtgcacatcggaatcttcctgcacgcacacggtcgaaccatcaatgtcaatcgatcaagaacgcgatggagtggagatttttcattttctagatttttttatattttaatttcattaatagactttttgaaaaaaaatattttcagaaactaaacctccagtggctcgcgtggcagcgttgttttaccacgccagctcctcgtgacgtgacaaggttatatggccatgccagacgggatggcgggatcaaaagtttatatttaacaatactttttgaaaaaatctattaataaaattgaaattgaaaaaaataaaaaaaagtctaaaaaaaattgatggagtgaggtggtgtgtactttaccggtagttttcgtggtgcgcgaaggtggtccagccggcggcggcgccgccccagcggaggacgcggccgtcggagacgccggtgtaggggccatggttggaggagtcgaaggcgaggctctcggcgccggtgacgccgtcggggagcgggaggtggaacgcgaactgcgcgtgcgacgtcttgacctgctgcgcggcggcgcacggcggcgcggcgaggaagaaggcaagaagcaggcagccgacgagccgcagcagcgtgaccaacgtcgccggaaaacctcgacgacggcgagccatggctgatcaacgttgatggtttcgatggagatcagcacgcacgacaatctgtactgcttttattgggagagatcacacggcctaattctaattcaagtcggtatacgactgcacttgtgtacagctcgatcgactggtggcgagtccgattgcttcgaccgattgatccggccgccagagtcgattacgattagaatttcgccggtcgccggcgctgcgttccgacgactaattgacaacccttgcaatcagatctttgttgatttttccttttttttttcctaccttactgttatgttaggctaggtatatgtttgaaggctttcttccatgcatccttgaagaggtatattataccttctcacaatttgagagataaaaataacttgttaaattgattagaaaacaagtttttattagcaccagcaatacttttctggtcattgtgaggtatagagagtatatgtatcttatagtgttagtccggaggtagaaatacgtacctcttaattggcacattaatatctatacacaaattagtgatgatatgttgcatatgcatgtaccagtgatgatacctatcaggtatcaatggtggtacaatagatacggggatatggatacatgtacgcgatatggcaataccagaatatgtggcatttttcaaaagataatacgggatatgtttatatatatgaattaaatatagaaattatttactacaatcaccgtagttgatagcttcaagtccactatgtttaaaaaaaagctttaagcccattaactgtgtataactaataagagattaaaaccaagccgccagttgacaacaatcaaaagaaaaatccgtggaatcaacggttgctagatgcagtagcacttagcttccagttcctaaatccatcggatctaataaaaagatagttcttgtactgagaacataattaagaaggcaattacacagtcatgcagattcatttttattttttttaaaaaaaaaggcattgcagatcaagaatggaaggctagaagaggagcaaaggaaacaaacaacttgatggtgttagggttgtgtctagtgaccggcgtcaaagggactgtgttgggcagcggcgaccctagtcccttgggcatgccggtggaggagttgcatctagcctgtgggtatatactgccatgctgcccctaaagatggcatagggcaaggagatgtcgcactgtgcacaacgatggcgcgggaaaggtgatgtgcggttgtgcccgatggcggcaacaacgctgcagcatgtggagtgcgtcggtacaccacaagatttttgaggtcgacattggacgtatcaatgttgtattagaacttagaagtgtatccaaattattttatttatttgaattaaaatcataaaactgatgatacatacgtatctgatagagatactagacttgagggacatatccaggtaatgtaggcgatatgtagttaccagtgatgatacttattagttatgatactttcgaggatggtaccatgatagtaccttcatagtttcagtatcatgatatcacgtggtatcatgatatctagtatgtagcactgtagttatttgatatctcaaggtaccattaaagtatcattaataactcaggcaggtaggcccaactagtgtggaaacacgcacatcaaaagcagaaacagaagctttaatcaggagcgtgtggagagagagagaggcgtggaccccatatggatgcttggtaaaggcgaatgtggccctatgttggaagaggtcagagtcatgtgatgggtgctcgcacgagtcccatgttgcatggacgtcacgaatggcatcctatttcaagcatttttctaacgagaaatctataagtagttgtaaccagtttgcaactagttggtagtaagtgataaaaggctgcaggggtttagccattgcacctgtgaataaagaaataagacaagttgtttattgttctagaaatgccccgtaaatgtttaaggtggcagtagacgaggaagagagcaagcggttgagacgactcgtgaataagaaaataagatggtttgcctattagtcttgtgttggtctctgcatgtttaaggtgatagtaggtgtgaaagaacaacaggggttaagtcatgttacccaagaataaaaaaaaaaagaagagtagcttattagtatgccagtggtcctaacgtgtttaagcgaagcatctaaagagccgatgagaaaaatataattgagcacatgtgtagcgtgatattacttggctccaacgaggccttctactacctatgctctatcaacatttcctatataacgaggaagagcaacacattctaccatactcaccaatcttctcatagatgcttagtttctcaattacgctcactttctaagccacctgcttctcgtctttgagcccacggaacactggcacaactgctgtcttgccaccctacgattggtttggtgcctcctcttgcaattcctctaatcgtgagtaacctcttgtttatcctactcatgcaagaccatgtcccgacatagaaccttaattaggggggggggctcattagagaaaacgaggatatggctcctcacacaagcttcctgatgcaaccttggtgcttgcagtggacatacatattttagaaccagtgttactaaactctcataatctaggtattcaaataaatccaacttttagacaactatcggtaaggtattaattcctgatgccacaatactaatcaccgtgcatgcaaccatgagggaaattgtctctaggtaccatttataggctacacacctacgtaatggatcatttccgctttcaaactgatagatggaggcaattcaaaccggtgctaattaaatgtttagaaaatggtataacaccgtaatatgtgaataattatattccttccattcatcaccattctatactaaatatccctcattttagaaactactgaaaagcgaaactactgaaaagtacagtgaagtggacattacaactggcattcaacaagtgctctacccttcaagtgccatattttaatccggcttaaggaaggatatgtggtcgcttgtgtgtgattaaataaaaggattgcaatggattgtgtatatacaattttaatgataacaacaaacactataaatgtaaaagaaattgaattagcattgcataaatgtaactaagatgtattggcaaaaaaaattgactaacaatattgtgatagcataaaaatgtacatagcacagggtgttaatttttattttgcaaagtgtcaatgacatttttgcctgatattgtgcttatctcatttttctgccaatacaatgttaattccatttcttgtacacatatagcattaatcaatatgcattatcatcaaaactaaaagaatataacacattgagattcttttatttattacatgcaaacgaccacatgtccttcctttggctggataagcatatgtggcatgcaaccctaagccgagctcacgagcctgagctttttgtccacctagtcacagcaggccaatgaaatttgtaaattccattataaattgatggttttcactccatatttgtgaagtgatccatggatagtagtgacaccaatggtttctcatcgtggctcagctcttgatacttctaagtgattttagtggtttcatcgtagcatgttaggggtttatcccaccactaagtgatcttatttttattttcttgggtatatcgtgatatagaagacaggatgtacaatatgttcctttataaaaaaaaacacaagtagttgcaatcccttgaaaacttgatggcggtaaatgagaaacaacagcacaagttaagccatggctcccttgaataaagaataagacgagttgctatttttttttaagttgtacatatgtgttgaagatgatagtaggtaagagtgacaggagttatgttgtgcttcttgtgaatacagaaataagatgagttgtttgttattttagttatccctacatgtttaaggtggtaataggaaagagcagcatgggttggagcggttccaatgaataaagaaagcatggttgtttattagtctagtagtggtccttacatgtttaaatgaagggcccaaccactacccaaaaaaaataggcttgagcatataggtggcgttgacatttcttttggctccaataagaccttcttctacttgtgctctatcagtatccattccctatataaggggaagggtgataaattatgtgcatagccaactggcccacccaacttctcctagctactcaagtattcttatgcatgttgcctctgtgaccgtttctcatcttcgagcccatggattcaccaagacaactaccgtcttaccatcccatcactggtacagtgcctccccttgcgtctccctgagccaagggaacctcttgtgagagaatacaatgatgtgtctatacatgtgaacttgccaagacaactgtggcggtgcatgcatctccgtaaaatataatagagagggagaggtacttgcgatggattgataaagtaggtgaatatcaaatagcaattcccaattcttcattcatttggtaaatacttcatatacttctaaaattttatcatgcctttattaaaccactaactgtcttagtgacgcgaaagtacatagacctggcatgtcttacatttattatgttagtggtatgatgcttttgaataaaaggtccaaccactagagcaataaaggttacattcaagtgtatgcatgatgtggaatcatttaacaccggttgggtttctagttatgttattaataaccttcttttcataaggacagggaaccattagcaatttttattagcaaaaaaaaggttatcttctttttttttcatctaagaaataaaggcagggtggttttttgctgaaatgctggttgaagacttgaaaatggatagacataaaaatttgtgttttcccatgcttggaacttttttccccaagacaaaggacagctgatagaacaaaataaaaatataagaaatgtgatctctacaccctcatttttatgagaaaattactagcacaataataagagaatggtaaatttaatgtaaatatggcattcgcttgctttctcaatcccacgcaagtgcctcccttctttaaaatgggaaattagatacttaccatttaatagggtgtgaccaagaatttcccgtgttgatagaagttaatttacttaatatattgccactttggttaattaatttcgccacatttcaccttctccaagctacgtcaccttttctatttcccaaattgcccccacattggcctggccaactagcagtgatgaaagaaccgttctcacaagtgaatcatggcacttcagtttattaactgcaatactaagatttaaaaaaaatgctacataactaaattgacattcagacagtggaaaataaacaaaaatcaagagaatctctattgccaggaaatgctggatagcactgttgttcaataggctttacaagatgttcttataaaatgtcatatgagaattgtatatatttttgttcagagctccatcgtggcatcctcttggtgttaagccaaacaagaccaatatctcactcttccaattaccaactgactggagtctcaagcaaaactgtttcatgtgaatcttcaatccaaaccaactaatgtcagaaactcagaatatcgagatgaacgaagttatttagccatgggtgactaaaaacacgcttgatcgtagtctcacatgaaatgttcgcatgccaacttctgaatatctagtgacagtttgtgaactatatgaactgcgggttctgaatatccgattgatctaatcagagtctgcctcagaaatagctgatttgtcatctggcatttcatcagagctactcaactgagagcactcatcagaagcccagtcgcttgatgcttgttcctgatcaccgttctcgctctcagctcctgcactctcttcttcgagaactgaaacagatgtcttctgtgtattatcctgtatggttccattataatcctttcccctccaaacaataatctgctctttgtcaaaagagacaattatgcaaggaacaaggtcctacagcaaaacagaagggaagaaaatgctctgttacggatcgtcaaggaaaatacacgcattaatatatgcacataataaactcaccctgagcttgactccaattttccgataatcactttttggcaatcctttagaatctatccggaccaactcatcagtcaaaaaggcatcccgaaccattggaacaagactagcgtaatacccattcttggctgtgaaatagcgcagttgttaagtcctctcttcaaccctacatatatgtaagcgaaaaagcggtacagcgtttacctagcttcgtcaaaacaggaacatataggcctttcttcctcatttcctttgtctcctcaactgtcagtccttctattgttgttttaattagcctcgggtatacaggttcagctggcttccacagcattaacggaataacaggtcttttctttggattataatgccgtcccctgtacaatatcaactgaccaccatgcctgtggatgataaggccaccagttttatcctgaaagaagtgggcactactcatcatgctttctaatggacagaaatgtaacaataagctaaaatcaaacaaaagctactaaaatggcatcagtgtattcacattagtacatgcaggcaaagatgattcttatttattagacccaacacagatgaagctacctcaagctgatggcacacattctgcatatcaaccgtcggcacgccgaggcatttcaccctgaccgcctcgtcgttcttccagtgattatgtatgtcatttagcatgttgtgagtgagcccatctctccctacaaaaatcaccacccaatcgaatcataatcatcatcaccacatcttgaaatggagtaaaatttaccaactaaaaacaagtcctcttcttttttttt

SEQ ID NO: 93724 - DNA, 1642 bp, Oryza sativa
agagtagtcttacccagaccaccagaacccacaatggacaacaccttgacttttacatctcgtatccccttggcaaaccactccatgatatgctcctttggtccattgattcccacaagctcatcaacctcaacgtagagtgctggaagcctagggtcaatatcacaagtggtacagctggctaccagaccaataaaattatacctcttgtgcctcttgcttgcctctatcacacgtgtcttgagttcttcgatctcattagagatttcatggcaagccttcatcttcttcagtttgtatgagaatcccttaaagaatgtagattgttcatcttgcttgtgatcaacaaggaccaagaaggaatcaatgaaatcttcgatatcataggccaactcacgcacggtgtccctccaatccttgtgcaggggatcaagttcctctacagattcaagcatttccaaggcagccttcatgctggtcaactcatctctaaagaaggccatttgactgtgtacacctttgagcttggtgtacttgtcctccaacatcttggagagcttggacaggacggtgttcatcacttttgtagaaacacgcacaagcatcatcgccattactatcttatgtcagagctctctgttagatgatcgaattgtaggattcgtgggatggagaggtgtccatgaggtagtttgatggtactagtcatgaaactaggaagcttcttgtagttgtggaggatttgaagaaatgttctgtgttcatatggtgcctaggcctgcatttggaagaaagatgatgcactgagtccactcggtcaagtcaagtcaactagtgttttctggccgcacaattgttgtcccaaactcatcattgttatagttactttcagttataatattctccatctttattggctttctgttaggaactttccttgtttttctcatcacaaggcgttctttcagttgtctttctctgaatgtacacaacacctaccaagttgtcttgttgctttcggccttgattctaaagttgttttaacaattttcagttaacagtgaaccatcatataactctttaggccttgactctaaagtttgttttaggaaacactaccagagatttgatattcattcagtgacatgaatcatcatgacaaaatacttgggagaggttctatggctgcagagcaattgcagattcaataaggaataccaatttccatcttcttgtatgaatcatgctagcttaattttctcattgatttgcgggtactcttctaaactaggacagtgcttgggttattctttcactgttggtccttcaaatattggaactcggaactagtgggaaggaatgtttggtccattgtaaattggtttcttcaaatggtttgcttcatctttcatccaaagtactgttgttcagctggttgagttgtcagcttgattcagtttacagtggttccaatgcctttccattgttcctgtctagccatctatatttgggtattatttgacaggcctgtttttttgcttggtttgacagtctacttgtatgttttcattttattgttctgttggtcaatgtatgtacacacaatggttttgcactgacataatattttcttaccatacat

SEQ ID NO: 93725 - DNA, 2968 bp, Oryza sativa
ggtccatcttggccagcttaaaagattttcgctacgagaacttcaagttgcaacaaagaccttcaacaataaaaacattcttggcacaggcggttttagcaaggtctataaaggaagactagcagatggttctttagtagctgttaagagactaaaggagcagagaacacctggtggggaactacagtttcaaacagaagttgagatgattagcatggctttacatagaaatctgttgcgtttacgtgggttctgtatgacacccacagaaaggttgcttgtgtatccatacatggctaatggaagtgttgcttcacgtctgaaaggtacctcgccttccttttttccagtcatgcatccctatatctttcaaacaattagaggtttgatttgggtcttattttgtagaacgaccaccatctgaacctccacttgattggcaaacaagaagaaggatcgcagcaggttctgccagggggctgtcctatttacatgatcattgcaacccaaagatcatccatcgtgatgtcaaagcggcaaatattttattagatgaagactttgaagctgtatttggagattttggtttggccaaaccaatggattacaaggatacccatgtaacaactgcagtacatggaacaattggacatattgcaccagaatatctttcaacaggaattctctctgagaaaactgatgtatttggctatggaatcatgcttttggagcttattacaggaaaacgtgcctttgatcttgctcttctagcagaggtgagggtgtcatgccactggactgggtaagtaactggtacattcctcaatccaaattgcagtcgagatgttcatgcccttttgtggcttgctgctgtgtcagagttagataaagtaacttttctgtatgtccaaaaatatcatctaataaaatgtagtttcagactttcaataaaggtcttaaaaaatagtatttttatggttatgtgctctgtgcaggtcaaacgattaatcaaggaggaaaagctggagaaattgattgatccagatctacagaacaagtacattgatgctgaggtagaatcactaatccaggtcgcgcttctttgcacacaaggctcccctctggaacgccccaagatggctgcggtggtgaggatgcttgatgaaggtgatggccttgctgaaagatggaaggagtggcagaagatagaaatagtacagcaggacgtggagcttggcctgtatcagatggttggactgttgactcaactgagaacctccatgcggtcgagttatcagggccaaggtgatgaatgctcaccggtaactttctgctgattcttgtacatcggaagagcaattcgtactgatcaccctagtcgaatcaccatctgtcatatttgtttgatgtataatgctttttcttgctcgacgcacaaccatggacattgccatattggtgccacggaaacagcacaacccgaggaactagtgtcctgagtggttgctgcaacaatgtcccagtatgttaaacctacaatttagtaggatggaactgggtatcatttttgcctcctttgggaaggcttcagatgatgcaattgcccatggtgtacttttatttgggcatttcgttatgtctgtgtttcctgtaaaggatatatacctagttctgaatcaaatgtaccttctgcacagagatgtaatctttggtaagaatcgcttctcttttttttcttttcctaaggtggattggacaatttggtcctgttatggccgtgtttttcttgggaagattatatgtttatctccgtcttacactgttaggcacattatccgtaagtttgttatttaaagaaaactactagcagggtagcctgcgagtaattgctcggctagcacttttataaaattatctggtttttacacatgacttttttaaaaaatatactaaatagtcatctaattgttttaggattctttttttttttataaaagaagtcgaatcttctcattagcaaccaccagcaactacccctcgctcatttgcccccattttacttgcttgctcagcttgccatggcttctatttatactcacctttagaaaaaccaaaccttataaattttagagttcaaaatagaacacacatgtaccttttgttcaaatataaaaatcaagttgtaattctcatgtaactctttatttatttttcttaatccataatattataatctaatttcacctagactttaggtggccgcacgggcattgatattgttcaaaggtaagactatagtttgtttagaaattatctcatagatagcgaactaaaggttggacgatgtcattttaaaatgattcagggggtcatatttttatccatagttttgtgtgtttagatccatgggtgtaaagttttggcgtgtcacatcggatatacggatacatatttgaagtattaaacgtagtctaataataaaataaattacagaatctgcctgtaaaccgcgagacaaatttattaagtctaattaatccatcgttagcaaatgtttactgtagcatcacattgtcaaatcacggcgcaattatatgcttaaaagatttgtctcgtaatttacacgcaatatgtgtaattagttattttttcgtttatatttaatactctatacatgtgcctaaacatttgatgtgacagggtgtaaaattttgctagggatctaaacaagccatttaaagaactttaaaggttttggtgcacacaaaccacctaccctattaacattgtttgaagcaaatttctttctttttcacatgtttgattattttctttgaaacaatatttatttcaaatataatttaggactgagggagtaagagccaatgaaccaatctgatgggaaaagaatgtgggggtgtcagtctcaggctctcagccacccaacatcaggcggagatgacaacat

SEQ ID NO: 93726 - DNA, 1011 bp, Oryza sativa
aactagatatacttttatgttctaaaaaatgtggtctgcctacatagcatcgatcaaagaagtcaaatattttaagaaaaaaaatagtacagcaatagtaaaccttataaggcaaccttatggtcgtttcaaagacacttgcatcgtaatccttgtcaaagcttagtgaatcggccacccagctggcatcatgaaatagacatcgactgaattagagtatgacataaatcataagaagatactccactctgtaatggagctataaacaagcagattagagaacttaacaagatataaataataaaaaaagtgctaaacaaaatatactcataaaagccatttatcacatgaatagatgaaacaaactgaatgcctaaagaagtaatcaagaaattccgatttccctatatcacaagggataaagagacgcattcattgctaaaagcctaaaatacctaaatgacaaataagtttactttctaaattagggaatgccatattttaacatcacggaatattaaaggatgaagcagacacaggtttagtctgaagtattgaatgttaatatgagaaacctaaaatctaatagaagtctctgtcgtgaatggaccaaattaaagcgcatgaggaagcattatgtacattctgtatggtgaaaaaatagttaaactcactctctggccctctgaaattcatcctttaggcccattatatacagtgtatcaagtgagtccacaagagttgccccgagaccaccaaagctattgacaccattctttgattgtggctggaaaataatttgaacaaagaaaaatacagaagacacttcagagctcactcagataagttagaagggcaatagaaataacagaatgttgactaaacaaacctgaagttcatccattccccaggcatacttcacataggaattccaagcatgggccatagcctccttaaccttttctctcctttcattattaataggatcaatttctacaagcttttctctgg

SEQ ID NO: 93727 - DNA, 1180 bp, Oryza sativa
acccgggatcctaacccgtagggtcctttgccagagtttagggtatccctggcgccggaaaaaaaagtccccggagttgaaggaaaaggcctgaagcacaaatcgcaaagttcatccggtggaccaaaatctgcaagatttggaggtagattttcagtcaacatatcgttagcatttatcggcgaaaaaaaatgagggccttaaatgtgttgggctgatatatagcccacagtttattgggcccacttgaggaccaaacattagctctttaggcccattttttaggcccagtcgttggggaagcccgacgatggcgagcagtccgccgcaacagccgacgacggcggcgggaggcgccggcgttcttcccgccgccggcgcgcgcggtgcccgtcgccctggacgcgatcctgtcgcggcgcgtgggagctcggtttcccgccgccgacgatgtctccctctgcccgcctcgccgcgccgcgcctcgccgcgcatccgaggacggggacaagcccaatcaatgccctgccgtggcggcctcgccgccggccacctctgcaacctcgcttctcctggtagttcccctctttccatgctctgcatttccctgatctgggtgcccgtgtttttgctctcgtgctaatggctagcgaaatcaaatcccaatgcgtaatgcgatacgatacgcgttcctcgtacttttcccctcggtgaactgatcacggaatggattctcgcttagcccattcgaggctctcgcatcgcattcatgtaatatcgattgaattcctaccgaggaattggatatcgagacgaatttcgtttccccatgcttagggtgatatgatgatatcaactgattgatttacagtttacaccttcaaacttttttgcttataatgctcgtgatcgtacagtttactccctactgatgtagtgatgtttaattacatggacgttcaagattttcctcctgtgagggtgaactttttaaacctccccaggaacatcactaaaattatcatcagcttaccttcgtcggtccacttgccgacgaacccatatgaagtagctttgcaggtagcatcaggtttcagcaacctctcgcagctatagcctagtgagtatcccacattggcgtatgcactgtgaaagaaaattttgcatcattgcttggaag

SEQ ID NO: 93728 - DNA, 1579 bp, Oryza sativa
cttcagtgtgctaagcattgttgtcgaagttgtcaggcaagtcagactaaatggtttcttacctgagaaaaaaaatgcagaccaagtaaattaacaatttatctgatgaaaacagcaaaacacaaagtaacacttgtcaggtatttctgaatcttaataatacacaatgaaaatagtaatgttttctttcgtggaatctgacggatctgcccacatttgcagtgcatatggaaatgtggggttctcaatgggctacagttgcagtagacagatcaatccagaccatctctgcacagataaatggactggtttcgtagggagatggagcgactctggcaaactgatactcatttttgtgatgttctttgggaggctcaagaagttcagcatgaaaggaggcaaagcctggaaacttagttagatcttagatgcagtaccagctgaacattgcaggtccctgagggtaggaaaaaagtataaagatgtactctttctcttccgtttgtttgtatattcattttcacatagacaggaaccttccactgtcatccttgcacaaagctcaccctccactccaagtgttggcagtttcagatcaggtgaatgaaagttcatcacaagaaatcaacataggctaattaacctgattcacttcacatagagatgcttctgtcactggctccctgcaatgaccatttattgcatccatgtaatgctagtaaaaggccggatgtcattgtgatggctgcaatacttaaatacccacatgttaaaagatatgtagatgtctatcaagtggtgatcagttcatacagtacgtccagaagtactttcttctgaagcaagggcatctagaagaacctgagagctgagatcacaaagattgaaaaaacactagattgcttatcctagtcactacacttttctgatagaaattaaaaaggacacacgtgcaaccaagggtgcatcagtgaaaaaaagagagaataaaagggaaaagggaaagaaaatctccactacacattgtgcattctggtacacttgttcccactacagaagatgttgattatatagcaataaagcaaacaatctagtatttgtggaatctgaaagataaacctcagctacatacaaaaataaaacgaggtaacaaattgtaatctgttataataaatatataaatgttcaattaagtgaatgcaaaggaaaaccaaaattagccataactttgataccagaatcttcaacaatggactgaacagcaatatgcagtagtaaattcaaaataatggttactataactaaatttcagtatcatgatacacaggtgaattctattaggaaaacagggacaaatttgtagtccaaaactagttgcacatgcaacattactgatttcagctaaagaagaacacaactaattttttacaataccgtatgataataatagattaaaaaagagtgaattattgaggcagagcaggtttacgtgtgaagacaaacagctaatctaaattgaggatattcttatgactcaaaaaatgtgaatgaaggattctaattgctgacaatcatttca

SEQ ID NO: 93729 - DNA, 1110 bp, Oryza sativa
tgtttgcagctccttagtcattattatttttgctcagattgactcagatacaagacaactcctgaagagtaaagatatcaaaatatggacgttttccatcttcacagcagtatcctcatttgcaaactgcggcttcaccccggtaaatgataacatggcaatattcagaaagaaatccagtctataacttctggttaccccacaggttctagcaggcaacactatattatcgccactattgaggttaagcatatggatcttgaggaaggttagcagaagagaagaatatgcctacatccttcagcatccagaggatactggctacaggtatttgcaattgcagaagaattcagtcaacatggttctcactgttggggggctagttctgctgcaagtgatgtttctttcctattttgagtggaactcaagtgccttaaatggaatgaactgatttgaaaagttggtttgctcattgttccagagtgtgaaactgtgaatacaaggcatgctggtgaagctgtcattgagtccaatactagttctatttgcacttgtcatgtaagtattccctataaacatttcataatatttattattttgaagcatttatcaggactttcagaattttatcataaatatggcacaatcaccatcagtaactgcaaaggataaattaagcacataatttcagaacgaaacaacataaacaattatgagcttaaaatcttcagatattttttggttgaaattgcttagttatcttaataaaggaacacaaaactagttcacttgttgaaggccagccttatgttctcgcaagagtttcagtttaaatgaagttctagataataacatggaagtatgaacactgtctcggtgagaaacatacttgtttactacagctaagtcagcaatttgtgtactcgaaaaagaaaaaaaagcagataaatgcatagaacaaaatcaaaacaaccataaaatcctgcactatgacagaggtcacaacatggcggacaagaacagatcccacaatccagatagtcaattcatcaaaaaaatagaaaagcatgctaatacccacgtaaacttcaatgacaacatgccattaac

SEQ ID NO: 93730 - DNA, 642 bp, Oryza sativa
tcttcagaaagatcttaatattccttatggtggtgatggttgggttttcctcacagaccaacaaaaggtattttgcagctcgttgctctgttgtagttcacttgtagtttatgacacttcacagtttacatgattaacttgttgtttctatctacaggggcttctaagtgtcattgaacatctatttccaaaggctgagcatagaatgtgtgcaagacacatttatgctaattggagaaaaaggcaccgtcttcaagagtatcaaaagagattttggaagattgcaaggtcatcaaatgctgtgttgtttaaccattacaaaagtaagttagctaataaaacacctatgggatgggaggatttaaagaagaccaatcctatacattggtgtagggcttggttcaagcttggatctaactgtgattctgttgaaaataacatatgcgagtcattcaacaattggattatagaagcacgattcaaacctatcataaccatgctagaggacatacggatgaaggtgactcgaaggattcaagagaataagaccaacagtgagagatggaccatgggaatttgtcctaatattctcaaaaaaataaacaagataagacatgcaacccaattttgtcatgttttatg

SEQ ID NO: 93731 - DNA, 945 bp, Oryza sativa
gaacatgaaagctgaggatgctttcaagagtacgtaacaatttatctggaattcactgagctgatcagctatacaccatcaggatcagaaagatatagctaattacaagtgattgacaatattatttggaattcttttattcagacctccaggtggcgatcaagtgcaagaacggcaatggtgagtacgagagcaaggccaccggaaagctcgacggtaccggcgtcttcagcatccccctcgacgccgacctccacagctccgactgcgtcgcacagctccatggcgcgaccaacgagccatgccccggacaagagccatccaagatcgtgccaatgtcagagggcacctttatcgccgtcgccggccagacccactacccatcagcgttgtgcgcatcggcgaccatctgcggtcccatcaagaagaagatcatagaccacttccacaagaagccggtgccacccaagccagagccaaaaccggagccacccaagcccaagcctgagccggagcacccattcctcgaccacatccacaagaaggagaagcacttcttcgatcacttccacaagaagcccgtgccgcccaagccagagcccaagccggagcccaagccagagcccaagccgagcctgcgcctgagtaccacaacccgagccctccggcgaagaattgatgaatatgatctgcattggatggacacagcatgtttgatcatgccgcagatgatgatcctgctcagcacaggagtgtaatttgtacttgattatcgggcatcagcagggatgtttgtactatttgcatatttttctctcccaaatgaaattatatatggtaaaataatttatttacatttagccagatttggtgggacgactgattattcaccatttagcattcaccttagcttgattcaagctactgggctcggccgaaagaaac

SEQ ID NO: 93732 - DNA, 878 bp, Oryza sativa
acattctgctgtctttgccgattatcaggtgttctcaacccagttggtatcagctgcaccatctgctgctgaatcggctgaaccgtttgttgttgaatcggcgaaaccgtctactgttgaatcggctgaactgtctgctgttgagtcggcgtcgacaacactggtccggcagttggctgagttggtaggaacattgaggcaatctagtcttgggacagccgactaatattctgaccagcatgttgcggttgctctctagaaaagagacgaggattaattgtctgcctttgcaccgatgatggcgcagctggtgccggagtcgaagctgctgccgtcgactgaactggtggtgcattggaagtactctgttggttacctatcaccaagttcctgtaatttgggaagacaccacttggcaagtagactggccctgtgttctgatgttcagctatcgtgccaaccatcacagatttgaacatatttgttagtgtattgacgatctctccagattggttgatcaaggcatgttgcaccgcataatcaacttggtcatggaaattggtgcacctaggaggttcttcttgcacttcagcaccatcttcgccaagatcttcaaccacaccatcctgaagcccgtcacctttgtcacccaaggcatctacaacacatttaccaccttgagatgagcttgagccaacttcatcagcagcaaccactttcagcttgtatttctgaacaattatcccttggcgggtttccttgaatgagttcatgaacttgtcctttacgctactcatcatctgttcaagctcatgcctctgttcggacgtcagtttgtctagtgtgattggaataatgtttgtctcattgacctcaga

SEQ ID NO: 93733 - DNA, 2705 bp, Oryza sativa
attaaggagatctttgaaattcatggagaggtcacaaaagtcgttttaccgcctgctaaggctgggaataagagagattttgggtttgttcattttgctgaaagatcaagtgcattgaaggcagttaaaggaagcgaaaagtatgaaattgatggtaatgttttctccatgttgttatcctttatcattatttattaaacttgatcttaatctaggtaggtgctttgtgtggaaagcagatgtgatttgatcatttgctgcaatgattttatgggacctttgcagttaccaccactactctgtatattagtaacttcgaaatatggttgattagaaataatcttgtgctaactgaatcacagggcaagtgctggaagtatccatggccaagccattgggagacaagaagcctgatcactcgttcaagcctggaggagctccaaattttcctcttcctccttatggtggctacatgggagatccatatggtgcttatggtggtggtggtcctggattcaaccaggtaaaccaaactaaaccaagtggtgcttatggtagggttggtcctagtatacctaaataccaaacacattctgcgagaaaatccacatataaataggtataatacatatgtataatcttgttgggtcaaatgcttcgttctctggctctttttgtccatccactaaaccctcagtccacaaaatgacccattcttgagcatcgccacttcagctacagtctgcctataaggcccagtggcccacaatgcccaacaccaaaccctagttaaccaatatccagcatctctattcctcaattccccatttccagctacccagctggcagcatgggtgcacggtcacccaggcatggcatggttactgcggtcccaagtgccaaagctgacaggtgcccagggtggcagaacgtcgcatttgccaggaggagcagctgagcaagtagtgtgcctgttgcgcactagttgatctctggatcctgtacaaggacatgcaggtagatggaggagctagcatgtgcgtcttgattctaaatcctaatcttctctgtaatatgtgcatcttgattcgaaattcgaagtttctttgttgatacgtaaatgtgaaatcaaagtatggtacattgtttttttatggaaaactgtggactgtagacaccaaaacaaaaatagaaagatctgtaaccacatcagggcatgttgtaagaacactaacattgacctgtgacggtgtatcaaagcaatccaatagactgttcacttcacatgctcccttgatttgtatgtagatgatgaagttcttagtgttgtctaatgatgataaagcatcatattctgaagttgtgaaaaatgccttgagtctgttgaagattagtcaacatatattgatagtctgttaatgttcttttatacatggatcatgatttttttgcatgaactttccatttagttattagatactacctccgtcccaaaatatatctatttatagcatagtatcttgtcccaaaatgaagctatttctccacctacctcctctcaactaattaatatcattctccttcacccactttcttttttcaatctatcacaaccttcctccaatcattcccatctactttttattacttgtgccaacctaaaaaagcgcacatatgagctgtttgttaattgtggggctaaattatactccctccatcccaaattatagggcgccgctgccccctttttaaggaaaatcaaacttggttgcttttgactaataatcatactaaccatatctatactaagtattatgcatgttatatcactagatttatattttgaagtacttctatgtgatgctaatttcatatttgttgggatcatagaatggaataaaatactagtcaaagtatattattgaagacggtgtaaaaaaaatatagccttataatttgggacagagggagtagttttctttaacgattttgtaacacctttaaattaaattgcattgtcatctattgtacattgattttggtagttcatatactgtccttttccatgaaatatgctttaagtaactctgaatacccatgctagaaatcttgcatccaccactgcatattgacaatttagtcattgtctctatcaacatttttgttacagcctatgatatatggtagaggaccagcaccagctggaatgaggatggtaccaatggtgctccctgacggtcgtctgggatatgttctgtaagataatgctgtcctagagtcacaactcacaaacaagtcttaccatacatcttcatttcctaacagttctgtttgtaatgtcttgacaggcaacaaccaggtggaatccctcctccgcccccaccgcgtcggggtgaccggagggatggtggcagcagaggtggcgaagggagtcatggccggcgatatcgcccttactagctttttcgttcccttggtcctgccgccatccagccatcacgcaatgtgatggatttcttaacctaaagaaacaagatagaagcttgtaaccctgttccagcataacacctgcaattgcgcaagacatgtaccgtcttcttttttcagttatatttatctgtcatgcatgtggtgcttgtgacttgaaaacagtgtcttgaagctttgtatctcgcggtggcgtctgtagtggtaaaccgatggaa

SEQ ID NO: 93734 - DNA, 3056 bp, Oryza sativa
agggaggaaatcttaatcagaatagtgatgtggcacaggattttttcaataacttccaagatcgggttgattacgctgtgcatcatgctttgatcaatcagtctggggtgttagtcaatagcttatcaaacatgatgaagtcaatagccgatggttcaatagctgagcatcaggctgcaggcccggtttatttgcaaggaggtgtcttcccaaattatcggtctttgattaccgatgttcagccatctactcaggcggttacctccgttgcaccaacaacttagccaacggcgccggcaacaactcccctacctgcttcatcagcgatggcgccaggccagccggtgaaccctcggttgttaatgagagagcagccacagcatggcgggcaggttgtgaatcggctgacccaagatcaggttgctgccatgtttctgccacctcaatctgttgttgatccaatacatcagcagccgattcaacagacacccccaattcagcaggttgtacaaccaatccggcaacaggtcatgcaaccattcagcaaacaccaccaaggcagcagcccctacagccgattcagcagacgctgttaagacagcaaatcgttcaaccgatccagcaccaaggttcaataagcgcatcggccgggtttgcaacgcctggtggtcagcttgtacaacaatttttaaaccaagttgtcccagaacatttggttcaccacgtacagccgggtggcacagtaatgcctcaagttattcctgagcacttggtacgcaatatccagccgaaccttcataattaccaagggggtaacttgaattatcaatatcagcctccttccccgcaagcccaatatcagctaggggcattggctcaacctcagtttgcgtctcaatacggtcagttcgagcccatgcaacagcagtcacaaggggcagctcagcaacaaccgtgggccaatgtgattgctgacgtaatgagggaacagtttgggcttaaaccaaaagagactggaagtttgtatcggcagccttaccctgagtggtttgagagagttcctcttcccaattggttcaaagttctagacttctccaaattttcgggacaagatggtgtgtcaacttatgagcacattagccgattcttggctcagtgtggtgaagcatcggctgtagacgctctgaaggttaggttattccggttatctttatatggatcggcttttacttggttttcctctttgttgtatgggtcgatcaatagttgggccgatttggagaagcaattccacagctatttctacggtggggttcatgagatgaaattatctgacttgatagcgattaagcagcggcatgatgaacctgtgcaggagtatattcagagattcagggagatgaggaacaaatgcttcagcctgagtttaactgatgcccagttagcccgatatggcctttcagggtatgattgctccgattagggagaaattctcgtctgaagactttgatagcttgtcacaactgatacagaagctaaccttgcatgagcataggtctgcggaagttaagaaaagctctaagaaggttaatcatgtttgtctgtacatgtatgggtcggatgatgatgaggatgattctgaaatagctgcagccgaatgggtgaggagtaaaaaggtcataccatgccaatgggtaaaaagttctggaaaagaggagaagtatgactttgatattactaaagctaacaagatctttgatctgctactccgagagaagcaaattcaacttcctgctggtcatacaatcccatcggctgaagaattaggcaaaaagaggtattgcaaatggcataattctaggtctcattctactaacgattgcaaggtttttagacagcagattcaagtggccattgaggggggcaagattaggtttgattattccaaaaagccgatgaaggttgatgataacccttttcctgttaatatggtgcatacagctggccaaatagccgatagggtccgagcaaggggttttcagggaattcggtaaagattatcgacaaatatcatgaagaatacgatgatggttttgatccccattggggttgtgagttctttagattctgctggaatgaaggtatgagattgccatttattgaaaactgccctgggtgcagtgatatcgttgagagctcaagccgatcatataataggggtggtcgactaaggcagacaagagtttctgttcatcaaagattgggtccagtgaatcaagatcatggccaagaggcaatgtaatcaggaagaatcaatggtgtccttctggtattttcacgaagaatcagaagaacatttaataaatctagatttggaaataaatgtggatggaggaaacataagaatttttctatatgaacagaattggttgtagaatggtaagctctaaaggaaaagtgttgactctagggagatggtatttcatgtactctagagatgtttgggaaaggatccaaaggaaatatatcccagagcaacggttagaggctagagaaataaatggaggggttttgtaaaagtcaaaagaaataaaaaggagggttttataaagtttgaaataaagaaggattttataaaatttaaaagagagcatttaactttacaaataaaatttaggtccaaagtaaaagagattaaaagaaagtaaggttgcttcaaaggaaaagtcgagaagagcacaactaaaacttttcgcgaaaatttttccctgaaaatttgagtatattgcatcaacccttcgctcattcatcttctcatacattgcaacaagaaaaactaatattatagaaaaaatcacatgattaggttacgatttcgatgtcaatatagttttgaagatgatgcggtgatttttttggataatgaattaaattcctgcctttatctcaaataagctacaatcacttattacaaaattctctcagagagagcaaacattcagaccacttcatagcgacgggcacgtccagcaagaatagatccaatatacatcgtc

SEQ ID NO: 93735 - DNA, 1545 bp, Oryza sativa
cgatgttttttgttataccaagatgcccttcgagctaatcagtgtaggcaacatgtaccagcgcgagattcaaggggctcttggtgacctgatcggccgaaatgtggtggcctacgtcgacgacgtcgtggtcaaaacaaagacaagcgacaagctgattgacgacatgagggaaacattcaacaatctccgacgacatcgactgaaattaaatccggagaagtggacgtttttagtaccatcagggaagctgcttagtttccttgtctctaagcgaggtattaaggcaaacctagagaagatcaaggcaatcgagaacatgaattcgcccacaagactcaaggaggtacagaagctagcgggatgaatggtggcactaagtcgattcgtggctaggatgggagaacgagtacaacctttcttcgctttacttaaaaacccggacaaattcgagtggacacaggatgccgagaacacgttcatcgcgctcaagtggtacttgtccaaccccttgtagtcgttgcccctcagccaatggaagagttatttccttatattgccgccacaccctattctgttagcactgtcatcgttgtcgagagggataaagcacaacacccggtgtactatgtcaacgaggccctccatgacgccaaggtctgatatcctcaaatacatagactgctctacgttgtaatcatgacattgcggaaactgcgccactacttccaggcccataaagtcacggccgtctcttcttcccccctacgtgcgtcgtgcctgcctggcgctgtcaaggccacatctctgggtcatcctgcagcatgcctacacatcgccatcgggcctcgtcgtgcgtgcggtggtcgagcatcgccgtcgggccccgcatcgacttgttgctctccaggtgcacgacgcacctgcaccactgcacgtcgccgtcagccccgcatcaacaacgggatttcaccgttgatgttgctgctgcttcaagccgtggtcttccagcatcttgcgaagttgccgtcgaggatgacgactcgctggatattgtcatctctgctgcttcaccttgttggttcccaccatccgcatgaagttgttgctgtaatgatgccagatcctgccggcgtggaaagggcagcacgcccgcttcgttgactgaaacaattagcaagcagctagaagaaatctggagcagcaagccgctgaaagaaatttgggatttttttccccttgtgttttctgttttttctctcttgttgatgcaggtaaatgcaaatgatttgttttatgggatagctggttacatcgattctggttggaggacggatccaatggtgcacttgtgccgagagatttttatcttcatcatggacatttctaggttagaccaaccatccagaagcctattaacatttttttcatctaacctataaccaagccaagggcataacggacattttcaagcaaactaaccagtcaactaaagaacaactaacggtaggggtatagaagagttcaaggtgaaaattcggaggt

SEQ ID NO: 93736 - DNA, 908 bp, Oryza sativa
gcacgccactttaattgacagttaggctagtacgtttgaatcaatgctttccccatttaaggctggagatcaaggacagcacactcgcactgcttattctcgctagatggccaataaattcataaacgtgcacagcgaatccagagtcaatatttcatgtgaatttatgtttgtcctttgtggttaacttcatttaggtagagaaataaaaacaacaggcagatattacagtacacatcgtgccctgctaatatgcatgcgatatccaataaatgaacccggtcacactttaaaaaaaaaactcctgcggatgaaagctagcaagtacattatatttcaatgtataatctcacacgggggtagaaagcgttattctgcggacacactgatatggcacgaaatcatacaagaccaaacgtagataatgtttagtgcttcgctggtgggctagggttgtggtactcaggcgctggctgtggcttgggctgtggcttgggttccgactttggctcaggcttgggtggtacgggcttcttgtggaagtggtcaaagaagtccttctccttcttgtgaaagtggtcgaggatggggtgctctggctctggcttcggcttgggcggctctggcttgggatccggcttcggtggcaccggcttcttatggaagtggtcgatgatcttcttcttgatggggccgcagatggtcgccgacgcacacaaagccgacggatagctggtcttgccagcgacggtgacaaaggtgccctccgacaatggcacgatcttggatggctcttgcccggggcatggctcgttggttgcgctgtggagctgggcaatgcagtcagagctgtaaaggtcggtgtcgagagggacgctgaaagcgccggagccgtcaagcttgcatgc

SEQ ID NO: 93737 - DNA, 3341 bp, Oryza sativa
ggccgccttctttgcggagattgttcgcctgcacggtgtgccgctgaccatcgtcgcgatcgcgactctgtcttcaccagcacattttggcgagagatcttccggctcgctggggttcagctgaatctctcctcagcttttcatccccaatccgacggccagtccgaggtgacaaataagatcattgccatgtacctacattgtctcactggcgatcgtcctcgacagtggcttcgatggctgccatgggcagagtactgctacaacacgtcgtaccaatcgtcactccggacgtctctgtttcgtgttgtcgacgagcgcgagccgccgacgcttcgagcttacgagccgggctccacaaggttgccggcggtacaacaggcgctccaagaacgggatgattttctgcgcgccatccgtgatcgtttggaacaagctcaacaaacctacaagacagcatatgatggcaagcaccgagtgttggagttggcagtaggcgcttcgtttgcttcactgaccaggtgcatgtctagctgtcaagaatcgcgcatgaggcgacccgagtgcaatgtcccatatcagattacgcagcgcatcggatcagtggcctatcgcctgcggctgcctccaggtgctggcttacatgatgtttttcatgttggattattgatgcctttccgtggcgatccgccggaccatgcgccgcccctgcctccgacgcatcatggtgatgtttgtcttcaacctgcttctgtgtcgcaaagtcgtttggcacgtggggttcgagaggttcttgttcagtggaaagacaggccggcggctgaggcgtcctgggtcggattggatgattttcatgctcagtatccagattttcagctcgcggacgagctgcttctccaggggggagagatgtcatgtggggattgcattatgcacggcgccgtctcagagttccgccgacacagccgtaatgaggaacagtcatcggtttagtctctgttcagtttacgagtttgttagtcatctttatctctccagttgttaggattctatccctcagctcccttataaattgtaagctgctttcgttggaagtaatcaatcaaagttcagattaatctagtatcagttcctgccttgccggtgcggtgccgaacacggctcctccgcgccgacgaggtccaggaccacgttctgttacagcctttaaatacttcctccgtcgcaatcctccttccaatctcctcgtccgtgacaacttggtatcagatttctctggttccgttcccatggcttccactcaagcacagctcgacgaaatcgccaagaacctgacatccatggcggcccaaatctcagacttggccaggaagatgagcgtcctcgaacctttggttcccctggcgcccaagctcagcagtttgcctgaccgcgtcacacaagtccaggcgtccgcgttcgagtactccgagcaagtccgcgccctcaatctggccgtccagcgcgtcgaggccagccatcgctcgtcgcccgtgccagagacgtcggggtccgctacgcacgcgccgcgcggcgctccgccacccaccggcgacaatgacaagcagtcgggcgacgactccaccgtcgacaacagttttcttcctcgtgccaagttggagtttccaacttacgacggcaaaggcgatccgcttccctggctgaatcgctgtgagacgttcttccgtggccagaagacaccggagtcacgtcgcgtctggtatgcatctttgcatcttctcggtgatgctcagttatggtactacagattgtaacccaattccggcgaaccatcgtggcagcgcttcgtcaagttggtgcacactcgctttgggccacccatgacggacagcccgctcggcgaactcacgacactttggcgcaccggcacagtggacgactacatcaatagcttcctcgccttggcttgccgcgacgccaaactatccgagaaccagcaggtgcaattgttcacggcaggcctcgtcaatcccctcaagacagatgtagctctctgccggccgagttcactggacgacacgatcatgctcgcccgggcgtatgagcagcgggttcaactcggcacaacggaccccgtgccggctcgctctggccgcacaccacggccttcgctccctgccctgccggcgcccgtgtccgccgcatctgccgcgtctacggcgccggacgccgcgtcatcggcatcgaccagcaaacagcccctggtgtcggctctccctcgcaagcgcttgtcgccggcggagatggcccaacgccgttccgagggcctctgctacaactgcgacgagaagtacgtggcgggacatcgttgcaagaaatccttcgtcgtcgaggtcatcagcttcccagaggaagctgaggagaacaccgacggcgcatgcgctcacgctagatgagcctagcatctcgctgcatgctctggccggcgtccgcacgcccacattcaacacgatcaaggtgcaggcccgcatcggcgcaacggacctcgtcgccctcctcgactccggctccacacataattttatcagcgacgttgccgcccgccgcgcccgtgttcccctggaaccgcgccacggcctcagcgtcgcagttgcaaacggcgatcgcatcacctcgccaggctgttttccgtcccagcgtgtcaccatcggcgaccacactttcgtcatcgatttctacgcgcttcctctcggcggctacgacgtcgtcttgggtgcccaatggcttggctctctcggaccgacgctctgggacttcgccaagcagtcccttgccttcggctcacccaacaatcgcgtcatctggaccagcatagacgcacctgcaccacctctctaggcggccaccatcgacggcgcgacgggcgaactcatgtccgagctgctcgacagctttcaggacctcttcaccgaaccacaaggcctaccttctgagcgccatctctgccatcgcatccgcctggaacacggcgtctcagccgtcgcggtgcgcccgtaccgctacgcccacatccagaaagatgagttggagcgccagtgcgacacgatgctacagcaaggcgtgatccgcccgagttcgtcggcgttctctccccggccctactgatcaagaaaaggaatggcacgtggaggttctgcatcgactaccgcgccctcaacgacaagaccgtcaaagacaagttctcgattccggtggctgaggagctgttcgacgagctgcgaggcgccaagttcttcaccaagcttgacatgcgttccggctaccaccaagtgcggatgcac

SEQ ID NO: 93738 - DNA, 1009 bp, Oryza sativa
atcagtcttgttcagtcaggctttactcaattccttaactgatactaggctggcattagcatcccctctatttggagcatttaagtcatactattggcttttccataagtatctagagatcagccaaattttataggctgtgattagcagtcggactcatattggtgtgttccttctaagatgttttataggccaacatctctactttaagaaaaatcactcaatcacattaatgtatctccaacttgccatacagaccaggagagaactacatcaaagaaagaagcctttttaaggtctcttctcccagctacctaataggatgtttcgccaccctaatttaccagatctttgatcacataggacaggttaccactattgtgtagctcaagtatgtctcaagcccatctcactcgatgcattgtctgtcacaaacccgtatggctggtccatatagctcacctcctccaactccccattaagaaaagttgtttcaacgtccatctgatgaacgataagaccataagaggctaccagaacaaataatactcaaattgtggtcaagcgagcaactgatgaataagtgccgaaaaaaatcattgccttatttttgggtataacccttggccataagtcctgccttatacttttcaattgtaccatcaggcctaaactattttcttgagaactcatttgtatcctataggtttgcagtcgtatggacactcgacaacttcgcaagtaccattagacgtaattgagtccatctcactgcatagcgcttccttccaatagtcagcatcaggagatgaatataccgagatgaatatacctcttctatggttcttggagtatcatccacaaggtatacaatgtattcatcatcaaaagactttgcagtcctttatctcttactctttcgagtagctatagtgttatcctcctcaagatttttccacaggcgttgttcatcgtgttctatcggcacaaaagactcggggataaaata

SEQ ID NO: 93739 - DNA, 2192 bp, Oryza sativa
aacgctatgattgcaaaacttagatcacaaaataagattgtgctcgctgttgcctcatcaggtgtagcatctctcctactacctagaggtagaacagctcactcccgatttaaaattccaattgacattgatgaaactagcatttgcaatataaaacgaggaactatgttgcctgacctcctcattgaaagtgcacttattatatgggatgaggctccgatgacacgtaggcactgttttgaagcattggatcgcacattacgtaacattctttctgaaacttgtcctacaaattcaatcataccttttggaggaaaacctgttgttttgggtggtgactttagacaaatcttacctgttgttcctaaaggttcacgcctcgctgttattaatgcatcaattacaaatttagacctatggaaacatgtgacgttgttatccatgaatataaacatgagactgttaaatccaaccctaccagaaaacacaataattgaattgcatgaattcagtacatgggttctagctgttggtaacggaacattgcctatgattgcaaaagaaggtgaagctcaaccctcatggattataattcccgatgatcttcttgttgtaacagatggtgacaaaatcgttgctattgtcaacgaagtgtatccagactttcttgcatcatataaaaaccctacatatctatcttctcgtgccattgtttgccctgcgaatgcagtagttgatgaaataaacaattatactattgatttactcccaggagaatcaagaatatatcttagctgtgatacaatctcaaaatgctcagagcaaattccagatttcgacctgttatacccacctgaatttcttaattcaattaatgcaactaactttcctacacacaaacttgttttaaaggaaggtgttgttgttatgcttctgcgaaatttgaaccaatcgataggcctttgtaatggaacaagattattagtcactgctttaggggaaagaattttacaatgtacaatactaactagatcaatcatcggtgaaacagtttatataccaagaatcacattaagcacgtcaaaaatgaaatggccttttacattacaaagaaggcaattcccagttcgagtttgttatgtaatgactatcaacaagagccaaggacaaacacttgagcaagttggcatatacctcaagaaacctgttttcacgcatgggcagctctatgttgctatttcaagagcaacaagccgaacagggctcaaaatactgattgaaaacgatgacggatcatgtggaaaccaaacaagaaatgttgtttataccgagatactttctgctacaatggaagcggtgtgccctcactgccatattgcatatattttatctctatatttacctacattcttggtgtcacattgggcatcatttcctattgcaggcttggccgctccatgcgtagctttccctcctcagctaattgcaatggcttttgtatataaattttggagtaaatatattgtactcacatgtagtatatgctgtatcactgctgcaccaataggctactagatttctatgtgctgttttctcacttgcttagttcattacagtgatgcttcatatttacataaactaaatatcttcaatatttatttgcagccttccaatggcgtacgtgcttatttcagaccttatgtatggggacactgataaacggatcaaagcgagggtatctaggcaatgggactaccatgatctgaatgatgaaacaaagatctaccacactgatcttgtcttgctggatgaaaaggttatagtctaattaacactcatttcttctttattaatacttacatacaaacatggtactaacaaggtgctttatatacacaatatgcacggcaatagcatccatgttcaaatctatccacctgccatgattaagcttaggactcttctacaggaagggaaggttactactttgactccttctctgtcagatatgcaaacagaacatataggccagttaccaaccctttgatgatctcattcactaaatggacaaccttagaagaatgcattgctgcttttgatgattttcctgccataactttttcattgacaccttttcaagacgcccggtctcttgcggacagaaatgctttctatgttggtataacctcttt

SEQ ID NO: 93740 - DNA, 2068 bp, Oryza sativa
ttgaagaacgcaggagcaacctaccaacggatgatttaaaggtgtttttcaactcagatcggccgcaatgttgaagcttatgttgatgatgtagtcgtcaagaccaagaagaaggatgatctgattgcggacatagaagaaacttttgcgaacatccgcgccttcaggatgaaactaaaccctgaaaagtgcatcttcggagtactgtcagggaagctgctcggatttatggtgtctcgtagaggcatacaggccaacccggagaaaatcaacgccatcctcaacatgaaaccgccgagctcccagaaagatgtctaaaagctgactggttgcatggcggcgctcagccggttcgtctcacgactcggcgagtgggggatgccctttttcaagctgctgaagaaaaccgacaatttccagtggggacccgaagcacaaaaagccttagaagacttcaagaaacttctcactactccaccagttttggcctcgccacatccacaggagccgctactgttatatgtgtcggcgacctcccaagttgtgagcacggccctggttgtcgagcgtgaagaggaaggccatattcaaaaagttcaatgaccaatttatttcgttagcgaggttttggccgactctaagacaagatatcctcaggttcaaaagttattatatggtgtcttaattaccgtcaggaaattatctcactactttcaaagtcactcggtcacggtggtcacatcgtttccacacggggatatacttcataaccgcgaagcaaacggatggattgcgaagtgggccttagaattgatgtctttggacatatctttcaacccacgaacttcgatcaagtcacaagctttatctgatttcctcaccgagtggaccggtgccaagaagacatgccggaggaaaagatggaatattggactatgcattttgataggtcgaagaggcttacaggcactggagctggggttgttttaatttccccgaccggagaaagattgagctacgtattgtggatacattttcctgtgtcccataacgtggcggaatacgaggcgctgctccatggattaaggattgcaatctctctaggcattcgccgactaatcttccgtggagactctcagttggttgttaatcaagtcatgaaagagtggtcctgtcttgatgataatatgaccgcttatcgacaagaggtacacaagttggaagataaattcgatggactcgagctcacccatgtcctccgacacaataatgaggcagcagacagactggccaattttggctcaaaacgggaaacagctccttcagatgtgttcgtcgaacatctttacgaaccaaccgtgcccagaaaagaaacaattgaagccatggatactcaaggcgtaagcatgattgaaaccgactggagagaacctctcataagatttttgaccaaacaagaactccctcaagacaaaaatgaagccgagcagatttccaggcgcagcagactctacgtcattcacgagaccgagttgtacaagaaaagcccatcaggaattctgcagcgctgcgtatctttggaagagggaagacaattgctaaaagatattcattcaggcatctgtggtaatcatgctgctgcacgaaccattgtcggcaaagcttatcggcagggtttcttctggcccacagctgtttccgacgccgacaaaattgtgcgaacatgtgagggttgtcagttctttgcccgacaagctcacttaccagctcaggagttgcaaaccatcccgctgtcttggccgttcacggtttggggtcttgatatggtcggtccattcaaaaaggcagtcggtggttatactcatctctttgtagctgtggataagttttccaagtggattgaagccaaaccagtcatcaaaatcactgcggacaaagctagagatttcttcatcaatattgtacatcggtttggggtaccgaatcatattattactgataacggcactcaatttaccggcggagtatttaaagacttttgtgaagactttggcattagaatttatta

SEQ ID NO: 93741 - DNA, 1926 bp, Oryza sativa
attcttggaatattgaacaccttcgtcgattttatgcttgggcagttcgtttgtatctttcctctttgactactaacttcaagtttttccttgaagctttcagtcggggggatgctataataataatggaacatgatttttatcaattcaatttgcttacttgatttatcattgccctgcttgattttttggcttagtcaatgagactgaaagttttttaataacttttgcgagttctaggctcaataaggtttgacaaacacttttaagaaatcagaggctaagttagaattgtctagcacaacataaattcatcagtattgtacaaattgatcttccatcatcatcagaatcactgttactaatcagtgtcagttctttcatcatcggaattatcagacccagtcggccgaaggtcggcatcttggaatctctcaactacgtcagcagcaatcttgtcagcagctttttgcgcatcattgatgaggtcgagggctgtttcttcgctcgtcccgtctgcaaacccatcaatggcgtcggtatcgattttggggtataaagatttggtcatggctaatgccatgcttgctcccatactcccagcctccctgatattcttgaagtaagtatccagagcgactcttagcttgtcaaagatctcggaagcgtcaagtgtactcggaccggtgttattgaagaacatggcttggatgagtggggtagcggcattagcgactttatccctggctccttcaagcctattgatcttgtcaactaagacatcaaactgtgcctgggacttgattttgcgatctgcatcaatagattcatatcagcgaacggctataagaacatggggaatcaattatcattaccttcatcatcttttaaggccgagtccctctgctttgctaattcggccttgtctttctccagagccttgacctgcttctctaggtcggaaatcctagcagcttgcactgtaatatttttcggttaattgatatcacaaggaaggcttcacgaatacgtcagacagatatggtatttacctttggacgaaccactcaattcatagttggattcttgaagctcggagattctattcctcagatcatctcagtttttctcgcgagctccttgtcctcatgtagctggtttttagtagattcgagagttccaagatggggaactaatttctcaagagttgtggttttcgcctcattcctgagatgaatcctctgcaatatgaatttatcggcgtttcagcaagatatggaaggggacaattaaagctatgcacaaatggacttacatttacaatatgagtggcctggctgagtgtcttttttagcaagcatacttcttcatcttctttctgcttgcttatcacgatttcttgaggttgcatatcgtcgtccaccacttaattaggatgggagggcgcgagtcttcagccgcctgtatacggggaatttcttcttcatcaccaatcattggtcctaatgtatccacgtataaaggttagacgattgattagagtcatttggatcaacacggtttcgggcaaggtgtttacccgtgatgatttccgaacggggacgagtcgactcttgcgtcttaacgggagattctggcgtcgggtcactgctggtgtcttgtttatgagggttgtctgcctgagctccaacttctggaatctcttggcttggtctagtgcccgactggttttctatcgggggctcctggttaaccccggctctagcctcggccgactcgtttccggttgggggttgatcaccagatcatacattatcggttgctggctggttatcactcggatgatcctcagcggttggctcggtttcttttaagtttgttcccgtgctggtcgggtcagagtcttttcccggaggatctatatca

SEQ ID NO: 93742 - DNA, 615 bp, Oryza sativa
actttcttttccatatagtttttcccctatatatttctcataccttttcattggcttaaaccttcttagtgcgtatactgtcgagttccagaagcgtgggctgccacatatccactgcttagtttggcttgcagcatccactgctgatgtgtcagcatctgtaatagatggcttcatctgtgctgagatacctgactatgacacagatcgtctaggatatgaattggttagtgagttcatgatgcatggtccttgtggcgacgcaaacaaaaattgcccttgcatgaaaaatggcaaatgttgaaaacattatcctaaggacttccaggatgaaactattattgatgaatctggttttacaatatacagacgacgaaacaatcaacgatgcataattaaaaatggaattgcattggacaacagatcagtcgtgccatacaatcttgaattgcttaaaaaatacgaagcacacattaatgttgagtggtgtaacaagtcaaatctgattaaatatttattcaaatacattacaaaagggcatgatcatgcaaagatatactttgagactacttctaagacaggaaatatgtcactaaatcatgatctagctcctcg

SEQ ID NO: 93743 - DNA, 1176 bp, Oryza sativa
gaaagatcaacttggaaccgaagaccactttcaataaccgtagttacaagggaatcaataccagctaagacttcaagctgcattgttctgtagtcattttgaatagcatcaatcttattgacaacagtttggatctttggcttgtttttgtccagtaccacctgcatgtcaaatgttagagcacaagaaaacatactcaagaatggaagctatcatgcaattagatattacctgagcaataagcttcttgtaaggtaaatggtcatccctcaagttcaagtgtgcaatatgccctactgtctcaaaccctgtaggaacgattattccttctgggagtatttcctctaaaatctacaaaaagtaagattcaatcaaaacagttaagcagcagaaagtgaacagacaacgagcatggtgcataagaatatttatttttttccatgtgaagcaatgttgatcaacatatctaatagaccccacaagtaacaatgtgatgacatgctaatacagtcctcatgctcctggaacatacagtttaatatctaaacatttcggtagatcaaaccattatacagcatttggattgaaaacaaaatctgtggagttgaaatttgtgctgcctaaaagttaattagtaatcccacaattcatatttgtgcctcgataatgcatttgtacgactgagttttcaattgcatttctatgttgtcacatctttgaagcaagaacagagtagaccaatcatctatgagaaaactgggaccagactctgatcttgagacaattcaatctaacctgtacagactgaacttttggtctgtatccggtatttgcaaaggcagtgttacctggacagtacagaagcatcagatactgacacaaatgagaagcttgaaaagaaagaattctacagactttgaagaacttgaaaacaatacagtaaattaaacaagcattattttaaatctacagaaattggataattttattctagaacaaaaggtaagccacaaggggtaaataccattagaactaaaaaaaggggtctcaaaggaactgagcatagcccagttggtaaggaggtaaaatggttcatcttacccacctgggtcagattgacctaggcacctaagtatcagccacttgtgacacatgtcaaacaagacaagtagtctg

SEQ ID NO: 93744 - DNA, 1431 bp, Oryza sativa
tgttcttagcatatatataatttatggcttccagatcaacagacagaagcccagaaggttgaaaacacaaaatgaatggctatttactgcacatagtcaaaccaactttgatgattgatcctttcaatcaatcgccaactcatgatagtagttggctcacacttctgctaactgattctttgtgtttaaatccatgtgtatcctataatattagggattagggatacaactggagactagaacatctcaaggacaacactggcattagataacaaaggaagccgttggtataatgacctaatcaaaaaaatgcactggcacaaaaaacagcaaatacttggacaaaaataataacaagagatgaagagaactgaaagaaaatgatgcttagaccatcaactgtaaacaggtggcaaaatacctcattcattggccagtaattgtagaacaaggtcaattggcattgcacaagctcgtaggatgaagatccatccttgttagtttcatggtccaacacaacctgaaaagttggcttaactaaaactagtaaacagattccactgaaagagaaaatctacaaaagtaagatatacatcatttcttcatgtatcctcttggtatctattttgtaataacttcataaaccttgaagataattttgcaaaaaagaataaaaaataagctaccatttctgggtccaaataaggtaatattgtgtcaaaaccagtgaaatacgtaaattaaaattttaaacaggctgaaagtgtgattttcctcatctggtctcgaaaagaatagttagaaagaaaatactgtctagtctggtgagttcttgtgagtatcatcaaggtagaatgctgaaccaatttggccagcgcacacccaaacctcatttgatcacagttgaatccacagaatcattcaaatagaaacttttcctaacctatgtgatttttatttctacaactgcaactatgaaaggctatttggtgacaagaattcatcaccttgacagcctccgggaggtcatcaaccctcttgttggcatagttctcgtccaggagcagcaaccgggtgggacctcctctccacgtgatcctcccgaacccctcctccccgaccaaccccatccactcgtcgccgtgctcctcttttctctctccgatcacctccaccacatatactttgtctttagtatcccttgccgtagccgcagcctcgccgcctccttcatccttcttccccttccgtttcctcgcggggggccgcgacatcttggcaaggttggggaattgcacgaagcctcgggcgttgaactcgcgggccagcttctctcggcgagccaccgcagttggcagggatgaaggagtggcgaggcttggatggggaacccgggaagaggacgccgccgtcgtcgccgggttggcggac

SEQ ID NO: 93745 - DNA, 543 bp, Oryza sativa
catgcgccattgccccgtctttttccgagccaagactgggttagccagccagtcgggatgaaggacttctttaatgaagcccgctgctaacagcttggttaattcctccttgatcgcatccttcctgtcttgtgcaaaacggcggagtcgttgcttgaagggtttggcgtcttccttaacatgtaaagagtgctcgatcacctctctaggaataccaggcatatcagatggtttccatgcaaagatatctttattattttgaagaaaggtgatgagcgcgctttcctatttacaatctaactcagcgcctattacagcagtcttagtaggatcagagggatctagtggaatcttcttagttttgtcgtcgccttcttcggtctttgacagcttggtcgcaggcacttctccttcgcttgccatggtcgcagccagtcggatgtctttgcgagcgagagtgatctcgcgggtctgggccatctcgcaactttctttgtcacatgtgacggcttccttgatgtcgctccgtagtgatatgacacc

SEQ ID NO: 93746 - DNA, 1332 bp, Oryza sativa
cctgggaatactcatggaaatggcagatgtttcttcttcacactgcctggacagagcatctgctgccttgttttctaggccctttttatactttatcttgtactgcaaacccatgagcttcaggaaagccttgtgttgtaagctggtggttaacttttgttcactcaaatggctcaaactcctatgatcagtaagtatagtgaacactgaatgctgtaagtaagacctccacttttgtattgccaacagaatagctaaacactccttctcgtatgtggatagggcttgagatttgacccccagtgttttgctgatgaaggcaatgggatggccctcctgcattaatacagctccaatgcccttgtcacttgcatctgtttccaccacaaattctttgctaaagtcaggtagtgccagcactggtgagttgatgagagcttgctttagtgcttccatagctatctgctggggttggagccactggtacttgacattcttctttagcaagtcggtaagtggccttgccagttggccatagttctttataaaccttcggtaataaccagtgaggcctaagaatcctctcagttgtttcaagttttttggaggtggccattgttgcacagctaccaccttagagggatcagttgctaccccttcaaccccaattatatgacctaggtactcaaggtgttacttggcaaatgaacatttactaagcttcagatgtagctgatgttgagccaggacttgcaaaacccctttaagatgctgcacatgcttagccaaggttgggctgtagattagaatgtcatccacaaataccaacacatgctttatgatccagggagcaaaaatagtgttcataagtccttgaaaggtagctggggcattactgagcccaaatggcataactctaaattcgtaatgcccttgatgagttttaaatgcagttttatgttcatccttctcctgtagcctaatttggtgataccctgatctgaggtccaatttagtaaaccatttggcccccgccagttcatctaacaactcctccaccactggcattgggtacttatttttgacagtgatctcatttaatcccctataatcaacacaaaatttctaggtgccatctttcttttttaccaccagtacaggggaagcaaaagggctctcacttggcctaaccactccctactgaatcctttgagctatctgtttctctatttcatccttctgagcacgggaatacctgtagggtttcaaattgactggtttcacccctggttgccgaggaatggcatgatcaaatgccctgtgaggaggtaa

SEQ ID NO: 93747 - DNA, 2203 bp, Oryza sativa
ctctcagacaagaaattgctggaactccctgagtccaccaaaatcaagatatgttgcttttgtattagcccttccaatctgatagttttcctaccagtaaccccagtggctgcacactccgaaattaccaattcttcatcactactggtttcaccttcctcctttactggttctccatcaacttgaagttggaacacctccaacaactcctccagaatgtggagttgtactgattttgggcacttatgacaaggtccaaacttttctccacacttgaagcactctccctagctcttcttgctgccttcaaagattcaaacctgtcttcccactttggcttttcttccacttttttagtttcctctagaactggccccaatatacctttcccttgatatccaatcttcccaggtgccgtattagcctccttgaaactccctctggtggaaacatagaagttcttcttcccagcttcagctatcagctcctcctgtattttggcgagagataacgcagcatcaactattctcggcttatgtagcttaatagcaaatttaatctctccctttagccctccaacaaaatttgtcacaaaataagtttcatcgtaccctttgttatacactagtaccctatgcatcaactcctcaaacctcttatggtactcgtctacacgcccagtttttgtaaaactctctaactcctctaagtggtcctgatatttatctctcccgaacttactatgcacagctacacataactccgcccaaccttctacactgtgcaactcctcataggtctgtaaccacagcgttgcattaccaacaaaatgcagcgttgcaaaggaagcccacgtttcaaacggaacttgatacatgtgaaaatacttctcagaattggactttcacaacttaggattctctccatcaaattttggaactctgtttttcgtaatctagtacccccatgatgctgactcccttgagactgactccgccatctctctgaaccttccctcaaatcgaaatgaatcggagagtggcggaagtgaggcttacccttgaccagggtatgctcctgagccgcagaggcatcagttgcaagaccctggtgattctcgaccttgccttgcccttcgggcggtggtgtcgctgctgttggtgatgccttcggctgggattccagcgccgtgatacgggtggagatcccttccaccgtcttgttcagatcccacatccccgcatccacgttcggaatccacgattccaagccccgcaaggtgcccaggatgttgttgtgactgcttgtgagttccgccaccttctcaccaagcgcctccgtctcgccttctgtcgccaccactctctccgtcagagttgggttccccatcttcctctccgtgttgcgcaaggaccgacggctctggtaccaaagatgtcacgaactgtgatgaatcaccggcgtctcgcctagcgatttggtcgattttggaagtttgggtgattttggggaagaacaagggaagtagttagtacagagtagagagagatagagatagttggtttttgctttcttcttcttcgatgatttagcccccaactcgaaggtctgaacttatagttgtgctttagcacttacatggccagcagccgcatggcccaatagcaacgacccaagtatacagcaaaagtctaaaaggggtacacacatgagtaaaataaaagcagcgtgacaattgggtgatatgggagggactcactctccatggatagattcctctggggtttagtatttcccaagcaaccgaacaaaaccttaaacaaacccatgccactggatgctttaagtttgcctaaccgtcaaccattgcgtgaaaattataaggtgagtcagatattcagaatcggagctgaaaattcttttggaggttaattttgttgcaagagtcagatagtactgttcttggtttgaaaagagaggtggttttcatttcgattgagctgaagacgacgtagtaccaacaaaaggagtatatcaatataatcgataagcccaactattaataacaattccagtttagcttttgcgtatagagaaactaattaattaatacaagacataatttaattaactgatctccaatcaaatacttgttaattcattatatatatattctaacaagaaatttttgagagacatgtac

SEQ ID NO: 93748 - DNA, 1022 bp, Oryza sativa
aagatccgctctacttggaggttgaaggcaagtcacgtctccattgaacatattgttgtcccatgattttaaattattgcataaccgctttatttaaattctcgcgttctcattgttttatttagcttttcatattaatccttgttatagccttatcgttgcaatggtttatatcacttcgttcacctaggaaaataaaacccaacaagtgtgtactctatatatggttccaccagtatgaatttagctagatgcttcgctagttaactagacaactttgacttgttttataatcttagactttaggagttatatcatattacttggatattatggagtggttggcttatgttggaatagggcatacaccctttcccctattcaaaaacaccccaaatggtcttaggctaggctcggggtgacgaggtgcatggttttgacttttgagagtagcactttggccatcataaggaccggtctttgggcctttgttgctatgtaataccgtacttctacatgtctaatgggtaaggcttagtttgtagtttagtctagtcatgaacaaaaggacatatagagatggatgaagtcgggtgatggatatctctgaggcaaatgaaggctatatgggcgggtgtccgatagtcgagatgtcatggcacaggacaagcattcgggtggccactctcgaaggatgttctgatgacgtggggcttagccttaacctacctgtcccgggagcctcggccataggcaggcgttgggtcggtgctcttgtgcaaggctaggatgggtgaagaactatgtgacaccctccgctcatttaccatggtggtaagtggcacgtggcaacgcgtgaggaaggcatgtcttgtgggtaaaattgtacacctctaataaaagtataatccattcgaatagccgtgccctcggttgtgggcaagcttaccaatgtacacaagttagtggtttttctcttaaaacttggttgggtttgcttgggatgagctggggcccggtgt

SEQ ID NO: 93749 - DNA, 1148 bp, Oryza sativa
cctgtttcctgtttgcttgaggtcgtactacgtagatcctcgtaccagcgtaccccaataccctctatattcggtctacgggtatcccccgtcgacagtggcgtgccaggtagggggacttggtgctcaaggttctactactatgacatccagtttcaccgacaacagcgttaacaccaatctcaaccaaggagttcctacttcaacaacactggtgtggactcaagtcggcgaaatcgtctttccggtttacaccatagtgctgatctcagctggtccgccaatggccggaaacgagaacgcagtggctagaacccggggtgactccatgtcgaagaatccagccgccgaagcggagatcggaacgtcgacaacatccgagcccgagaaggatcctagtgcggccaagccttgtctttccaacaggaatcacgagccgatgaggattacttccgaggtgacaaggtcctggtgtcctatccacaaaactaggaaacacaccctgcaagcctggtgggtctttctcaacgttcatgctgaaattcgtgcctgcaaagagtgtggaattcaacatacctctccaactcgtgatgtccattgtcctattcacaagacaaaaaatcacgacctctcgagttgcaaggtctttctcagcgccatgaagacaccacctcctaaggtccagcagtcacgcatccccatcagggatgaagacaaggaacaaggagcgacgccgattttagatcgatttgttggggtaatcgacatcgatccccacgaaccatcagtcttgcacttgctcgaagactatggatcatcgacaacgagtacgccgcgtgaggtattggctattgacgatgtcggcacgtcagtgcgcaccaatgcggaagcggagaatcaagtgactgctccgacccagcacatcagagccatcaacgcaatactgagggaaaccccctacgatcccattctgaacgacgatcaagcacgttggatagaacgactacaggaatcagtgaccaacctcagcaacgtgttcgaagaggccgctaccgcagcacacccagaacagcaccaactggcgatgctaatggtgaaaaccctgaacggcgggaatcgcctcatcgagccacccctccacctcgcgg

SEQ ID NO: 93750 - DNA, 904 bp, Oryza sativa
agaaagtggagcgtgaagtctgttcgacgtggcagggggctacgccaaagatgaagtggtccgagcagaagatagaattctcggaagaggaccaccccaagattgctgtcatcccagggcgatatccgatcatggtggaacccactattcgtaatatcaaggtcgcacgagtcctgatcgacggcggcagctgaatcaaccttctcttcaccagtgccttggacgcgatggggatcccacgaagcgagttgacacccactgatcaacccttccatggaattactcctcagtcattgtccaaatcattgggcaaaattacgttgcctgtgactttcggccaagcaaatagcttccgaacggaacagatcacctttgatgtcactgaattcgatacagcatataatgccatcattgggagaactgcactcgcgaagttcatggccgcatctcactacgcgtatcaagtgctcaagatgccaggaccgaagggaacaatcactattcaagggaacgctaagctggcagtacaatgcgacaagcggagcctcgacatggtcgagcacacgcctagcccacccgccacagctgaatcacccaagaaagtgagcaaaacaaacaagacgccgaagcccgacggcgcaatcaagatcgttccactattcagtgctaaccccgacaagaccgtcaagatgggggcatcactaggcgagaaataggaactggcactcatcaccttcctccgggacaatgctgaagtgttgccttggcagccgtctgacatgccgggggtacccaaggaggtgattgagcacaaactcatggtgggacccgatgcaaagccagtaaagcaaaaactgcggagatttgcaccagatggaaaacaagccatacgagaagagctcga

SEQ ID NO: 93751 - DNA, 1179 bp, Oryza sativa
gattctaaataataagttctatgatcgaacccccagaaaagatagtgtcaaggctgaaaaagcgcatcctatttctgtggaacatcaacaggagccatctcaggagcgtgaatctccggcaatttgcaaactcattccttacattggtctctgacaagctgagaacagctgccagctgatgaaagccatgaccagtgaggagaacagctcgaagccaaccacctttggagtctgccactctaatgatctcctcaagtaactgcatgtttagcacagtgaagaagaaaacaaaattaatgaatttggagaaacatgacccctgcaaggacagaacctaaacaactaaacgaatgaaacatagtaatgaacaaacaaaatactctggttatagcacatatctaagaaacataagtccagacgaatcagtcctagcttagccttcgtaagcaataaataaatatcacaaactagagacatactactcaatcaccattggtatagccatctgccagaaaacattaacttagtttgcatgctttatcgaagttctcctttgggcttactcaagcgtccacattcacaaagagtaaaagaggagacgagtagaccaaaatattccatacaagagtactaaactggcattagatttagaacagaatagaaacttggaggcaataattgtatgcaagataaaaggaggtttcagattgccaaattaagaaatgatgaagaatgagggttacccaaaactggaactgaaaaaatgatctgtcagaaatattataagctggatatctagttcttgctgattagatgttaaggttagaaggggcattaatcgaaaatctctagattgacacacatatgctggaggaaccatggaagtatggaacgttgtgtttcaatgtagtcaaacgttgtgtttcaggacatttttctagaagaacataaacacatgatcgagctgataaaaaaggagtaacctggtgatagatggcattgttgccagaagcaaagcacatgcataaattattggcaccaaagtcctaggtttgtttttcctcagccacatcaaggatcctaaagcagcaagggacagcgtcataacctggagaaacataaaagtaagccttctgggataataaggtataagtgaaatacatacaaggaaaatttttt

SEQ ID NO: 93752 - DNA, 768 bp, Oryza sativa
ctatcaacacacattatttcataccgatgcgcttgtgtgccttgagcaacaactctatgtctccgtgcctttttgattttatcttccatgtactttgtcactacgttgccaaacactatgttgttatcggccatggacagagtgaaatttctccttacgctcattctcaatccactgagtgaaatttctgatggacgaccctgacctccttctcattgttggtgggtcatcatgtaatgcaccaagaagtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccatcgactccgaacatcaggccacttagctggaagtcccttctcatcccaaccgttctgcaagtagtcaatagcccgcaacatacccgcatgacgatcatgtataaggcaaacgttgggcctcatacgcaccactacaatgtgcactctctctaggaaccagtaccagctttcagtgttctcactctctacaaatgcaaaagccataggtagaacctggttgttcccatcacacccaattgctgtcaatatctgacctcgatatttacctgtcataaaagttccatctatgcatagaacaggtcgacaatgcacaaaagcatt

SEQ ID NO: 93753 - DNA, 3158 bp, Oryza sativa
tgcgggcgacggcggtggcggcggagcgcgcgttcctgtcgcccgacgcgctcccggcgctggaggaggcgctcgcgacgttcctgtccatgtaccccaagtactcgtcggcggcggacgtggaccgcctccgcgccgacgagtacccgcacctggacaaggtatgcctcgactactgggcttcggcctcttctcctacctccagagctgcaacccttccgactccaccgcgtccttcacgctgtctgagatcaccgccaacctcagcaaccatgcgctctacggcgccgccgagaagggcacctgcgagcacgacgtcaaggcccgcatcatggagtacctcaacatcccggagtcggagtactgcctcgtcttcacggtcagccgcggctccgcgttccggctgctcgccgagtgctaccccttcggcaccaacaaacggctgctcaccatgttcgaccatgagtcccagtccgtgaattggatggcgcagtccgcgcgcgacaagggggccaaggcctacaccgcctggttcaagtggcctaccctcaagatctgctccaccgagctccggaagctgatctcaaccaagaagcggcggcgcaagaaggactccgctacggggctattcgtgttcccggtgcagtcgagggtgaccggagcgaagtactcgtatcaatggatggcattggcgcagcagaatcactggcatgtcctgctggacgccggggcattggggcctaaggacatggactcattggggttgtctttgttccggccagacttcatcatcacatcattttacagggtgtttggggctgacccgacgggctttggctgcttgctgatcaagaagtcggtcatgtcgtgcttgcagagcccaaatggcgggacgggtacagggatggtgcggatcatgccagtcttccctcaatatttgagtgattcggtcgatgggtttgatggtgtcctggatggccttgaggatgatacaatcatcccaatcgaggagggttcagcgtcgaacagtctccatgctacgcacttgcctgcattctcaggcgcttattcatcagctcaggtgagggaggtcatcgaggatgaaatggaccaggacagctctgatagggatggtgccagcacgatatatgaggagaatgagagtgtatctgtaggggaggtgatgaagagcccagtgttcagtgaggatgagtcatcggagaactctttctgggttgatttgggccagagtccacttggttcagaccattcagaacagtcaagcaaggggaaattaggatctcctctgccagcgtcttggttttctggtaggaagaatgtgaagaagacatcgccaaaggttctgtccaaactgagaaggagccctattcctgacaaccatgttgtgtcctttgatgctgctgtgagatcagtatcacaagagctagaacatgggaaggattttactgaggaagattgttcacaaaatggtatcaagaatgttgttcctatcaaggtcagtgagattgaagaagatcaagatggtaaacaaaacaaaaggtttgtaaagttctcttgtgctaatggccctgcagaaggtagctcaacctctgtttttgggggttgcacagcccgtgggaatggctccacttcggagatttgttcagaagccaaagatagtgccatcagaagggaaaatgaaggggacttccgtctactgggaaggagagaagcacataatagcagattcaatggtggtaggtttgttggagtggaagaagcagagcgagtgtcaagtatgggccgcaaggtatcattcagcatggaggatagcaggctgtgtcgcaattcggaaactgcagaaacatctggatatgcaatgggagatgaggatgatgatgaagaatacagtgactatgatgatattcaggatggcaggcgagaacctgaaattatttgcaagcattttgatcatgtgaaccagctaggtctcagtaagactacgttaagactgcggtaccttatcaactggttggtgacctcactactgcaacttcgcttgcctgattccggagatggtgaaggggtgcctcttgtttacatctacggtccaaagatcaaatatgaacggggagcagcggttgcattcaatataaaggactgcagtactggaacttcactgatcaatcctgaaactgtacaaaaattggcagagaaagaaggactctctttgggcattggctttcttagtcatattcgcatcatggacaaccaaaaacaaggggtggttgatgtggggctcagttcttccttgtgtcggcctacgtcaaacggccgacgtgagaagaaaagtagcaagaatgatataattgggattgaagtggttacagcttctcttgggttcctcacaaactttgaggatgtatacaggttgtgggcatttgttgcaaaatttctggattcatcatttcttgagcaacagaggctatcatcaattcccgaggattcagagagatagtatttagagggtttcaattatgcctgttgcaactacatacatacaggaggatggcggcgacggcaatgtaattgtgaggacataagaagagatgtcaaggagcttttgcttggagcttttgtatcccaaaaatgactccacttggcataaaggggcaatcttgtggtgcggctggtatatttcttcgttcttctttttcccttttttctaggatgcagcttttttgcttgtagattttgttcaagatttatatgtgccacctaattattttgagcagcatcttttccatgtactcgtttgtaaagtggctccattggccatgaagttaagcttgcttgtatgattcttgcaacatgaatagcatgatgataggtgatcagcctcttttcagttctcctgtagtcctgttgagctcgacattgttgtcatcagtcccaacttctctgtactttttttttttgctttactgctggcattaagctaccatagtcctgctctgtcatatctgtgtacaataaacttatctgcgggccaacattgctatcttcttaatgtgctgtcattttctggatgctgttttacattggaagctttctgttgttgtgatcacctgtgaaacttatcagaggcttgttactgt

SEQ ID NO: 93754 - DNA, 6784 bp, Oryza sativa
tgctagaatgacttacattatgaagcggatggagtagctaccatgattactcgatctttgagggtagctgagcttgttcattcaaatagaattttaccatcgaatagtgttttctcaatcgctagagtttttttcgagttggacacttagaaatctcaagacctccttttacttagtgttttgatcaaaagaggagggtgttttacccctgctataacactaaccattaaaaaaattgaataaaataatcggtcaaacattgggaagaaaaaccgaaaactgcacttaaaaattaaaatgagactgatggagtatgaaacaatactaggagtaatatggtgttgtatatacggagtaagtacatataaggcactgtttagattctaacttttttcttcaaactttcaacttttccgtatgtcacattgaactttcttacacacataaacttttaactttatatcgttcaaatttctttaaacttccaattttagcgtggaattaaacacagcctaacttgggcgcacacgtacggtaccccgtgcttttctcgtggggccttgccgccttggcgtgctgtaccccagaacttcagttttgtcgctatctgttgcaagttttgcgtgacgtggcgcccaactggcggcagccaaagattcgctatattgagggttgaccgagtcaaacaatcttggattgaaaccgtggaatactaatgattattattagcacattgggcctttggctgacaaaatctggcccaatataaataaggcccatcaccagcaaacagcaactttgaggtggcagaaggcccatcagctgtgcaggggcagcgatgcagcatgccagcatatctacagacaattttcatctaaaaaaacagatacttaggttgatggattttcgacacagcaatttgtctttgaggacttgccatcatataacattgtatacttgatcttttgccatcagtaagttcatgttacaaaggcacttgcggttacagtggtaatattgatggcgactatcaaagcatgagaggttacccaagttcggcaaatcatagatttttcttgcaagttaaactgtcagcgccttgaattatcgaaatgttgctggcagaacatatcgtcaggcaaaaacgaacgtaacatcaccgtgctttgttttctgaccagtacagaactaacaagaattgttctaaaaaaagaaaaaaaaactaacaagaatttgagccggatacttcaggttttttagatgacgtgctataaactagaaacgacgataccaagacagactgaataacatacaacaaaaaaggggaaaagaacttctttgaggttaacttcccctgggaattaccgagaggcattgtgatagcaagagttcacggctactccacctgtacagtaaaactgaaacccaaacctgactctaaatttctgacattaaataacttgcacatttgtaacgcatgtgttgaagcttaaaggtaaccaggcctcagcaatggggggaggaggaaagctgttattccagggaagtaaccccagttcaattacaacagcatcatgagttcatgggaacatcgctggggttccacggcaagaaactaagcaaaatacagaacgattcttttcacaaagggctgctagtactttgacaaggtacacatcagggcaccctgccccttcagttctcttgttggtcgatgacttacatcgcatagacgatctcgccgctgctatcaacatcaatatctgagtcggaatcgaggtcatccatgtcatcgtctaggtcgagtccatcagttaggatgtggtttattcgagagcaagcaggtggtatggtggcctcagttaaaatttgcatgatctgatccatggtttgcattggctgatcaggttcctcatactggctgctcatactatcatcgtccatcaaatctgcaggaaggttcttcaagaaccagccatggctccgtatttctgggattgttatcctctgcatttgccatcatcaaaagtgtcatgaaaataatgtaccaaaattttgaaatgcatttacaacgattaacaattacatcaactataaacacaaataatcttataaaaaactattaacacgaatatggtgaagtagaagaagaattgaaaaaaccattgacagtgtagagctaactataggaatactaggtctacatcaaagccatcctactaacaaccgaacaccttttttctgtcaatacggtgccatgtcgcagacctatattaataagattcatttaagagtagctgtagtatgccaaacaattctggccctagggcatataaatacaaaaggcactgggtagaaccactagtaccacaaatccatttcctaacttatatgatgggaaagaacacatgcataccaacagcacgagcactgaggttttctacgttcgttgggaggtatggtacccttacgtatatgatggaacagaacacatgcacaccaacaacataagcactgaggttttcagtgttaatcacacacacgcgcgcgcacaagagcaggcgcacacacaaacacaacacacacacacacaaacacacacacacacacacatccctctcagtaccctcccaaggatcagataaagattcagcaaaataattaaacacatcacaggatgtgcatctgatgcctaattactacggaggacaacatgcaaggactcaccaaagacggatccccgacaaaaaatcctcgaaattagatgcctacattctggagatatgtccatgttttctggaatcgagtactgaacattcaagatacgctgcacaaaaatgacatgcaaggactcaccaaagacggatccccgacaaaaatcctcgaaattagatgcctacattctggagatatgtccacgttttctggaattgagtactgaacattcaagatacgctgcacaaaaatgacactgacatcagcttttcacagagagccaaggatgaaaaaagtgctccaatgtaaacaaagcaagagaaataagaaaagaaattatataacctgaattgttttacggaagttcttaggctcttctggatcctcgaaaggatatgcaccaactaccataacatatagagtcacaccacaggaccatacatcagcagtctgtttcagtataaataatgtatcagtatgagccaggattcctacactaagcggttatcagtaatggaaatacttctgttttaaagaaaaagaagggacataggtcctacgttaccctgagttctacggaacactcaattcatctcaccagtggcactatattaaaacagaaatcagtcaagacaagatagtttctggatggttcccagccaggttttgtgacgaagggagtagaacggtaaccagtgttttaccaattttagaaacactggtatgcacagcatctccactttcagacgttaaaacagagcataccaacaaacatattcagtggtcatcccaggaaaggaccagtgtatcaaccacaatggaaaaaatcaggtatacttgaatgacaagaaaaaggggaaacccatttcaccactgtagacctcaccacatgataaacttggccaagtgattggcacataatcttgacaaaatggctaattttttctcagcttagtgtgaacttgtagagcattttggtggtacttcactgaaaatacagaatgcaggacaggggaccaaacaactcccaaaatattgattgtttatgtttgtcaaaatacgatgcaagacgaaaagctatagtcctcccaaaggtactgctctcggggattaaatcaacaagcttaataagtcatgtaccttgccatcgtattctttcttcaacagaacttcaggtgcaatataagcaggggttcctacagtggattttggttgtgaatggagaactgaagactgcagaaaaagattgtcttttatcatttgcttattagagtaaaccagataatgtcctaaagtaatgccagtatagtgtattgtaagcaaatgaaatttacacatatcaaaatctggtctgactttgcctatggtgattagtgaattgttctgaaaacagcattatggatttacctatggtgcttagtgaattgttccgaaaacagacttccgtaatgtattatagaaacattagctaagtaccttagaatagccaaagtcacatattttcaagcgtggagcagggcttccatccagcagtgtattctccaacttcaaatcacggtggcatacttgcttgaaaatggagaaagtaggatagttcagcttaccacgatgccttagtacagaataacaatcagatgaaagaaaatcattgtaataagaaataccattgaatggcagtagctgactcccgagataagctgctggaagaagtagcgagcctagaaagtagaatcagaccgatgcaattagtgcgatcaatatgtcactcaagaaagatgcatcaaaaagaggatgcaccagggaaatggtgcgtacctcatcttcactgaaccgtacattcttacaaattctctcgaaaagctcaccaccagaggcatattccatgacaatagcaagatgagttggggttaaaataacctgtagatacatgatagagaacttatttttgctggaaaatattgaatggtgaactagagaatgagcgtcatgaagatcctgacttacctccttaaacctaataatgttaggatgtttcaacgatcggtgatttataatctcacgctggacattatcatctatctgtacaagagaataaacaaaataagtaataaacaaaacaaatgtggaaaaatataatgtagtcacaatacaccaattaaggttgggtcttaataagttgtctagcgattgtttccctaattaaacaaacaatacctcttttgccacgtcatgatcaagaattttgattgagaaccatactcaacattccaatctatgctatgaatatcaaatatgagttaacaagctaacagctaaacaccaaaagacctgacctccttacgggcagaataatttagggagaaattcttggctttatacgggtgttttttttccaggatttctagatgaaatatgcctaatttttatttatctatttagtagggatgggggaagctggattggtttaaagtgataagaacacattatcaatgaattgaagtgacaagagttactataaaggattacaggttcattaattgatcataaacaggcactgtggtttcttttaccatctgcattaatcacactgggatcaaccatatatgtggtacctacaagaacttagaccaacatggatgataaaatattcatggattaagaatggaatggaagaatggattaatgcaacatgcttcccgagctcctaaagggtgcgatttttttgaaaaaaaaactttctatatatgaatttcttaaaatactttttttaaatccatttttcaactttatgatagttaattcatttgtttttacccttgaatagtgatcacaaaatcattcagctattcattcaaaaagaaaacaggcgctgaggtatctcattcgtttagcatcaaaccagtaatcatgaatggcattcataattattataggcagctttgtccggtcaagaggacaattccacaaaagcagtaatgattggtttatttattggttatttactgtgatttaaacacacagaaaatgtcaggtgggcattcaaagaactttttcaggggtatatgctatgaaaagaaacttgttggggatttatcgaagctgcctaactttgcaattttcaacaaccacgccaccatgaacgtcactatatccacacgtttctgctcttaaacaccgtatgtattaaatgcacataaaacaaaagaagtacatatataaaatgtgagttcatgaccaaaccataggtcttcgtttgtgaatttgctttgtttcccatgttggtacaattcaatttgatgttactcaatggtgaattagagcacattgcatttgatttggtgtattgcggtggtggatgactgatgcttggttagccctaaagccctaattacggcatatctaaacaaaatctggagcaatagagctcaagcatactatacatatcaaatgaaaatgatagcaacaactacatgcaataatcacaatggttaaaacactaaaaataagcaattcactcctcgcactggaactactgaagacatgaatccctaatccacggaacaccacatcctacagcgccgcatgactcaccacaaacccagcacggttcggatcgtacagccccccctgggcgcaacgccgatcaaaccaacgaggcccccaaaatcggccacgtttgggcacaccgggtcgaatcgatcactcagccagcgccgaatcgaagctagaaagggaggagaaggcggggagtcagcggccgtaccttctcgccgcgctcgatgtacttgacggcgacgagctccatggtgcggcggtcgcgcatgaggcgggcgacgccgaagttgccggagccgatgtcgcgcacgagctcgtaccggtcgctgtcgtgcatgatcggcatgtccatccccgggcccaccgtcagcgccgcccgatccggcgcccccgccccggcccccgccgctgccatggccggggacggcaagggggttttacctacctgcggcttccaaggcctcggccacccgagggggggggtcccctccggggggcccccccccccccccca

SEQ ID NO: 93755 - DNA, 7237 bp, Oryza sativa
atatatatatatatatatatatatatatatatatatatatatatatatatatatatatatatatatatatatatatatatatatatatatatatatatggtgagtttatttgcaatcacagaggtgccaaattggtctctatcataattgatctattatttactttaaaaaatatctatgatcagttatactatggagtatatttacatcatagtattatagaggtaccaaatttggcacatgaggttttaccaccttcgaaattcggtgaaaatgaaaacccaccaccagatcatatccacggtgtgtcggttatggtaacaaaagccatactttacctaatagataacatatactatttgagctatctatcaatcgttgctactggtgttcggtgcactattcttaggttgtatttaaatcacgttttcttattctcttgtatcttaatattttacgatgtttgagaagattcaagggagggatacattggtttatgtgaaaaacgtattttgcacgatggatggcgcaagctatcctttggcaatttgctcttcataattgttgatgtccgatgcatcatctttagtttgctcgttggttattataccaaagttattttcaatgatacacaagctaccctttggcgctttgtctttccatcactactaatgtgcatctccttttagattgtttttatttatcatgacactctcaatttgagaaagtataatatttggaggtaccaaatttggcacctaaagttttaccacctttgaaatttggtgaaaataaaaacccactgccagattataccctcagtgtgtcgattatggtaccaaaagtcatactttacgtaatagatggcatatgctatttttggctatctgtccttcgttgctactgatgtaggatgcaccattcttgagttgtttttatatcatgttttcttattctctattatcttaatgttttacgactcttgaaaaaagtccagggatacatcggtttttacgtgaaagacatatttttgcacggtggatggcgcaagctatcctttggctatttgctctttgtcactgctgatgttcgatgcaccatctttagtttgtgggttggttctgataccaaagttgtattttcaatgatacacaagctacttatcactttgtccttccatcacaacttttgtgcattatttttatattgttttcatttatcacgatgccctcgatttgagaaaatgtaatctttaaaggtaccaaattttgtacctaaggttttaccaccttcggaatttggttaaaaatgaaaatccaccatcagatcatttcctcggtgtgtcggttaaggtaccaaaagtcatactttacgtaatagatgacacatgttatttgagctatctgtccttcgttgctactgatgtccgatgcaccattcttaggttgtttgtatatcaccttttcttattctattttatcttaatgttttatgactcttaaaaatgctcaatctttttatctgaaagacatattttgcacgatggatggtgcaagctatcctttggctatttgccccgtcattactgaagtccgatgcatcatctttagtttggtgtgttggttcttataccaaagttgtattttcaatgttacacaagctatcctttggcgctttgtccttccattattaccgatgtgcataatttttagattgcttttatttttcacaccaccctcgatttgagacatattttgcatgatatatggaatgagctatcctttgggtaagtgtacttcatcgctattgatgcgtgataagtcatttttagtttgctccgtggttcttatatatatcgaagtctcatcttccatgatatatggtacgagctatgctttggctctttgtacttccgtcactatccagtgcttcatttttagattgtttttatcgccacaccgctctcgtttttttaaaagattataactgaggtacagtcaatgatgaacagagagtgtattccttgtatttgtggcaattccaaaaacaattcatgaaaaaaatatttaatatgtgtaggtttcacacacagagacaaacacacacacatacacacaaagacacagacagacaaacacaaatgcactcacacacacataattatgcttaatactgcactttgggcctttttttccctcgacaaataaactcctcctcatggctcataatatatgtagtccagtagccaactgcctcaaatcctctaaacctaacccaccaaacatcatatctctacaattgtggagtgaatgcacaactaataaatcatgcgtccgttactgggtatattgtttcgtcagtacatatcctctaagttaatctaatgccattatcacagataactatcatcatggacattcttacgtttgcagataagttactggaattctcctactgaaccatgaagaaggaacataatttagctgtccctaagtcacaaaagtttccggatcaaggagctggaacaagaaacatgaaacacgggatgccatcttccaaaaacatggaacgataggggtatacctcttctaaaacaatggaatgatagatgaaacacgtccctagtttgattctatcatgctccttttttttggatacacagctgaaaacgcgatggtagatggctcaatgcaacgatgggaccagcatgacggcttcagcgctacgctgccacacatagtgatggagggagaaaagaagttgcgacacatggtgcccctctatttctccatccttcccatcctggcgatggcgacgatgcggtgcgatctcgtatattcacctcggcgcgcggcgactagcaacgaaggagcggttaatattgtttggaaattttagattgccctttccatcttttgctccatcatagcttgttcctccctctaactatcctgcttgttcctccatcgttccctcatactagaacgacgacccatccttattcaggacaaactttcacatagttcccattcctcgattcggaacgaagttccctattcctgtgacttggaactgcccatgagcttacgcaattggcgaaatgtttaagacactttgttgtttgccaagagaaattcccattttgtgtagatcaaataattgctcaagaatgtactccttattctgagtgataaatataattccctcttcatctaaaaagaattgttggtttatttacagccccatgattcttaaaaatatctacttgtaacaagtacttgtattgattttttttaatgaacaggcacctagagtatgccaatttcattgaatatattaggagtaaaagttgttgtataagtatgaaaagaactgtacaagaaaaaataaagctaaatgatgagctctaagagtcgttttgctcttgctagggctcaagttttggcctcctcgattttcgtcactaggactatcgttgaaagttcctttatgttagaacactccggaaacactagttagcgcgcgcgcctcctgtacgattttattttttgtttttttacattttttcctttttctctctcttttttctgatttttttaatctttagcatgttttgagtttgaaaatttttaaattttgagttgaaaattttcaaatctgaacttgaaagttttcaaatctcgacttgaaagttttcaaatctcgacttaaaatttttcgaatctagatttgaaagttttcgaatctcgagttgaaagttttcaaatctcaaattggaagttttcaaaattttcaaatctgaagtttttaaattttgaaatgaaaattttcaaatctgaacttctttttaaatctcgatttgaaagtttacaaatctagatttgaaagttttcaaatctcgatttgaaagtttacaaatctagatttgaaagttttcaaatctcaaattgaaagttttcaaaattttcaaatctggatttgaaagttttcgaatctcgattctcgagttgaaagttttcgaatctgagttgaaagttttcaaatctcaagttgaaagttttcaaatctgagttgaaagttttaaaaatttgactttaaaatttaaaacttaaatcgaagttttcaaatctaacttaaaaaattttcaatctgttagtaaaaaaaatatcccaaaaaaatctccagaatttttcctaattactatcattagtgctaagtatagtaactaatatagataattaacactaaagagaaggagggagtgctcgccagctactttcctggcacgcgcgccttagcaacccccagaacactccggtttctttccttccaaattttccatgccgttagtaggatgaggatgcgtctaatcgcttgctagtggctaatgccatccatcattcatggaccgtcgtagttgtacactattttatcgatttgatttgctcgagcagataaaggtaagattttgatcttgcttggcatgattgtgggacggagtgtgctgattcattctgatcctctccaatgattctttcaagaaaggagtcaggggggaggcaaagatgtatcccgtggatgtgggctgaatcctctcagcccaattgtacgtccagcccagacatcattatggatcagcccatcctacataattggttttgccaccataatgctacattgctactcaccaacagaccatagaaaaatccaaataggaaactatcactaacttcatttcccaaactcgccaactcatccaatccccaatcaagacctttagaaatgagccatttctccgtctcataaaaacaaaaaaagaagcaaagagaaatttcagtatctcacagaaaaagaaaggattcatttcagtgaaacgtggcaaaatggaacatgttaagcagagacaccaaaccgtagtcggattctttatgcgtttactccgtacatttcagcaacagcttatattgtgcagggagaaaatcacgcagggatgtgagctcaaacacagctacatcctccatgattcttcagagcagaatcagagtcagcgacaccagaacaccaaaaaaacaacgagaaaataagtcattcttgctcccgatcgatcgatcattagctgtctttgcagaacagcaaagaaagaaaaagaacccagaatattcagccatcggttcaccgaacatggaaagggcacacgcgtccatcccaggatcgagaagccgtttaattagggcaaatggcaatcaaaaccggcgtttaaataagcttatcgcgagcctgaaagcagctcaccgcgcactcatcttacagcgaaaaggacgcagaagatgctgcaagcaacagcaagaatattcgcaggctgtgagcacagtgagccaggcaggatcaggaaaaaaaaatcagataaacaggaggaaatttcagtacatgtgccaagttggacggacaaaaataaaagcagcagagaaaaactaattctgctgcatataattacgtggagataatctcacgccaagcagcaggccaactcatatactccacacatgctcaaagccaaaggggggcaacttgccaattagcccttcggattagtattaaactaatcaacggataagcacggatggtcagaggtgtaagagtaattaatagttgttgactcgcaaggatagcaatgctagctagggcatgcatatgagaacgacgtgcaacttatcgtggaatctatgcagggtatccagctcatggatggtctagaatttgcagtgggggttttattttccttgcaggtttgatcaagcttgtcagggtggtgtacgcaattctgcataagattttgtataaaaaaaatattgagattgcaattcaaaggagaaaatggaggtattaaaaacgtagctttctgtcagaaccgctgatcacatagaccagcagtgatgttcttggttcttgattcaccctgttcaaggaactttggattgttcacagttgtatttggtgttactggtgaattttcagcaacagaggactaaacatcagaaagctagcaagttacaacttttcagatagccagattacagtttggcaatccgttgtgaaatatctgcttaatggcaaccacatgcattgcaatgacctaactgcaacagcttgagcttcacctgaacgccgagaggaaaaaagcaacatttttattcacccaagcatagcaagttcatcacactgtgatcactgatcatcagttcatcacaagaaaaaaacgacaatatgcgaatcttgtatatatttatgtataatatgtatgtaaatctcagggcgaaaatttggggtctgcccgacactttgcaagcctcatgggtggtagcagctcttcatctacacatccacaacaacccagctcatgatcagttcatcacttgagctctcaacagctcaatcttccctgtatacatggccaacactaccatcctcctcagagtttctgaatccattattggcaattttgcatcgatgcgcaagccgaaaatccatcaatctacctctctgtctagcaagattccacgagcacgatctttcgatcattttcggacatagccttccgacttgtcatcatcctcgcagcagctgtcgccggcggtggccgccgagacggccacccctgagccggagagctgaaggggaccttgaggtgatccggattgagagcagcttacttcctgagaagcccagagatcaccaacaagtacaatcgaatggctcgctgaagctgtgcctggtgatttccggttgtgcagccgatacttctgaaaatatttgcatgacatgatcaaaatcagtatcaacaagcaagatatggaataatgaaatgaatgaatcaggaagcgagaactaatttgtttcaagaaatggttgctgaaataaaatgaggggtgtttgctcacctggagatggcttttcacttcgtcgttggtgagcccatcaaccttcatcacctccctgatttgctttggagtagcaactgcaatcatggtggaacaacaagatatgaggatttccggtgatctttgcaaattatggaaggtgaaaatgatggtcgaccatgtaatataccttgggggccaccgagctgctgcaaggcggcgacgaactgccggtgaagctccggcgaccagcaccgcctcgacttcctcgcctgctgctgctgctgctgcgcctgagcctgcaagctaagcgccgccgg

SEQ ID NO: 93756 - DNA, 2785 bp, Oryza sativa
actccctacgagctctagaattgctgcacgccggcctttgaccacctttgcacattcggctgcgtcgcccacgtgaaggtcaacaccctcgcacctcaagaaactggaggaccgcagcaagccgatgatcttcgtcggctatgaaccaggctcaaaggcgtacagggcctacgatcccgtggcgcggcgggtccatgtctcgcgtgacgtcatgttcgacgaggtagcccagtggaactggaatggcgaactgggcgcccctgacgacaccgactttgtcatcgagtacacctccgtgttccagcctggcacaatgccagtgacgcacgcggacgcgggggagctcgcctcgccgatcacgggggggtcctcacaagctgccccgagccctgtgacaccatgtcgaacacctgtagtgcgtgctgctgcatcggaggttgagttcgtttcgcccccacctgggggagaagacgacctcaacgcggaccacgacgatgctccacttcgacacaggcgccttgatgatttgctggggccggctacaccgccgggtctcgcagtgcgggatgtccaggaggaactgatgatggtcagtagcgaggaacccacctcgtttgctcaagcagcaaaggaggaggcatggcggcgtgctatgctcgacgagatcgcctcgatcgaagagaaccgcacctggcggcttgtcgacttgccggctggacaccggcctattgggctcaagtgggttttcaagctcaagaaggatgcacagggagtcgtcgtcaagcacaaagcgcgcctggtggctaaaaggtatgtgcaatgtgccagagtggacttcgatgaggttttcactcctgtggctcagctcgactctgttcgcttgcttcttgcccttgccgcacaggagggatggatggcgcaccacatggatgtaaaatcggcttttctaaatggggagctcacagaggaagtgtatgttgtccagccgccgggatttgaagtggaaggagcagaggacaaggtgtataggcttgacaaagcgatgtatgggctgcgccaagcccctcgagcctggaacactaagcttgatgccactttgaagaaaatcggcttcgagcaaagcccgctggagcatggtttatatgcacgtggtactggccgcgggaggctgctggtgggtgtgtatgtggacgatttggtgatcgttggcggagatgaagacacgatcactgtgttcaagaggcagatgatggaggaattcaagatgagcgatcttggctctttaagtttttatttagggatccaagtgcatcaagaaggaggtgtcatcactctgaaccaggcagcctatgcggcgcagatcgtggaaaaggcaaggcttgaaggttgcaatccctgttctacgcccatggaaccccggcttaaactcagcaaggagagcatggcgtcgctggtcgacgccaccgagtacaaaagcctggtgggtagtctccgttacttggtgaattctagaccagatttggcgtttgctgtgggctatgtgagccgtttcatggagaagccgacggtcgagcacatggtggcagtgaagcgcattgtcaggtatgtggcaggaacaattcagtttggatgccgctacatgagaggaggagaagggaagctgcacggctacagcgacagtgacatggccagagatcttgatacccgtaagagcactacaggggtcttgttcttccttggcaacaatcctgttaggtggcaatctcagaagtagaaagttgtggcgctttcctcctgtgaagctgagtacatcgcggctgcatcggctgcgtgccagggcatatggcttgcccggctccttggcgatctcagaggtgctgcagctgaggttgtcgagttgagggtggacaatcagtccgcactcgccctgatgaagaaccccatttttcacgatagaagcaagcacatccaaaccaaatatcattttatccgtgaagctgtggagaacggggaaattaagccggcattcatcaacaccggagagcaactcgctgatttcttgactaaggcgctaccacgagaaaaattccaggaaatgcgaggaaaggttggtgttcttccaataaaacaggtacaacaatcttagagggagatttgttagaataaagtttgtgtaccttagttagcaggtttatttccttgttttttgagtcagtcttgcatgagcttgctgtcttttgtggaagtcatgcgttgtgagggatccgagagtatctcgcgttcccacgtcatacgccatgggcgtgacgcacgtctcgcagctgtggggatggacgcagcaaattgccggcgtgagaagcggtgttggttgttgttttttcagttgcaatttccgtttctatatatggagcaagatcagaaaagcagcagttggttacgctgcacaaaaatcctcttattcctctgttttgcgtctttgccggatcgctacagtgtgtgagtgtgaggtgttcgtccgggatcctcacgatccttgggttccctgacagtattaggatgctactgtgaattggcgtgcattataggctgtttcttgagtagatcacgtcttgtcactgtgaattatagcaagtaaaaaccaaggtcaactggacagcatcaattggcgtgcatggttgctgtcgtgcaatgtatagcagcagcatgtgtcatagtccgggcctggtataataatgttgcatgtcggcagcgatgctcttgaaattgatgctcttgcagaactctt

SEQ ID NO: 93757 - DNA, 2156 bp, Oryza sativa
  unsure (1)..(2156): unsure at all n locations
gacggtggcagcgcagcgagacgccgagccggcgaggacgaacgatgacgacgacgacgaacaccggtggagttcggtcgaaggggaggcgagtccgagggcgaccttgccgctgcgatgccggaggtggtggtggtgcacacgacggcgcacgggtggaggaagggccgaccggggaaattccggcgaggtggatggagaggccgacacagcacggcggtgttccggcgaaattaggggcgacgccgtggcctggccagggaagaggacggcgttccggtgccgggagaggtggtggcgacgtcggccgacgcgcaggagactcggcaaaggcggccggaggcggaacagtggcgacaacaccactgttgccagcgggggcgcacctccgggggtctccacgtgaaacggtgggcaggccgggggagaggaggctgctgcgacgccggggaaggcgacggcacggccagccggcgtgctgacgcgacggcaggggcggctggaggtcggccggcgccggagagagagaaggagaaggcggggagaggtggtgcgggcacgggaagacgtgggaggaggctaaaatgggagaacagaggatggggattccattttataggagaggagagggagccggccacgggagaggcggggaacggcggcggaatttgtgccggcagccatggaaggtggccggggttggcgcgtccgttcccggcggttgggggcacgaatcaagggggaaattgggagaaaatnnagaggaatcaatggggattaaaaccccccaattaatttcagaaaccatggtttgaatcgcgtggattttgaggagaattggcgctagggtttgcacgggagagaaaaaggaagaaggccgggcgggaggaggacgacgacccgggggtgggacccacgcggggcgcggtcagcgcgcgtgacgggcgcgtgcgcatgcgggaggagggcggctcgggcagggggcgcggcttgggccgggcggccggcccaggaggagaggagggagaggcggcccgggagagagagggaggaggagggagctgggccgaggggggaagggaagggcggcccaagagagagagggggaaggaaaaagagagggagaagatggagactttggccgcaggccaagggagagagagggaggactttgggccagacttggcccaaaggaggaaggaggatttatttttaggtttttctttttaataaactttgataattgttgttgttgcttaataaatatttccggtgctctgaaaattcaagtaaaatttgagggctcattttagaccaaggagaatttaacaaaaattcttcgggccacattcaaatttttcttgtacgtattttagtgtttgccaatttcttttcgaattttaattaattctattattccttttagaaaatgatttttattttgggatgaatttatcaggacgtgacacctaagtacttcaggtgtggttgagcaaaggagcacttactaattttaacaaagagttggtactgctggagccttgccaaaactgccttgagatgggacacatgttctgtcagattttgactatagatgagtatgtcattaacaaaaacaagaacaaacttcctgatcatgtcagcaaagattgtatccatcagcccttgaaaagtttgctggtgcatttgtaagaccaaatggcatcactttgaattcataaagaccctgatgtgtcgtaaaggttgttttgcattcatcctgctccagtagtcgaatttggtggtatccagatcttaaatccagcttagtaaaccattgcgatcctgccaattcatctagcaattcatccaccactggcatgggatacttgttcttggctgtaatgttgttgagggctctataatccacacaaaatctctaggtcccatcttttttcttcacaagcagaactggagaggcaaaggggcttacactgtgttgaattatgccttgttgcagcattgtcttgatttgtctttcaatctcatccttctgtgttggggcatacctataaggcttgatgttaactggttttgcatcaggtgtcaatggaatactgtggtcaaaatccctgtgggaggcaattctatgggttcctgaaaaacctgctgaaact

SEQ ID NO: 93758 - DNA, 523 bp, Oryza sativa
aatgggtcctatgccaaccaatatacctccgcctccaccaggccaaaatccctacatgcctggcccgccgcgtccatactccatgcctccaccgccacacatgccaaccatggcaaccatggtcaaccccattgggattcctcagcctccaccacctttgcctccacaaccacctgctgaggagcagccacctcaacctgatgaaccagaacctaaaaggctgagaacagatgacgcttctcttataccagcagaacagttccttgctcagcacccggtaatacttcttgatatatttcttctccactttcctgttttctactaaacattcttgttagtcttgttctttttgtatgcgtatattgaattttaagaatttccatgtgctaatttcttctcttccctgcagggccctgctcacatctcagtgtctgtacccaaccttgatgaaggaaacctgcgaggccaagtgttggagatcggtgtccaatcactctcagacacagttggcagtctaaaggag

SEQ ID NO: 93759 - DNA, 764 bp, Oryza sativa
  unsure (1)..(764): unsure at all n locations
cattcaaatagtgaacatcttgtaagatgacaagtaggcagtgaactttcaagacaagcacatttcacaacagcaaaacagcagaagctaaaacatatattttaagtaacagatggccataaagagatatgtatgtctgacattcaaatagtgcaaataacagtgtttcaccacgtttaaacataacatgagaatacagaaattaataggcagcaaccaacaaaaatattctcctttatagctgcaagttcagttgcaagcaataacctgccagtgcactgagatacaagaaagctcatttctttctcccaccacgctccctcagtgttaaattgatcaccactccagggccaatgttgtagtaagcaagagtgagattgtctttgaggaaactagtccgcacgctcaacttctgcttattagcagnnnnnnnnnnnnnnnnnnnnnnnnnctcctttagactgccaactgtgtctgagagtgattggacaccgatctccaacacttggcctcgcaggtttccttcatcaaggttgggtacagacactgagatgtgagcagggccctgcagggaagagaagaaattagcacatggaaattcttaaaattcaatatacgcatacaaaaagaacaagactaacaagaatgtttagtagaaaacaggaaagtggagaagaaatatatcaagaagtattaccgggtgctgagcaaggaactgttctgctggtataagagaagcgtcatctgttctcagccttttaggt

SEQ ID NO: 93760 - DNA, 825 bp, Oryza sativa
agcaaaactgtggttgtcccagttaatgccaacaatctggaaccttccaattatgagacaccaaaagatgttcatgttgtagagaaaacggacattacacccatgaatgctactgttacctctctgactagtaatatcaaagtaagtagcttcatattttaaaccaatcaaattttattagtaactgcttagtaactgcactatgtttaccatttctgcatacccactctgattattttgcttaaagttttacttctatttttaaaaaagtatcatctaagtaagtatattggatatttgcatgtgataactatcgctgatttcccatttgactggaatagatgagaagcaaggctgacagatcgtcgagtgaaaacacattattaaatgatttgtcactactttcctctattggattgaactgggttggttagtggtttgcaggattagtttattgtgcttttatctcttcatggccagctgaaaaggccgatgcagattggttcacatcaataatgcttggaatgagaaacctatagctacttcacttgcatgttccattgattcagactacttactgtattagcttgcttctatattttgttaatacacaggaaatattttacattctttagctgttacttatgcctaattactgagtaattgtttgttccatttggtcacattccttgtatttagctccaatgctttaaaattatttaggaatcttcaggtagattttatctgactgttgagaaaaccactcaggaactagctcatggagaagtccaaaaggattcacagcgatctgcaattgcatcatct

SEQ ID NO: 93761 - DNA, 4434 bp, Oryza sativa
ccatcgcctcttcagcgcccatccgccgccgtcaccgaagatctggcccttgctcttgccctcggccgcccgccctaccaccctcccgccgctggcccccgtcccacactgccgaacgtcgccgccgccgctcattctcgctgtccctgcgcgccaccggccgaaggggaagaagggagagaaagagagagaagggagagagggaggaggaagaaggactgacatatgggctccatatgttagtgggcccacaattttttttgtgtgaatgactaatgggtctcacgtatattttttaattctactgccacgtaggtgccacgtcaacgtcacgtggaacgaagattcggtcaatattgccacgtaggcaccacgtggcgccacgtcagcaaaaccgcctctcaaaaccatccagggagtcaaatcgcatcggttttaggagtttaggggtcgggatatgtgatggattagatttcggtcacacttgagggtcctaaagtgaacttattccttacgctgctgcagagacgatcactactacttcccgtcacacgcacggggagcagaaaatgagcgaaatacactaatcctgtaagatgcattttaattctagtttaatgtataacagcgtgttcaggcctccatttatcacgtatgatcgccgccacgctgctctctgtcgtcgccggatggggcaccgggaactgcctcaagaaatgcaagcagcatatagccgcacgccccaccactaagtcgtgacggtcggtggcagcagtaccagcaggatgaaaacattacgaaaatttctcgaccataccgataccttccacaaaactaatataataataatatttttatcgatggttactgtttttaaatttagttttaagttctgtcatcgtggcattgaagttgatactaaatagataaattcataaatatggaaatttcccgatcatttcggttcgttttcgagaaaataataaaataatgatattgtttctgaccatttccgtccgttttcatccccggcatgcacagtgagtggcctctagagttcaacatcggtgaggttgttctgaaaaaatatatagtggaaactatatatatggtgtcgctaaggagtctaaatgcaaaatgtgtgctagcgtatagcgttacgccggtggtcatacacgagcaaataagattttagacatgctgagatacattaaattaacaatatgaatctaaatatgtattttgccagattaggtacttaagtaaaccaccgtataaatttaagggctggtcgtgtatttcacaggaaaaaaaacaaccattccttttttcgttgttggcctggttgcccaaacttttttcctaagtagtacaaaatttttaccaattttttggccagccaatccgagcacccctacccagtcaaaagctccaccattgcatgatgccattatctcccctggagtacaaaatcaaatgcaccgaaggcactttaaaatccacaatcactaatggctaacctcaaaacaggacagaaaagtaaaagtagtagtagcttgattaggacggatggccaaaagaaggaaaaggagggatgtttagcaaaagcagagagttcagtgaacctgttgtctttctgagacgcttcatggcgtccccacaagtcccaatcattgtagtagtactgaacggcccctgttctggcaaatggatcttcccagcgtcggttatcctcgatgaaagcaggcgccacacacagcaaagagataaggaggaaaaaccggtaaagtatatagctctagttcgtgtttagtgcagtacaattttccatcctgcggtcagcagggtttacaaaaccatattgctactacgcgcacggtaatcacgtacgataacctacgacatacctcgcggtaatcaccaaaccgtaggcgatggtaaccttacccccaaacaatttggtaaacacttacggtcattctattactataggaacaatttgatctcatggtctctctaggatgatcgcgatcgccaatcaccggcgatcaatttttcagtccaaaatactttatggaattatagtagcagaaacttacataatagccagaatgttgttgccattcggaacgaggctactagatccaattgttacagcaaaattagtctacgtcacgtgatcgatctttttctcaaatctcattgacatgtagtactcggtacaagctgcgcaatgactagctgcgttcgaagctaaaggttaggaccatctcttcgctttgtaaaatagaacgagccattagggaataattaattaagcagatacctttagcttatttaaaaagttaatatattttttaagacaactattctatagaagttttttttcccataatacgtcatttagcaatttgagaaagatgcgaaaaaacaaaaaaagttgtagttgaaaaaaatatggttaagaacgcaaaataatttgtcaatcaactcccacgaacaaggaacgagtccaaagcaactcacgcgcttggatcactcgcgaaacgacctatcaacatctcaaaactctcaaaccaatcgagagaacgaacgcaaaatttgcccataaataaatttatttgctccagctaagaccggcggctgatcgatcgagctcatcaccacgggaaaagccgatcgcggaagagaagagagcccttccagcctgggccacgtggcgtccacgcaccatcaccagcacaaggaaggaaggagaaagaaaaaaaaaaagaagaagaaaatctcctcgtgctgctgccgacctgtgccggcgatgagagcagtgggccccagtgaagcacggcggcggtggggatcggcgaaagatcctccgcctccgcctttgagaggggaggaaaggtcgccggggattttctgtgaaggcgtatcctgacgaccaccttaagctgtcgacctgcttatgtttaatccaaaaatttttgggggatgtttcatccaaatcgactttaaatccctgattgaattattttttcacaggattattatatggattatctactaaattatgtattatatattttaaaataaatttaacaaatagtttagaaaaaaattgtctaagctgtatggtagaagaaaatattctgagagggcatattttaaaacgaatttcttgaagcttgatttttttgtattaattttaatggatagtagcatttgttttcgtgttaatcatgaaatgggagtcatgcaactaaagcacaactagttccaaaatcaaattctaaatttcaaaatcagcctacagtgaaaaaaaaactgaattgatttccatttcttgtttttattcaatagatggtgaattgcacgcatgtatataatcatttttctgtttgtaatgtgttttggaaaaggaaaagatgatgaattgtgagctgaaatttggtctgaaagaggaaaccaagtgtgtgaacaaatgtcgacacgtggtggtcaatttgcagccgtattaggtggtatcaatacgatttttaatcaattcgaatacaggacggttacctatcttaaaaaaatttaaaaaaagaacagggaaataattagtgtacgcaacttggacctaccaataatgccaggcgaactaatccaatccggttcaactactaatggatggctccaagtagcgtcaatgattgagctgtcagggcaattcacaaccaatggaggaaaaaaaaaagaggagataataaaaagaaagatgccactagctcaagctgataataatgctctccacagataataataaattttatacaaaagggaattaaaattaaatagagatttgtgggaggacaacacaacaaccccatcttcttccttcctccctctttccatccaacttccaacctcaaccaccactacaacaacaacatcatcatcatcatattgttcttcctttgcttgatgcatcttgagtcacccatctcatctccttttctttttctttcttttttttcccctttcacctttaagaagctctcaggaaaagaaaaaataataccctcaactttaatttttaaaaggaaagaagaagaaaaaagaaagaaaaaaggaggaaaattcaggttggtttccccttgtattatccttttagaacctaacgatcttggcggcgcggacgacggggttctccctggcgatggcgtccctcgccgccgacttgtagtcgaagctgcagtcgtggcggtcggagtaccggtgcgcgccgcagtagagctcgccgcagcggcaccggaacccggtcaggcccacccgcctccggcagctgtggcatcggttgaccgacgacgacctcgacgccttcgacgacgactccaccggccccgccgtcggccgctcaaccaccagcgccaccgccgccgccgccgacgactg

SEQ ID NO: 93762 - DNA, 1869 bp, Oryza sativa
  unsure (1)..(1869): unsure at all n locations
agccacagcacagataacggaggaaaaccgagttcacgacctggtacacggcaccaccaaactttgcacgcgccccccgggcaccagccaccacaccaggggcacaactgccaatccaccacaccaccaccagtcgaagacgccgccatgtcacgcacgcatgcaacccccctcgcgattggcgcccccaacctaagnccgcgccgatcgggccgcccaaagctgaccgacgccacgcccgtgaaaccaacccaagtgaaaaaatacccgcaggaaacgcagcggaaacccatcgcgcgattcgccgaggagccgcgtgcgtgagcgctgcagttttagcgtcgtccgtccctgcctgacctccccggttgtcgctgtccggcagctgagctgtgccgcgcctgtgcggattaggattagcacggccgcgtgcagctgctgcttctgctccctttccccggcaacccgtcgctgtcgccacggtaaaaatatggcgaccacgaattcacgtggtgaattaacatccgctgcaggatactagtatgatgctgcgtcaaggtcaatggatatcaccctttttttttctttttctcacacatagttttcttttatcataaaataaatcaaccacgactcgtaatgtattttggaacgaagagaatacatagttatacatactataggggtatcatcatacatggaggagaattatcgtgttcctggtaggtaccaatcgaaatcctctgcagtatgctcactgacatatagggcccatatatcaatgagcagtggaccctcacactcgttaggtactactactaatgctggggcgagctgcggtatgtgaaaagcgagggaaatgtgcgcgtatgtgcagggctacctaactggcttgggtaccagccagggtggtgcacggatggatgaatacggcagccgacctatcgtgcccaaacatccgtgttacacccgatcgatcgcgacgacggctctcatcaagccgcgtcgacggggagagctctcctagttggaaaaaacgataaagttgctgaaaaataatttaaaatgagactgatgtcaaatctatagataattgtataaaagttttagtgctatcacgttatttttctcgataaatggaacaatggatgataccatactcatgtttctgaagcttgtaagatagtagtattacctttctcttaaaatatattaattcttacctatgtatatggatatacttttatgtaaatgcataggtaactaaatgtggttatattttgggatgcgatttttttaaaaaggaaggtagtattatatattactccctctgtccctgaatatttgacgctattaacttttttaaacatatttgaccgttcgtcttattcaaaaacttttgtgaaatatgtaaaactatatgtatacataaaagtatatttaacaatgaatcaaatgataattacttaattttttttaataagaaaaatgctcaaatatgtttaaaaacgtcaatggcgtcaaatatttagggcccctttgatttgtaggaaaaatgtaggaattttggaggattttaatcctatagaaaaaaaatcctatgaaggcctttgaaacaaaggattgaatcctatccaatcctttaaaattcctatgaaatgggtaatcctatgcacattttgaagaaaagttagcaagaggtctaacctcttggaacatttcctctgagtctatctctctcatctgatttctgtgtttttcctgtggtccaatcaaacggccattcctgtgttttgcaatcctctgttttacaattgtattcatgtcagaatcctgtatttttcctattcctatgttttttttcattca

SEQ ID NO: 93763 - DNA, 916 bp, Oryza sativa
cctacccgcagccgtcgtcgccgttcaagtggcgggacatgctccaccacagccccgtgccgctgttccacagcccggcctcctcgccggcgtcacggagcccctcggcgtcctggctcgccggccgcgagcgcgagcggctcttctccagcttcgtgcgcaacgcgctcggctcctgcgtcgattacgcgccggtcgccgcgctgccgctcggcgtctcggctgctgtcggtgtcggtgccggcgagctcgcgttcgagctcgacgagcacctctccgaggcggagccgtcgtgcgagccgtacgctcgcgacctcctcgccggcgcccaggctcgccaccgcatcttccacgacgagctcgtcgtcaaggccttcttcgaggctgagagggcgcaccgaggccaggtggaatcccaattcccaagaacttggacgaaactccaatgttaacttcttgctttttcttttttgcaaggtgtaattatctatgtccttaaatctagtgccctttgtgcttgccctgtgtgatcagacgcgggcgagtggtgatccgtacttgcagcattgtgtggagaccgccgtgcttctagccaagataggcgcaaacgcgaccgtcgtctctgccggactcctgcatgacaccattgatgatagctttcatggattatgatcagattttccggatgtttggtgccggcgtggctgatctagttgaaggggtatgagttttgtttacttgatttttagatggatcataaattcataatagtttaggagctctcccagtttagtagatgaagggctggttccacggctatgattgaattatctatgttatcattgttgattattcaaagtcaacaggccatgtgctcatcttgcttaagctttcaaccatatggataacttcacta

SEQ ID NO: 93764 - DNA, 1665 bp, Oryza sativa
cacattcggtggctttggcatgacaaaaaagttgtcaacaaatttcaggaagcgagagagagagagagagagagagagagagagagagagagagagagagtttataggttctcgggtgtgcaagccaccaaacaagtgaacaaccatcctcgaacatcgtggggcgtgccgccacgtgaggcacttagcaggccatggcggcggagcggatgaatgacataaaatagtttatagtattccagtaacatttggtaaaggaatcatgtctgcaacatagaaatttaattggcaaaggaaatactgtattaaggtaaacatttcttccacgagaatgaagggagaatcatccatgtaaagagtacttgcaacaagattaaaagctggtttgtcatggggagttcacatcccctctctctaattagcttaactagagctaatttatttgccatatgatgaccacggactactcgatccaggccatgtcatccaggaaggcaaattcattggtgttgttcataaggatgtagtccaggtccaggtcccagccgatctccatgccaccttcctttatgttcagtgagtcgtcagttgcctcaccgccagcgtcttccataggtatcatgtcctcgtccaaccccaagagcgattccagagagaacatgatgccttcttcaacatcaaccggagcatcaacaacaacctgttcaggcatcatgaatagttctgcattgttaggtgctgttgcttcaattgctggcaccgcattattctgatcctctgacacaacgacaacagggacagatccctcacccttggtcccaacgattggatcgatgatggtgaatgttgactcaattggtggcaccatgagagaaccaacagctgcattgttgttcagtgcgcttgtgtaggcgtacatggcggcgtcatcgtcgttgtcgtcaggggctcctatggatggtccggcactgccatatgcggtttgtccaacgaggaagtcatccacgggtagcccaaatggaagctcgatcataggagccttgtctttattcattgtcatcccgtcctgaggcgtgaaggccgccgggactatgttgatgtggttacgcatagtagctaggtggtggtggagggccttggtaggagaagggccccatgtacaacctctgctggggagcatccggctggacaccaccggacagccactgtcccatcactggagcctgcatggctgccgacgcagcaacgttgtcgaaggatataaccgcgttgccggtggccgccggcgaagcagcgttgctgaaggagataaccgcattgccggtgggtgcctgcacggtcgtgttgctgaaggagatcaccgcagtgccagcaggttgttgctgttgctgctggaaaaccgaaactggaaatggtgctgcagtactgccgccagcgatggtggtcgtggggatgcagctagcttggcccggcgccaccggtgaggatcagagggtgcacagcgagacattgagcgtcgaaaggatggctttgaggaacaaggagtccaatgagaggagacggcgctcatcaaggtccttctgttgcttcgtgcagtattcctgcggctgtggcagcaggaaattaaggcacgttaatttggctcaaatatatacatattcacgt

SEQ ID NO: 93765 - DNA, 1509 bp, Oryza sativa
agaaaaagaagaagaagaagaacacgtcagtagagggtccttgacggaaaatgatcttatcaagtcaaccatcgattctgggccgccgaatagtgatcggacgggtacgaagatgttatccaagactcccaattatgggagggttgaaacgatgaatcatcctcatgaaggggtctctaacgtaaaatcattgcctggctggcataacatacttttcctagtcgatcaggattgcagaagcattatcggacggtgctggagaacccatgttttgatcgaacctgtgagttaggcccattaagaattaggcccatgcaaatcaccctcggttgaagcccaaagcagtggctgtggcggccgcaggtacaaagatctaattaagttaagagattatgctgtccaaggcaaggcacacctttttattcctttttattaccatgccagtaagaccaaacaaggttttcaaggcaaaatagcaggcaaccattggccaattctatcttcgctcttgattaaccacgatgaaaaatccacaatcaggattctcatcacattattggcacattacggccaataacagaacactatcaataaaatgaataaatcccacacaaaaaaccaatgtggtgttgtgtgtcttgtatcacaacacctctaagatctagcttagttatgtacagatccttttgtttcccctaattaatattactcctatatcttcccctcttaggtctgaccatgaaattctaggcacccctctcctgagatagctcggtgtccttctgtgccgcctgagcgaggtggtgtacgatccgatggagccgtcgcgttgcagcacgatgtcagcatggattgcagagtttgggttcttcagccggtatcgatcatggtgactctggtgcttctcttccactgtcccttcgatcctcatgtcaaccttgttctcacaatctacttgttgggttttggtcacatcgtccttcttgttatcttccacaacgacggtgaacacaaatgtaccaatttggaggtagtcattcatgtccaatatgggctctagggccttgaccacctccctcatgctgggcctggactttggtgatgggctcaagcacttgtaggctaccaaagcagcctcttgggcccctttgtaggagtattggccctccatggctgggtccatgacgacccggtgcaactggtcgggcttcttgaggtactttcttgtccaatccaccagactttgctccctatggcgacgagagcggtccaccgagtgccgacccgataatagctccagtagtaccacaccaaaactatacacatcgctcttgtcggtcaggtgccctgtcatgatgtactcgggcgctgcatacccgtttgtccccatgacacgcgtcgtgacatgggtcgcgtcgccctgcggcccatccttggcaagcccaaagtcggaaagcttggtgttgaagtcctgaaatcaaatgaatcagagatcgggttaggcaggga

SEQ ID NO: 93766 - DNA, 5680 bp, Oryza sativa
  unsure (1)..(5680): unsure at all n locations
tcaggccctttgataaatctgtcacgctcgcacaaaacgaggaggtcgatgcgggcgatctcggcggcgccggcgggcatgctgcgggcgcggctccgcgggggcggaggcgacggcgcggggcggtggacgacgcccgggcacgaggagcggcccaaggggcacctcttcaaccggccgccgccgggggagtcgcggaagtgggaggactgggagcttccctggtacgtcacctccttcctcaccgtcgccatcctcggcgtcggcctcagcgccaagcccgacctcaccctcgagacgtgggcgcaccacaaggccctcgaccgcctccaggagaaggacctcgccgccgccggtcaggttccccgcgaactctagattttcttctttttttttctttcttttcaaacggtttgtactacgttatgtgtaattccgtaagtggattggatgaacctcaaactgataaaaaaaatgtacatctactgatgtttctcttgataactgtagtatgagtcatgattgtatctctctttctttctttctttttttggcatgatggtgaacatgttatacctttttagtggtttgcaaactgagatttttgcatacctgttgcagtacatttgtttgttggtatccattggcttataatttcctcctggttttggcaaaatgctacaatgaaatgcaccagtagatgaaaatgtcagatattatgcggggtaattcttgctgctggagtgccaacgattatcttcccctcttcgagaaatctctctctacgagaagttaagtactaggttatatgtaaattaaactgcgaaagcttatgttagtgacaggtgaggtttttaaggaaatgtagttgctcatgtagagtgagatagggtctgagtgaactacaagcccatggaatcgcgtgaggcttttgttgccacggatgttgtcctctagaggaaatggttgttacaatgcataatcaaatttagctggtcatataaagtttgaataattttcatgttgaatgtgacgattgttgttgaaagtcatagcctcatagggatcatgctaatgcatgtgtgacatactgatatgtgttcctggtgagcctgcattggccttatggcttttaaaacattgtcctggtttaacatcaaatattaaaagtgatactcccttctgctataagtaatatactcctcaaagattgacttgtgaaaatggttcctcaccaaaatgtgtgggatatatttctctcatgtctgaatgaagtggaggttcaaaatgtgctgttgaaatagagcatgaaggtatgtttaggtggctaaggtaatagcaattacaagaaagtgcaattttccatttggattaaggggtaaactacaaggattggttgtctgtgctcttgattagaatattaaagcaagaaacattttaaggtgggaaaatgaccttgccgtacagaaatccgataggcccagcggtgtgtccagacccacttcctaatattttgccatctctaatgcgacggtccctcagttgttacatggaattaaattgaatctctaagttgtttgcgctacccttcagctgtaaggactctcaatgcttctcttctttgaccatttattgaccttccctcttacaacttacaaggccccttgcagggttgggcctgtctatattcaatacaagaaggggtgcatactgaaatgctaaggctttctacaggcagcctatcttcctaaattgtgtaaactttgaactacaaggttgtgccatatgaacatttattagggcttctcctccagatacattctacagagacccagaaatccgagaggcccctgtaatcttgccccaatcagggtggctaagttcggatatcttgaaaagtttcactaaaatatttaatgtccactccaggacatcagtactatatgcctatngcttaatggaactgggttgttatcncattnttgaaataaatggctaannatatttgttaaatggatgcctccttttggaaagccttcacatgtgtacccttgaccaagcacttgaaaacaaaagtctgaaaaaaataacccactttacttaggcaggcatatgcttattgaccaacacttacctaacacattacacatattgtttacctgttcagttggtacatgatgcatttttgtgtctgtgctctgtatctgacaaataagctttacagtgaggattttttcaaattttgcatttgactgtcttgatcttttgcagcagtttagacaatgtgttgcactgttgcctcttgattaacggcgattcctatcgaagctatgaaattttctcctgcaatttatttatcactagttcactgcattattcttcatgctgtggtgattatattgtgcactgagtccctgacatctgagcatcctgtggatttattagatttgagcagtgtctgcatctttaccaacaaagcatttttgcactgtcactgcagcttttgttgtccagcatgcaatctcttgctcatgctatgattagtctttgtggacaccaatgctatcttgcagctttggcaatataaatttcttactctaatgatctaaatatgtataaatatagcctgccaaatttcatggatgcttttatatgatttgattttnaaattgggggaaaaaattttttttaancccaaatttntggttgttttcgttgaagatttagctcatgttgtcaaccgaactaccgaatgcattcaagaagtccttaaaccaattatccatattattagaattgttattttagtgctatttcttataagtctatgcgagctaaaaccataacggagtacattcttttatgccagtgaggcgtgaaccaaaccttttttccttagttgttgacatttcctaaataatttagtctacatgatgggatgattctgcttgttagggaccacaagcatggacatgaggcactggcattttgtttactgtctaaagtattcaagttaaaattgggtaactgtaagggctatacttcattatttcaattttttacattcttttatttaacaagcagctgctgaagtgctaataactaaaagtctatgaccaacacaacaaatcatcatatacttaagctgagtgcctgcatctaaacaccattgagtattatttgaaatttcttgtgcactattctaccagttaattgttgagagttgacatcatggaacttttggtctaccaaataaagatatgtcccttcacatttaacacattttgttttaccttaatgttacagccttcaaattcttagtcctttggacgacttatttaactcttcgatgtatatttgttctacttgctgttttggaagggatgtttgaaccatgtataaactttttggtgtcatgtatatgtctatcttgtactttcgcatgattacatttttccaactttgtgtatgcatgagctttcggaagagtttcagatctttagcagatgtgtagtaacttatcttacaagattgcaacttttttctaaagttatgaaccgatcttcctgttgtgacactaacttcttacctgatgatgcctttcaaagaaatgtagttgccatgtttatttgatgaataaagttttatacaatattttcctcatttaaaagctgagttactcttgctgatagctaatcttttgcatctttattatactagtgaaattgattaatttcactgatgctatccttagtgagaaccccaaagtgcaagttatagttgatgttatccttgaagaactccaaaaatgcaagttatagttcttgtcaaacagatattgagatataattatttcagttgcaatatcttgtgggaaaaaacttggttagagagtcaccacccacaaattatgcagtctcatcaaagttacatgtacttggatataatcattagtagggcgcctcatactgctccatctcaggtataacatataattctgctttattttctgtccctactgcatcactctcttgctgcctgttatgattgtgatccaacggatatgtatagctcaattctgttcatccctaatggaagtaaatgaaacattgctgtctcatcaccgttctacctgatgaattagctctgtgtgtatggtctcttggccctttcagctggttgcttggtttgcttcaccctccgaatcgtaactccaacgtgactccaggtcagtacattaacctactcctgtggctgtggttgtgatgtttttagtcagaaactggtagaatgggggatcagtgtaccacctaaggattgattgctgaggtactatgaagcaaccattgacattcaatctcacaatgcgagctgacaagctgtatatgcaaagcaatacggtggttgctgttggcatgtccttgtgagagcagtcgcggtcctaacatgctgctaagttaatttcttttttttcttttgtaggtccttcttactgaatactgatatggcctgccttgtagctccagaagtccagatctttctatatgccgaaattgctgacgagcagctagctagctctatggaacttctgatggatgggtttgctgacacctgtcggtcaatatatggagctctttttgcaggtatgacaatctttttttttagcaaactcccagtacaggtataattccatgctccattataaaaaagagaaaaaaaagggtataattccatgtgtctagacatccttttccaaagcctctttggtcaggatgaaagagacatattcaaactgcgtgaaaatgagaactgagaaaagggtctctcaccgaccgttagcagatccactgtgtgggggttgttggatccccacggaccaaaaccgaattgagtacacatagaggtttacatgataaatgtgttatacaactatacatgataaatgtgtcctcaaggaccacatgtcagtatgttacacagcattgcttaaactctgtacgactgtttggcatcattactggtgattggacatacttgatgagattagacgattttgctgttgagtgtagttatcatttgcttaatcttaatgcctgacttgtttagttccggagggcaaagtttgtcctcaaagtttcttttcccgtacatgacgaatttcaggtggtgtagcttcatgccttcaacttccatatagggatgcaagtggggcgggcaatcaggttttttttagcccgcttatctcatttctagtttatttttttttctaaattttgcactaccacgtaaaaattaaagtaatgagcgggtttttatacaggtagcgggactatccacttgcatccctacttccatatgagaagtacaacacattgcccatcttatgttcccccaacatgcgaaatataaagccccacttaccatgaagaaattccataatatcttacactattttttacatccattttctaaatatatggtgcagttgatttttctcacaaactgaacaatatttatcaagtacagtgagaaaagagtactactaaataacaatttagtactggattatacacaatctagtactatgaatttatacgctttggaacaggaaaaattggcatactttatgatagagggagtagaatgtataaataatcaaatgaattaaaaaataagtgtg

SEQ ID NO: 93767 - DNA, 1288 bp, Oryza sativa
  unsure (1)..(1288): unsure at all n locations
ttgtgatagatccanctacacaaagaacacaaccaagtatgccaaaggtgtgtagtttctcctgcagaatggcgtgtgcaagtgcagcactgcacaaattgacaaaagattatggttttgatttagcaactagatagcaaaaacaaattttagcaagtttcttatttgattcatctgaaattacctgatgattatactgagtgccccaagaggagtaacaagaatagcaggagcaaatgcataagcagcaaaatttgcaatttctcccacaatcactgttcacaaaggtcatgtaagatgccattagtcaagtttctttccttagtgacattttttgtctaaaaacaaatgaaacagtaacttcagtatattagaaaatacacatttctgttcacttccaaccaataaattccaccaaatatcttactgaaagaataacaaggaaaaacaacagccctaggagcagacagtagtaagagatattcatgctaaggagccatattcaggtgacaggaaacactttgctccgtacaatcacttttcatgccccagttaagctcaaaggttctactaatatctagtcacatacttgtatcaatgtaattatctagaatatcgttttggcttcattgaattcagccccaattaaaaatgtttagtttctcctaatacaaagtaactgtatttatcctgattctcaagacacagaaacatcttattacaggtcttagggagttgacaacttgacatcaacacgagtttacatgaccaactaaccaggtaacagacaataaagatctcatcataatcaaagtgacatcaataaggaaaaaataattgcaggataatgtttgagcagagcaagctatatgttaagatcaaaggggaaaaaactgataaatccaatgatagaaaaaaaatattgtgcacataatgtgacagaaaagaaaggaacattttcaagaagtacaaaatattgtataatttaaaaaggaatcaaatgtggcttactagaaatcatgcctatccaccatagaggctccattaagtaagaaaatcctccatatcctgtttaatgcaaataaagaaaacatgtgacctcctgcattgaaacttgtagagcttgcaacacaatagcttatgaaatatcacacgaataatgaaagtgcattgatctgacatcaatcatttcaggtaagtgcataaggacatagatcaggttgagatgtaagtgcatgttttgttcatacgttaccactaggctgtcctaaagtaagctattatagag

SEQ ID NO: 93768 - DNA, 728 bp, Oryza sativa
aggcctccccctccctcctccggccagatctaggaggaaggcaaggggagccgccaccaccgccccatgccgttgtcgccgccgctgcccccgccggcctccccctccctcctccgaccagatttaggagccggcctcccccctccctcctcctcctcctcctcccttgtcacaccctgaagttctcctcctaagcctaaaatcgaattaataagagaccctaagaaaataccggtgcaaagcaagagttaaccctattaaatcaatgcaaataataatcggaattggcatgtggaatttttcttgagttctacaagtcgaaattcactaacaagatttttagtggaattttcagagctctcgaaataattttaaccaattaaaatcgagcatgcaatattttaaatcccagggaaattcttttcctcctttctttttttccttttccctcattttcctcttcttgggccgtcggcccagtccaccccgccgcgcgcgcgcccttctccttgtgggccggcccaagccgcccctccctctctccccggaacgccgacaggtgggccccacctgtcgggcccgtctccttccaccagccggcgctgccgcgcccgcaaccgccgacgggtacacgcctgcgccttctccgggccacgtcagccacgcctgcgcgtgcgccgcatttcccgcacccacttacccctatctcgcgctcgcgcccgtgcccg

SEQ ID NO: 93769 - DNA, 504 bp, Oryza sativa
cctgacaaaaaatgggaatccccttgttccgctcaacttagttatagatttagtaccaagatatttccttttcaaaagatcttgccacacacagtgttcatttattaatttaaacaaccacttacttagtaaacactggttttggatttctaaattatgaataccaagtccccgttgatctttatgctgacaaataacatcccatcttgtcaacctatattattttttatgttcatcaccttgccaaaagaaacgggatctataataatcaatttttcgaagaacccttttaggaatctcaaaaaacgaaatcataaacataactaaacttgataacactgagttaatcaaaaccaatcgcccacctacagacatatgtttacccttccaactactaagttttttctcaattctttgctcaattgttaactaatctttattacaaagctttctaaaatgcataggaataccaagatatctaacatgaaaatctcccagtttgca

SEQ ID NO: 93770 - DNA, 1542 bp, Oryza sativa
ccaccatccttgcgtccatatgcaatcttcataccttgcgatctcttaacctctcgagaaactcgttcaccgatttgccaagccaactctctccgtgccccatgaaggctgaattgcaagtgctggatctcagtagcaatatgctgtctggtcaacttggtgatttcgttggttttcacaagctcgaggttcttgatttgtcctccaactctttaaatggcaatataagtacccagctgagtgatttgccaaaactgagaagcttgaaccttagttccaatggttttgaaggcccagtccctacaagcatcgctacctctctggaagacctcgtgctctcgggtaataatttcagtgatcatattccaatgggtttgttcaggtatggaaatcttactctgttggatctctgccgcaataatctacacggtgatgtcccagatggcttcttgagcttcccaaaactcaggattttggtcctttcagaaaacaacctgacaggaaaaattccacggagcttgctgaatgtcaccacactgtttcggtttggaggtaatcagaataattttgttggctcaattcctcaaggaattaccaggaacattaggatgttggatttgagttacaacatgctcaatggtgatataccctctgaactgctctcacctgatactttggagaccattgacctcactgcaaataggcttgaagggttcatccctgggaatgtttctcggagcctccatagtattcggcttggtcgaaacttgctcggggaagcatcccagaatcaataggcaatgccattgacttggttaatcttctgttagatggcaataagttggttggatatataccttggcagctcagcagatgcaagaacttggcactcatcgatctgtcatcaaaccaggtgcagggtaatatacctattgggctgggcaacctgagcagctcgtagtcttaaagctccaaaagaacaatctcagtgaagatatcccaagttcattttctgacatgtcagccctggaaatacttaacctgagtcataactcattcactggagaactacctttcacaaattctactcagtcactgaagctctgctacttaggtttgcatggcaacaagctcaatggtgtgattccatcgtcgatcagcttgctgcagtctctgatcaccattgatctggggaacaatgagttgattggaattatccccacaaacattggaacctttctgaagttggagcgtcttgatctttcaaaaaactacttgtcaggtcaggtgccatcctcagttgcaaacctggaaagattaatgtgtctattcctttcagacaataacctttccggaccattgcctgagctacctaaatgggtgatggtcaatgtaactggaaatccaggcatcatactagacacggaagaaaatagaacttcaggcagtatgaaaggctcccaggatgatttcagatcagctatatgggtcgcagcagcttcttttgtacttggattcagcttgtccttctattgggctgga

SEQ ID NO: 93771 - DNA, 1151 bp, Oryza sativa
taggttttgagttgttatcgtgttcccactgacactactttatgatcataagaaacatcaatagcaatatttcctgataccagcccaatagaaggagatgatgaagccaactacaaaagaaactgttgcaacccatgtagttgacctgaagtcatcttcagtgctagccatattgtattgactgtcagagtcttctgtacatattgtgagacctggattgccagatacatcaacctttacccctctaggcaactcaggcatggggccagagagctggttatagcaaagagacaagtagatcaatcccttcaggtttgcaaacgaggatggcacctgaccggacaagtggttgtctgaaagatcaagtaacagcaagttacttaaagctccaatgctggatggaatagacccctggagatggttgtgacttagtataagagcaccgattttggttggcattgtaggaatggttcctgtcagctgattgttcccgagatcgagggtgctgagaaactgcagagagctgatcgaaggtgggatcacaccactgaaattgttgccatgtaaatcgagataacagagcttggacaataggaccaatgttgaaggtatctctccagagaatgagttcgcactaaggttaagtacttccatatttgtcataccagaaaatattcttgggatatatccactgaaattgttggtttggagcttgatgacctcaagttgctgaagatttctcagctcatcagggacaacaccttgcagcttgtttgttgacagatccatgagcaccatgttattgcatttgccgagttgtgagggtataggtccacttagctgattgtcatccaactccaggtaagccaatctgatggcattacctattgattcagggatgctcccgcttagcaagttgcaaccgagtctcaggtggtagaggctccgagagaaattcccaggaatgagcccttcaagcctattggcagtgaggtcaatggtctccaaactatctggtgagaggagatcagagggcatctcaccattgagcatgttgtaactcaaatccaacattctaatgttcttggtgattccttgaggaattgagccagaaagtttgttctcattacttgcaaaccgaaacaatgtgg

SEQ ID NO: 93772 - DNA, 542 bp, Oryza sativa
atcgtgtctcacataacatcacacacacaaacgctctgttctgttaggcccaagaaatagaagaagccaagaaacagagatgcggcaatggcggcggcgagctgcttgcctggatctcgatgaggatgatgcagtagaagtagtcgaacgcgatgtcaccgaaggcctggaggctgcgccagaccttctgcatggaggtgacgccggtgccgacgctaatgccggtgaggctgcccatgaacccgccgttgcggacggtctgcgcgatgccgagcgagaggccaatcgtcgaataggtgaaggacatgatggcggcgacgatggacagccaccatatctgatcgaaatccgggatctgtgagaacacgatctgcacgacgccgaacaggatcatgtacgggttgctcgagctcctgcacgggttcttgtgccccttctcgtggaagcaatccgccctcttgatcgccctgctcgatcgaatcaactaagctatcagcaatcacatcatcaatggagtttgcatcgaaaccgaatcgaaacaa

SEQ ID NO: 93773 - DNA, 690 bp, Oryza sativa
ctggacaggcgaagatcacttactggttatgtgtttactattggcagttgtgctgtgagttggagggctactttacagtctgttgttgctttgtctactactgaggcagaatatatggctatttgtgaagcatgcaaagagttgatttggctaaaaggtttgtacgctgagctcagtggagttgaatcttgcataagtttgcattgtgatagtcaaagtgcaatttacctcactaaagatcagatgttccatgagagaactaagcacatagatatcaagtatcattttgtgcgtgatgtgattgaagaaggtaagctgaaggtatgcaagattagtactcatgataatcctgctgatatgatgacaaagcctattcctgttgctaagtttgagttgtgctcaagcttagttggtttaattgaatagtccaagagactattgttggcaccagtggttttctatctttgttgttcaagatgattggttgatttatgatacaagaagaatttgtctcaaggtggagtttgttggagttgttccaaattcactttaagatattggccgggcttctgacgaagcttattacggtacggtatatatgccctttgctagggttttgtggagacttgattctctttgtaagccgacataggcgtttaacccaaaaattttgagataatgagattgttg

SEQ ID NO: 93774 - DNA, 883 bp, Oryza sativa
taggggatgctctctcagtcattttggagaatgcttgtaacggggagtcttagaatgtttggttcccaatttggttccaggggggttaactcaccttcaatatgctgatgatactattctttttactaaagcttctgaggagaatgttttggctttgaaattcctgctttattgttttgaagaaatgtctgggatgaaaataaactaccaaaagagtgcagtttatgtcttgggggttcctaaagaaacagaggaaaagtttgctgatatgttgaattgcaaagtggggagtctgcctttcacttatttggggttacccatgggttttgagaaaatagggttcttcagaaagtggaaaagagattggaatcttggtacagtgggcatctgtcatatggagggagagaaatcaggattaattcttgtctgtccagcatccccatgtactccatgggtttctttaagctccgagaagaatttcacaagaagatggacagtataagagggagattttactggcaagggaatgggaagaagaagaagtatcatctaataaaatggcagggcctgtgtagacctaaggactttgggggttaggtttcatggatactaaggttatgaatatttgtttgctgagcaagttggataataaaatggaaaatgattctcaggacatgagctgtgtggtccttagaaacaaatatttgggccaaaacaactttttcaggagctcagctgggggggggttcttagttttggaaaggtctccatgattgcaaagattggctgaacaggttggtggttaaaaaagtgggaaatggaaagaaagtgttgttttgggaggatatttggcttggggaggtccctctcaaaactctttttc

SEQ ID NO: 93775 - DNA, 2425 bp, Oryza sativa
tgctgcttctgatgatgattctggtgattgtctggtagtatttgctggttgagttgctggtcatgatgaatggatttttgattccgcatgttcgtttcatatttgcactaaaagaaattggtttagttcttacaagcctgtgcagaaaggggatgttgtgcggatgggagatgataacccatgtgctatcgtggggaattggatcagttcagatcaaggactgatgatggcatgacacgcaccgctggaaaaaatgtggggtatatgccagggatgtccagaaatcttatttcattgagcacgcttgatgcaggaaggttacaaatattccggttcagatggcgttctaaaaggtatcaaaaggttctcttgtttgtttgaaaggtgatcttaattctgcaaagttatatgtccttagagggtgtactttaactggttctgattccgctgtgctgctgttagtaatgatgaacctagtaagactaacctttggcacatgcgtttgggacatatgagtcacattggtatgacagaattgatgaagagaaacctggtgaagggcttgacttcgagtaagatcaagttttgtgagcattgtattttcggcaagcataaaagggtacagttcaacacttttgttcacaccaccaaaggtactctggattatgttcatgctgatttatggggtccttctaagaagccctcacttggtggtgctcgtatatgcttacaattattgatgattactctagaaaggtttggccttattttttgaaacataaagatgatacctttactgcttttaaaaactggaaagtaatcgttgaaaggcaaactgaaaggaaaggaaaaatgcttcgtactgataatgggggagaattttggtcgcatgcctttaatgattattgcagacaggaaagcattgttaggcatcacaccataccccatactccacaacagaatggtgtggccgaacgtatgaacaggaccattatatccagggcccgttgtatgctgtctcatgcaaggatgaacaagcgtttctgggctgaagctgcaagtactgcctgttatttgataaacaggtctccttctattccactaaataagaaaactcctattgaggtatggtctggtacgcctgctgattattcacagttaaaagtttttggatgcactgcttatgctcatgttgacaatggaaaattagagcctagagctgttaagtgtcttttccttggttatggttcgggagtcaaaggctataaattgtggaatcctgaaactgggaagacttttatgagcaggagtgttgtattcaatgaatctgtgatgtttactaacagtttgccctcagaacatgttccagaaaaagagttgcagcgtatgcacatgcaggtggagcatgttgatgatgatacaggtgttcaggtggagcctgttcatgagcaggatgaccataataatgatgttgctgatgatgatgctcatgatgatgttcagcaaactccttctattttgcagctagaggaggaattacctattgctcaacgcaagtcaaaaaggacaacaaaacctcccaaacgtcttattgaagagtgtaatttgtcttactatgctttgagttgtgctgaacaggtggagaatgttcatgagccagcaacctataaagaagctgttcgttgtggtgatagtgagaattggatttctgctatgcatgaggagatgcagtctcttgagaagaacagtacatgggaggttgtacccttgcctaagaaaaagaagaccatcagttgcaagtggatcttcaagagaaaggagggtttatcttcaagcgagcctccaaagtataaggcagggttagttgctagaggttacagtcaaattccgggtgttgactataatgatgtgttctctccagtggtaaaacacagttcaattcgtacttttcttagtattgttgcttcacatgatcttgagcttgagcagttagatgtgaagactgcgtttttgcatggagagcttgaggaggacatatacatggaccaaccggaagggttcatagtgcctggcaaggaaaaatatgtgtgcaagttgaagcgatccttgtatggtttgaaacagtcccctcgtcagtggaacaagaggtttgattcatttatgttgtcacacagttttaaaagatctaaatatgatagctgtgtttacatcaagcatgttaatggatcacctatatatttgctgttatatgttgatgatatgctgattgctgccaagagtaagattgaaatcactaagttaaagaagctgttgagtagtgagtttgatatgaaagatcttggtagtgctaagaaaattcttgttatggaaattagtagagacagaaaatctggtttgctatttcttagtcaacataattatatca

SEQ ID NO: 93776 - DNA, 1036 bp, Oryza sativa
gtgcttcttgctcgccgtcgccgtcgtcctcgtcgctcatgcgacggcgccggcgccggcggcgtcgtctcggctgcctctgcctcctcctcctgctgctgctgctggtgatgtctccggctccgactccgaccgccgcgcgctcatggcgttcaagaagctcgtgagcggcgacccgtcgcaagccctggagtcatggggcgacggatcgacaccactgtgccggtggcacggcgtgtcgtgcggcgtcgcggcggggcgccgccgcggccgcgtcgtggcgctggacctcgccggggccggcatcgccggcgaggtgagcccggcgctcggcaacctcacccacctgaggcggctccacctcccggagaaccgcctccacggcgcgctgccgtggcagctcggccgcctcggcgagctccggcatctcaacctcagccacaactccatcgccggccgcatcccgccgccgctgatctccggctgccggcgcctcaagaacgtcctcctccacggcaacaggctgcacggcgagctccccggcgagctcctctcctcgctgcgccgcctcgaggtactcgatcttggcaagaacacactgacaggaagcatccctcccgacattggcaaccttgtaagtctcaaacagctcgtcctagaattcaacaacctgacaggacagatcccatcacagataggcaaacttggcaacctcaccatgctaagcctcagctcaaatcagctgtcaggctccatccctgaatcgatcggaaacctctcggcattgaccgccattgccgccttttcgaacaacttgacagggagaattccgccattggagaggttgtcatctcttagttaccttggtttggcaagcaacaaccttggaggcaccattccttcttggttagggaacctctcgtcactgacagctctggatcttcagagcaatggctttgttgaatgcatccctgaatctttaggtgaccttcagtttcttgaggcaatttcactggcagataataagcttgagtat

SEQ ID NO: 93777 - DNA, 6393 bp, Oryza sativa
caacaaaacggtgttgttgaaaggaaaaatcgtgttttggttgagatggctagaacgatgttggatgaatataaaactcctagaaaattttgggctgaggctattaacactgcttgttatatttcaaatcgggttttcttgagatctaaacttggaaaaacttcttatgaacttcgatttggtcatcaacccaaagtttcacatttgcgtgtttttggttgcaagtgctttgtcttgaaatctagaaatttggataagtttgaggcacgttctaccgatggattgtttcttggttaccccgcacatactcgtgactatcgtgtacttattttggggactaacaaaatcgtggagacttgtgaagtttcttttgatgaggctagtcccggtactagacatgaaatcgcaggtacactgtcacaggttcaggaggaggatggtcgtatttttgaagacgagagcgactacgacgacgacaacgaggtcggctcggccggtcagaccgggcgccaggccggtcagaccgccggcacaccttcggtcaaaccggcgcatgacgtgcggtcagaccggccagggtcgtcggctgagggatctgttgatgctgatcgagatggtcctccggagattacaacttcgaccagtacggatacagaacgtggatcaacttcagaagttgctgctcctttgcacattcaacgacgacatccaccggaacaaattattggtaatataggtgagcggactacaaggtctaaggtaaggactcatgatgtttgtgcaaattctgcatgtgttgcttcttttgaacccaaagatgtgtcacatgcattaactgatgaatcgtggattaacgccatgcatgaagaacttgaaaattttgagagaaataaagtttggactttagttgaaccaccttctggacataacattattggaaccaagtgggttttcaaaaataaacaaaatgaggatggtttgattgtgagaaataaagctagacttgttgctcaaggttttactcaagttgagggtttggattttgatgaaacttttgctcctgttactagaattgaggcaattagacttttgttggctttgctgcttcaaaaggttttaatttgtatcaaatggatgtgaaaagtgcttttctaaatggttttatacaggagaaagtttatgtcaaacaaccaccaggttttgaaaatcctgatttttccaaccatgtttttaaattgtctaaagctttgtatggtttgaaacaagctcctagggcatgatatgataggcttaagaactttttgcttgcgaaaggttttataatgggaaaggttgacaaaacgctttttgttcttaagcatggtgataatcaactgttcgttcagatttatgtggatgatatcatctttggttgtttgactcacgctttggttgtagattttgctgagactatgcgcagggaatttgagatgagcatgatggatgagttatcgtactttttgggattgcaaattaagcaaacacctcaaggtacttttgtgcatcaaacgaagtatacgaatgatcttttgagacggttcaagatggagaattgcaagcaaatttctacacctattggttctacagctgtgttggatcctgatgaagatgaagctgttgatcaaaaggagtatagaagtatgattggatctttgttgtatctaactgcttctaggccagacatagaatttgctgtgtgtttgtgtgcgtgctttcaagcttctcctcgtgcttcacatagtcaagcggtcaaccgaataatgaggtatttgaatcatacacttgagtttggaatttggtattctacttcatcttctatatgcttaagtggatattcagatgctgattttggaggttgttgaattgataggaaaagtactagtggaacatgtcattttcttggtacatcattgattgcatggtcttctaggaaacaatttagtgttgctcaatcaattgctgaatctgaatatgttgctgctgctagttgttgttcacagattctttggcttttatctactttgaaagattatggttttaattttgagaaagtacctctcttttgtgataatactagtgctatcaatattgctaagaatcttgttcaacactcacgcacaaagcacattgatattcgctttcactttttgagggatgatgttgagaaaggagatgttgtattgcagtttttggacaccaagttgcaaattgctgatattttcactaaacctttggattctaatctctttgcttttctttgtggtgaattgggcgtaattcatccttttggcatggtttgagggggagtttgtacctcatggttttatcaagcaataatatgacaatgagaaaaaaatgagaaaagagagctttgttagcagtatgttgaaggtttatttgtctctagcatagtgtcacgcccagaaattcacaagtaatttctgaactaatttgtgcattaaaaccctcgtccaggaatcagccgaggaacacaaactgacaatttaatatacagattcatcaaaataactaaaatgatttatggcttgagtcttgtaattagtgtggaggtcatcaatagcatccaaccttgtagtcatctgcaccatagtttgattctctcctccccgactatgtgcacaaatcatccaaaaatcatcaccatgttttagatggtagtgatatataggattctcgagacgatccttgagatgatgccggagacgacacaaagcttcgtaaacaactccttcacaagcatagaagaaacaattggcctcactagtaaatgatagttggagaagatcttccttgtcaaaaacgagagtaccggttgtcttgcaatgcaattggtctccaacttgaatagatactttagtcctttagaaaaatgccttgctttcttgtgttgctcctctcactaatctgaccaatcttcttgggcacatcaccccagatttcatcaaagcgtgccatcatattttccaacctctccttgtagggattcatctaaagcaagttgaaagacggggaagggaggatgggaaaagcttttgcaaggagcaatgggataaggaggaaaacaaacttttgcaaatagatttttgtttttgcaaagactcgtccttatgggtttaaccgtttggcttgacctacagtcgagatggctctgataccaacttgtcacgcccagaaattcacaagtaattcctgaactaatttgtgcattaaaatcctcgtccaggaatcaaccgaggaacacaaactgacaatttaatatacagattcatcaaaataactaaaatgataaatacttacataagaggcacttagtcctcaccatgaagaaaactgcagcggaaaataaaatctagcgaagcttcagctccactcccacagacagcgcaactgggatctaagccaaaggtctgctccttctggatcctttttcttcaactgaggtttgataattattgcaagaatgagcatatgacatactcaacaagccacacagcaaatatgcaagtgcacaaggataccaaaggatggcataatataggctcatttgcgaaagcagcatttagcaaagatttaagagaagtaaaacagtagagtaattaatcatcaattttaatcaacactgaacagcaccccaatgctgcacaggcccaaccaaacctgaacaaccaaccccgatcgtacagatcaaacctccaaaccaggaattatccattccaaactaggagtcaagttaattatcacattattaccattaatgagtagtgtgggactaatcacgaaaaacattgttagacccgcccataaccgcgggcacggctattcgaatagttttactctggccagagatgtaccactgtacccacaagacacgattccacacttgttgccatgccctaaagtaccaccacagcactgcaaaggaggaaattagtgacaatacccttcgcacaacacaactcaccataatgcaccattcctggatcataatcaccccctcaaaaaccagaggcatggactccccagcgacccccacggacttctcgctgcttctcagtctggcaccccgtaatgaactatgctatacaaaaggtaaagccgttgcccacgctagcttgtggttggcacggttaatgtctcacaatagtagctcgcgaaccggtccttaattgtcatgagcacgaccttcaaaaccatgtgctcacaatccaccattaatcatattttaattatcaattaattatcataacacgattgaccatcgtgagctaccattcaatataaccataagtaataatgtagtatatatgattcatcccattaatgagctaatgtttctaagcatggctaagcaattatatatatatatatagcatttagctgaaccaatccaatctataaggtccaaactaatcaaattataacccataggaaaataaagtcatcttcggccataatcaaatcggaaggctcaccacccgatgacattcgaaaataatgcatacgttgaaataaaacaatagctttaaatgggttcaacatgctcaaagggttgtttgggatctgtgtgacttgccttgcaaacaagcatcttcaattcatcttcaagaacttctccaacgatcgaacgatcctccgaaacaacggaaaactaaacctagaacgcaaaacgagaaaaaacactaataaaaaccaaataaacagtacaattaaagttcataaataggtagatcttgaatttagatgaattatgagacttgaacgacctcattccgagttcgtatgaattagatatgaattttagaagatttaattccaattaaacctattaaagaaaagactattccaaattgattaaacaatttacaaatgacttatagctgagtcaaaagattaaaaccggaaatagattagatcatatttggtagatgacatatattaaaaaggaataatatgccattgaaaagaaagaacggatttatatcgattttggacggctgagattaatctcgaccgagtcgaccaagatcggatggcttggattgacacacagcagcggcacaacagcggttgcggtggcacacctacagcagcagcgcgacggcgacgtacaacgactaaacaacgacgtggcggcaacaaggcagctagcgcagcggtgacgctagggcaacagctagcgacacagcaacggctgcgctagggttagagcaacagcggcggtgacacgaccgagggattgaaacctaacccgaggggacacggatagaagtctcaccgaaccaaagcgaccggagagggagggtcgacgatgacgatccggcgacacacatggaaacgatgacgacgctagggccaaacaacagattagattagattagattaaatccctagggataaattacaccggtaaacgacatgggagagaggagagctcaccggagaagacgacggcgacgaccaagatgacgacggcgaggggtgacggctagcggcagcggcgactagggcagcggcggctaaacaggaggaggaggctaggggcggctgaaaaaaaacaggaaaaagatggggaggggtcggcttaaataggggaagattgaataggattaggtgggccaagggaagcacgagaaagggggagagggagggactcggaggggagagggcagggtaggcgtgcacggctgggagaggccgagagggggaggggaaaagatatgggaggaggggttgcctagaaaggaaaggtgggggaaacagatgcggtgccgttttgggaaaggaaaaggaaacgataccggaaagagaataagactcggctcttcatacaaaacgaaatcgtggcggcaaagaggtcagcggatacaacgaacctcagacagggagagtgaaccgggaatgattcacaaccaaaggaggaaaaagaaagaattattaattacttttccaattaaattaatcactgaatgatctttcatttattaaaaatacttccaatgctcaaataattctgggaaaaatccagaaaatacttggacattaaaaatatttaatacaattttatctatatcaacttaatgttcaaaattttcatagattttattcacacacttgctttaatcattaaataatttctaaaaattcctttttcacaacgttttataatttagcgatttcagggtgtgacacatagcttgtatgtattctagtcttttcatgagatttagattttgcttttaagggagatgatgcatgacatctaaattctacttgaattaagaaaatatgcaatgttgatgctagcatatggtttgatctataaatgctatatat

SEQ ID NO: 93778 - DNA, 1365 bp, Oryza sativa
atggggagaaatcagttgggggtagaaaggcttaggaaccctctgctcatcaccacccctggaggggttatgacagcaaagtattatagccctgccgttcctatagaaatccagggaatcccttttcccttggatttgattcttctggacaccaataacttggatgtgatccttgggatgaattggttggctcaattccaaggagtagtggattgcgcaaggcgcactgtcactctgtatcgggggccggaacaaccggttgttttctttgcaccctcaacctctgtcggcagttcagaacttcatcagataggactgtcagaaatacccatcgtcagagagttcggagatgtgtttccggaagaactacccggtatgctgcccaagcgagagattgagttccggatagatcttgctccaggaaccactcctctatacaagcggccctaccgtatggccgcgaatgaactggccgaagtcaagaagtagttggaagagctgaaggaaaaggggtacatacggccgagcactttcccctagggtgctctcgtgatttttgtgggaaagaaggacaagacaaagaggatgtgtgttgactacagagctctcaatgaagttactataaaaaacaagtaccctcttccccggatcgatgatctgttcgatcagcttaaagctgccactatcttttctaaaatcaatcttcgctccggatatcaccaattgcgtattcgtgaagaagatatcccgaagaccgcattcaccacgcgttatgggctgtatgaattcacggtgatgtcgttcggtctgaccaatgctcctaccttggataagtttgttgtggttttcatcgacgacattctggtgtactcacaatcagaggaagaccatcagcagcatctccgtctagtgttgggaaagctgcgggaacatcaactttatgccaagtttagcaagtgtgagttctggttgtccgaagtcaagttcttagggcacgtgatatctgctaaaggagttgctgtggaccccgaaacagtgaccgccgtcactgattggaagcaacccaagacagtcactcaagtccgcagctttttgggtttggccgggtactatcggaggttcatcgagaacttctccaaaatcgctcgacccatgacacagttgctgaagaaagaagaaaaatttgtgtggagcccgcaatgcgagaaggcattccaaactctcaaggaaaagctggtttcctagccagttttaatcttaccagatactcacaaggacttcctggtgtactgtgacgcttcgcgccaaggattggggtgcgtgctcatgcaggaaggtcatgtggtagcctatgcctcacgccag

SEQ ID NO: 93779 - DNA, 1406 bp, Oryza sativa
aatccgcgaggctcaaaagaatgatccagatatgcatggactcctcaagaatatgaaacagggtaaagcccctggtttcacagaggatgaacacggaatcctatggaacggaaatcgggtatgcgttccagacgacagggaacttaaacagttgatacttcaggaagctcacgaaagtccttattccatccaccctggctgtacgaagatgtacttggacttgaaagagaaatattggtgggttagtatgaagcgggagattgcagagttcgtggccctttgtgatgtgtgccagcgtgtcaaggcagagcaccaatgaccggccggacttctccaacctctccaagtaccagaatggaaatgggatgaaattgggatggatttcatcaccggacttccaaaaacccagggcggttatgattctatatgggtagtcgtggatcgactaaccaaggtagctcggtttattcctgtgaagaccacctatggagggaacaaactagccgaactctacttcgctaggatcgtaagtctccatggcattcctaagaaaattgtatctgatcgggaagccaattcacctctcatttctggaagaagctccaagaagagttgggtacccgattaaatttcagcaccgcgtatcacccgcagacagatggacagaccgagcgtctaaatcagatcctagaagatatgcttcgcgcatgtgtcctagatttcaggaagacctgggataagagtctcccctatgccgagttctcctacaataacagctaccaagccagcatacaaatggcaccctacgaagcgttgtatggccgcaaatgccggacaccgctattgtgggaccaagttggggaaagccaagtgttcgggactgatatcctgagagaagctgaagctaaagtcagaaccattcgggataatctaaaggtggcacagtcccggcaaaagagttatgcagataaccgacgccgtaacctagaattcacagtggacgattttgtgtacctacgggtcacgccattgcgaggagtacacaggtttcagacgaaagggaagctcgcacctcggttcatgggtcctttccgtatcattgctcgacgcggagaagtcgcttaccagttggagctgcccgcatccttgggcaacgtgcatgatgtgttccatgtgtcgcaactcaagaaatgtcttcgagtgccatcggagcaggccgattcagagcaaattgaagttcgcgaagacttgacctacgtggagaggccagtgaaaatcctggacaccatggagcgcaggaccaggaaccgggtaatccgtttttgcaaggtccaatggagcaaccacgctgaggaagaagctacttgggaacgtgaagacgagctgaaggcagcccatcccgatct

SEQ ID NO: 93780 - DNA, 703 bp, Oryza sativa
  unsure (1)..(703): unsure at all n locations
agctatcactcatggttcgaatatttaatatctgatttttaatttataatagaaattaatatttgactttactatcttgtgcataaatattggtagggttaacaataatatattctcgtaaattatatctattgcttaaatgtcgatcttttctttactttctttgtgatcatttatggtttggcaagcaatagcaatcataacaaccagcatgatgcaaaagtttaaaaagttcgaaattttagtgatttttattgtcaggaatttttaggatgttacactaactcagcgcctattacaacagtcttagtaggatcggaaggatctagaggaattttcttggtcttggcgttgctttcttcgctctttgtcatcttggtcgcaggcacttgtccttcggttgctgtggacgcagctagtcggatttcttctcgggcgagcgtgatctcgcgggtctgagccatctcgcagctttccttgtcgcaagtgacggctagcttaatatcgctccgcagggatatgactccttggggacctggcatcttcatcatcatgtaggtggagtacgggacagccatgaacttggctaatgccggtcgtncgagcatggcatggtacgctgtctcgaaataacaacttcgaagcaaatattctctgtgcgaaaattctcccgagtgccgaaagcaaccggcagagtgatctg

SEQ ID NO: 93781 - DNA, 701 bp, Oryza sativa
gaagtagaattcgaatctttgcgatttcgtaacttcagcgaggagcgctatggagaagaccgagtagatgatctttaccgactggaagaagcccgtgaagcaaccttaattcagtcggctcggtatttacaagggatgcgccgttatcacaatcgcaatgttcgatcacgagctttcttagtcggcgacctggttctgaggaaaattcaaactacacgagatcggcacaagttatctcccttgtgggaaggactgttcatagtttctgaagttactcggccaggttcttattgactcaaacgtgaagacggtactcatatcgacaactcttggaatatcgaacatcttcgtcgtttttatgcttaggcattattttttgtatcttcttctttgactgttaacatcaagttcttacttgagttatcagtcgggggctactataataataatggagtgtgatttttatcaattcaatttgcttacttgatttatcattgccttggttgattttttggctttagttaatgaggactgaaagtttttaacagcttttgcgggttctaggctcagtaaggtttgacaaaaacttttaagaaatcaggagctgagtttaaatcatcaagcacaacataaattcatcagtattgtacaaattgtgcctccatcatcatcatcattgtcagaatacaatatcaatcagt

SEQ ID NO: 93782 - DNA, 1174 bp, Oryza sativa
gcatttcatcatcccaccacttgactaatatgggtgggcgagaatcttcacctgatcgtatctggaggacctcttcttcattaccgatcattggcccttatatattcatgaataatggtgaagcaattgaagaaagtttgtcggatcaagacagatttggaggacttgtttacccattataatttccggtcggggacgagcaggtccttgcaccctaacaggagagttagttccagggtcagcagcagcgtccgtcttgggagggctgttggcttgagcttccacttctgggatatctctattttgttctgtacccaactggtttccagtcgggggctcttgatcagcaccgacttcagcttcggctgactggtttccagtcgggggctcgttgctagtatctatattgccggttgccggttgattattacctgggcggtcttcagcagttggcccagtttctgctgaaggactagtctctgtgccagtcggcatggggtcttttccaaagggatctatgtcagatggtttcctccaaatttgagacatgctatcagctttgcttcaatagtgagtgactagcgaaacaggggaaattgctagatgacacatacctggatgacttccttatttttggcatgggacgactggacgttttcttcttcggattggcttgctttggctgtttcccaatcacccctttgttgtccgtcttttccgcgtcatcaccttcatcgtcacttgaaaccaacttcctcttacgagaatctgactggttagttgacctcgaggtgttgggttggacgtccgactggatcttcggccctccactggcttggccagtgtgccggcgaggtgagcggcgttgagcaattggagtatcggatttcatcaaagcgaattcctgtgcatggtattccaagttttcagtcgaccttacagaagataaaagcatgctttgagaaaggctaaggtgtataatacataccggtggaggagggttgaacgtattgtatggcacgactagcaataagtgtgaatagctgaccacaatggcattcgagaagattttgtacattctctcctacataattttgaactcaagagactctgggttctctcggttggggtcatgcttgccatcaaactcaaaagctgtgcgggatctctcctt

SEQ ID NO: 93783 - DNA, 2066 bp, Oryza sativa
acgtgcgtgtattattccatgtcccagaaggcaaggtataccaaaagttgatacattttagagcttatcaagcggaagcgtaaatagttaatttattacctgggcggcgaaggcccagcacacaagaagacaaacgaaaaacagcggaggactagggcgacgaccacaggcgcttgacggcaggcacgagctagacaccaaagccttcatcttccaggaactcctcttctgggtttgggaaaaattgagcaagactgagtacaaccaccgtactcaacaagacacacccataagtgcagaataaatgcaagggagtacaagggagccataatataggggttagggtttgcagtaaacagcattaaaagacacttagttgctcaaagctattttgtaaatacgaccctagagctatacaatattattaatcaaggccgtgaacccacacgaacctgccttaacccaaggcctacgatgattcagaccgaactggcaacctgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatacggatggaagacgtgacatagtttccaacccatcctagccatacacaagagtccgacccaaccccacctacggtcggaacatccgggacaggtaggcaggactgagcccctagcagcaggacaccggccctgtgccatgacatctcgactaccgggccgcagctcgtgtagccttcatttgccctagagatgtccatcgacccccgacttcgtccatctccatctgtgtacttttgtttataaccagactgatccacaaactaagccttacccactagacatgtggaagtatggtagtgctttgcaacagaggcccgaagaccggtccttatatggccgaggtgctactatcaaaaccatgcaccccgagcccagcctaaaaccattttgagggttttgaatagagggggaggtgtgaatccaattccacaataatccaaccattccataatgtccaggtgatatgaatattcccaaagtctagagctgtaaaaccacctaatgttgcctaattaagcggcgaagcatctacctaaattcatactagtggtaccatgagtagagtgtccactagttggggttttgtttattctagggtgaacaaggtaataataacaatagcaataataataaggtcataacaaaggtaaataggcatggctaaataaaacagtgataacgcgggaatttaaataaagcaataatgcaataatttaaatcaaaataattttataaattgggattcaatatgttcaaggatgatgtgacttgccttgctcgctttccaaaacgtcggcttcaacctccacgaagagcggatctacacgaccaacggaaaagaaaaggctttactctaataaactccatataacaagcaggaacaaagcacaaaaatggattcttgacttcttaaggaaaaattagagacttgaacggtccaattccgagtttaaatggccaagttatggccatttgaagtttatatgctctttaaatgaatatttgccaatttcttcatttaaattttaatttaaaaagggtttattgcgtcagccgagggggaggggcgcgcggaccgggtccatgggagtgggacccacgcggcagcctcacggtccacggtggaccgggtgcacccgggctcacacctgccgacgccgtgggccccacacgtcagccgcacccgagggcgcgggcggctgacggctgggccccacgcggcagccactcggtgcgcccgagggcggccatgccggcgcggtcgacgagaggcggcgcttggcgcgggcggggcggcgggagcggcgggaggacggggatgacgggtgggccccaccc

SEQ ID NO: 93784 - DNA, 678 bp, Oryza sativa
ttaggcatcatacgggatgtaaagcttgtcaacagttcgttaatgttcaattggtgcccgccgcagtgttcaatcctattattaaaccatcgccgttccgaagttgggctttagatttcataggtcaaatttatccttcgtcatccaaaatgcatcagttcgtgccagttgtaatggattatttcaccaaatgggccaaactcatgctgctatgacttacacggaggtaattgactttattttaaagcatattgctcataaatttggcattcctcaaacttttatgtctaaggaggtaagaagtttttccaaattttatggtattaaattgttaagttcatctctttactacgctcaggctaatggacaagccgagttgagtaataagatgtcgttgaaattagtcaagaaaaagatcgaagaacatccaaagaggtggcatgaggtgctttcgaaagcattatggaatgataggatatctgaacatggtgctactaaagttactccttaattttgagtaggcttatggacaagaagccgttttaccgatagaggtgaatcatggctctcttagatacataaagcaagatgacttattggttgaagaatagaaaacatttatgggagacaatctttatgatgtgaccgataagtgtttgaaggctttggaagtgatag

SEQ ID NO: 93785 - DNA, 505 bp, Oryza sativa
ccgagctaagccaaggcctcgaccaatggaaagctagtgaggatcatagctctgaaagatgagatagcacgcttgaagaaaaagaatgctcagttgaagggtctcccagcgccaggggagtccggatccgcaccacgccccgcaagacggcgactgcacccgtgcgcattcagcttgcgcccaggaacccacctccgcccgcaattctcgcagctccagctccaaccccagctccagttccagtgccagctcccgcgtccgctctctccttcgctccagcgtcagctgccaggggtccagccagtggcaacggaggttggttgtctgctactcccagtggcagccgcgaccacagcagcagcagttccagtggctcagagccgggcagcagggagacgtatctgccagactccaggagccgctaagagggatctggtgacgagcaggaggatgccttcgactccaccgaccgcaggagccgttccgagcattaggcttgctttcc

SEQ ID NO: 93786 - DNA, 685 bp, Oryza sativa
accatcagggaaaggttgagaattgcccaatctcgacagaagaactacgcggacaaccgccgaagggagctcacttttgaaacaggggattacgtgtatcttcgtgttactccgctccggggagtgcaccgttttcaaaccaaaggcaagttggcaccacgtttcgtgggaccatacaaaatcttggaacgaaggggagaagttgcttatcagctagagcttccttccaacatgatcggcatccatgacgtgttccatgtatcccaattaaagaagtgcttgagggtacccgaggaacaagccaattcggagcacattgatattcaagaagatctgacgtatgtggagaggccacttcgaattcttaagaccagtgaaagaagaaccagaaacaaggtcactaggttctgcagggttcagtggagtcaccattcagaggaggaagcaacctgggaaagggaagatgagttgaaggccgcccatccgcacctcttcgccagctcctccgaatctcggggtcgagattccgtttaagagggggggtaggtttgtcacaccccgaagttccttcccaagcctaaattggagttttaaatggtctcaagaaaatacctgtgtcaagcaagagtaaaccttaataaattaatgcaaataataatcggaattggcatgtggaatttttctt

SEQ ID NO: 93787 - DNA, 1156 bp, Oryza sativa
tggcgcgacttctgaaagccgaattcatccgtgaggtcatccatccgaagtggctgccgaacccggtgttcgtccccaagcgaacggcaagcttcggatgtgtatcgactacatcgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacatactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaactctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcc

SEQ ID NO: 93788 - DNA, 669 bp, Oryza sativa
ccctaattggttacccaaagaaattcgagtagtatgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcgatgtagtcgatacacatccgaagcttgccgttcgccttgggaacgaccaccgggttcgccagccactccggatggatgacctcacggatgaatccggcttccagaagtcgcgccacctcctcgcggatgaaggcttgacgttccggggcctcccgccgcactttctgccggaccgcccttgcgcccgcccgcacgggaagacggtgctcaatcaccttcttggggaccccgggcatatccgcgggtctccatgcgaagacgtcagcgtttgccccaagaaggagacgagcgcgtcttcatatttgccgtcaagaagaccaccgatccgtgtggtcttggacgggccgtcgcccaggggcaacctccttgaccgggacctcgtcgcctgtgatcatccgctg

SEQ ID NO: 93789 - DNA, 870 bp, Oryza sativa
gatgaatagcctgtgagtctctgtgagagtgatctcttgcagtgaaagtgtggacagtgtttcctatctcaatccagctgcatgctgggtcttttctcaaaccctgttctgtcatcttggttctaatctccttgacattattccacttgcccatttcggcgaaaacatttgatacaaggacataattacctgggttatctggttccaactcaagaagtttatcagttgcaatcatagcaagctcatggttcttgtgtatacgacatgccccaaggagtgcacaccacaccacagattttggttccaaaggcatagatttaatgaacttgtaagcttcttcggtctgtcctgagcgaccaagaagatcaactacacaggcataatgttcctgccatggttgtaacttgtatttgcttaccatcatatccagataaaatttaccctcatcgacaagttttgaatgactacaggcatagagtagagcaagaaaagaaacatgatcaggagatacacctgtttccagcattctcttgaaaatatatatggcttgcttgccatgcccatgcatcccagtagcattaatcatcgctgtccagagaacaacatctttacacttcgcctcatcaaaaactttgagagcgtagttcatgcttccacaaccagaatacatgtccacaagggagctaaccacagcaccttccacgggaaatttacctctgataaggaaaccatgaatttcctttccttttgtcaaggatgacaatccagcaattgctcccagaataccaactagtgctacagaatcgggttggatgcctgcattcagcatcttgccaaacaaggcaacagcttcatgtaacagcccattct

SEQ ID NO: 93790 - DNA, 1547 bp, Oryza sativa
cgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccatacttggcgcacgtaggcgtccatctgcgggtcagagcaccggtactccttacagacttggttaacgaccagctgggagtcgcctaacaccaggaggcggcggatccccagtccagctgccactctgagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtatgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctctttgctaggggccgcatccctggggcactcttcgtccaagcagcctcgcggggcgcacttgtcttctgtgccgacgacctcggggtcggaggacgacaggggcggccttcccacagtggcctcggggccgtcctgggggtcgggggctcctggcgtcgtcggacaagcgggtaaagggccaactccggtcgtcaggggccttaggcctccgttcggctcgggggcctcttctccctgctctttcccgggtcgggtcagcacagggttagcctcggggtcgaagggcgataggtgcggccttcccacagtggcctcagggccttcctgggggtcgggggctcctagcaccgtctgacaagcgggcagagggccaactccggtcgtcgggggccttgggccaccgttcggctcgggagcctctcctccctgctctctcccgggccaagtcggcacagggtggggaagcgtgaaatgagagttgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccgtccaggtaaacggtccggagcgtttgagaagcttaaataagggtaacgccttctctcccagcc

SEQ ID NO: 93791 - DNA, 2590 bp, Oryza sativa
gaggacacgccccaacttcacgttgcaaacggtgggagaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggtggcaatggtggccccaggctcttggaaacctaggccatcatcgccgtcatcgatgtcctcggcgggggccttctgcttggcctcacttcgccgattaccggtaggaaccgcccgggatttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctccttggaggcgatcttttcaagcatgcggttgtgccgcacaccccccctgaacgcgtaaatcaccgcgtgcgcagggatgcatggtatggtgttgcggacttgacagaaccgctgaatgtacgagcaaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcttgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcccgggtcggaggcgttgacgaaggagtagcggccgaatggcgaacagcggctgccgctcgccgcgccctccgtcttgacgatgcggagccggtggtagcagcaccagaggccttggtggcggagaactgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctctacctcctgtgggtgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgtgcctttgctggctcggccattgggctgaacaggaaaagcttggcgcacacgaaagagtgcgagagctcagaaaatccctcgcagagcccctacctggcgcgccagatgacggagcgtggggctcctcaccgggagaccgcgcaggccccccttagccggttcggccgggggctcagggagagattctaagcactctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttttgggtttctaatctggaaaagtccagtcccccatctaagtgggcaaggtcctccttttatatcttaaggggataccacatgcaccatttctctcttttttgtggggacttaccccaccttttcataaatggacggagatttgtatagttgtcgtccgagtcaccatctgatgagacggctcacaactacctccactttcgccgggagctggtgcgacgtggaatcgtggctgtctgctgacgacatgaccggtatcagaccagtcacgtcggtcattcttgtccaccacgtgtcagcttagcattctacatgctcgccattctacacacaacatcttgcctgtaatggttaggatgaagcttggcatatatctgaccag

SEQ ID NO: 93792 - DNA, 1671 bp, Oryza sativa
ggggggactaagaggagggcgaacgcatcaccctcgggccggacgtccttcgggggtaccaggcaacgtgtgcgattgtgtctgccttaaacctctagtcatgatactcctgatcccatgtcaccgacagactatcatgccatgttcaggtggaaaaaaataaacatttttggctctagctgtttctcattcatcttcctctcgagagcgcaattgaattttgtatctggtttcctgtcttgaatcttttccttggttccttcctagttcctagaatccacaagcacctttgattttttttttctccctcgcagtaaaatgactgttgatgacattagccacaccacaaattaaatctaagtgaaaattaccgaaggaggaaaatatagtctttctagaatgatggtgttcatctcacacagatgtgattggtacatttgttgattttgcagaacatgatcataagacccagaagaaagttcttccattgtcataagctagggcatgacacgcacgtctcaacttgcgcgacaatggcacagtcgaaccatccacatcagcactgcttaacgaaagcagcaggccagcagccggttaatttctcgctgactcgcagtcaacgctgagtttctcgtcaactaattggacgttggctcgatcaaggcgattggaatgggcccaaaacgagagtgaaattattcgatcaccacaattcaagtccaacgagtaagtctcatttttgccaacagttttggcccaaaaactaattttcagcagaccatggaacaaaccctagagtgacatatgaacgctaactgagagaaggcctctcaactcaagtgattatgaacagtgaaaggaatcagctattgaaattttacagaaaagaatcctttacatcgttttacattttgacgctataaatcacaagtcctcgtgccattcagactcttcctcagttgctctatgatccatctagagatgaaaaacagatggtgaataaactcaatccggaatgggcggcaaacgagatcctatttgtcagggagcaggacaagccatttctctcttcttcttttcttccccattctcagccagttcatcactcatgtgcctttgttctaacctcttcaccattcttgctatcaatgttctatacttctacaatctaactgtctaaggccactcaccagaagtcaccgcaagaacaagtgcctccactgaaatgatggaatctgttggcgtctcggaccacaatttccctttcaaatagcttggacactagcttggtgaactcatggcaatcgccgcaaactctgaggttcttggcaatccttagaggtgtacctgaggcagtgctgatcaaaccaaacgatatcgcaagcctctcgctgtgcctatgcagcaaatctatcttctcttcttcgctcacatcatgcagaacaaaactagtatcctcgacatactgaccttctcttctcagtttttcagttatctcggcaagtttgagatgaatagcctgtgagtctctgtgagagtgatctcttgcagtgaaagtgtggacagtgtttcctatctcaatccagctgcatgctgggtcttttctcaaaccctgttctgtcatcttggttctaatctccttgacattattccacttgcccatttcggcga

SEQ ID NO: 93793 - DNA, 674 bp, Oryza sativa
tgcgtgaacctccctgccattgattaacctacccaaatgacccactgcagacaataagctcacaatgcaagcatgatcaggattgaaaccattctgtaccatttcgccaaaaaaatcgatggcctcagcatatagcctattttggacataacaggagagcattgagttccatgatatgtagtccttgtcaccaatctcacggaatactctgagagcgctatccacccaaccgcatcttgcatacatgacaagcaaggcattgcattggatattgaactcggtaccgcatttcagaagcgctgcatgtagctcccttccatggttcagctgagcaagctctgcacagacctgtagcacaccaacggttgtgtaagaattcatactgaagccgtcgctctgcatccgtcggaacaggtcgagagcctccaagaacatcccgttctgcacgcagcctgatatagccgagttccatgaggccacatccctcccgtcgcgcatccactcgaacacccgcagcgccgaatccaagaggccgcacttggcgtacatcccgacgagcgcattggccacgagcgtgctccggtcgagggcgctctttaccgccagcccgtgcaccttgctcccgaaccttccgtcccccttcgggccggacgccttgagcacggacgcgagcg

SEQ ID NO: 93794 - DNA, 1094 bp, Oryza sativa
tcatcaaaaactttgagagcgtagttcatgcttccacaaccagaatacatgtccacaagggagctaaccacagcaccttccacgggaaatttacctctgataaggaaaccatgaatttcctttccttttgtcaaggatgacaatccagcaattgctcccagaataccaactagtgctacagaatcgggttggatgcctgcattcagcatcttgccaaacaaggcaacagcttcatgtaacagcccattctccgcaaaacagtttaccatactagtccaggtaacaatgtcctttttgtctaacatttcaaatatattaagcgcatagcaaacccctccacactctccatatatatctatgattctattcttcagtatcaagtcaagcaagccatttctaatagcataagagtgcacttgctttaacagtgagatgcttttcaaaccactgcatgcttccaaaatgcttcccatcatcataggatccaccttaatgccctctttctgtgctgttctaaactttccgattgcctcagaataccgagaactttgcgcgtaacaggcaatgattgttgtccatgacacatggtccttaatcctcatcctgtcaaatacacgggcggagcactccacggagtagcactttatgtacatgtccatcaatgtattagctatctgcaaatcactatcaagcctttgcttaacagcatatgcgtgaacctccctgccattgattaacctacccaaatgacccactgcagacaataagctcacaatgcaagcatgatcaggattgaaaccattctgtaccatttcgccaaaaaaatcgatggcctcagcatatagcctattttggacataacaggagagcattgagttccatgatatgtagtccttgtcaccaatctcacggaatactctgagagcgctatccacccaaccgcatcttgcatacatgacaagcaaggcattgcattggatattgaactcggtaccgcatttcagaagcgctggatgtagctccctttcatggttcaactgagcaagccttgcacagacctgtagcacaccaacggttgtgtaaaaattcatact

SEQ ID NO: 93795 - DNA, 664 bp, Oryza sativa
acataactctacatagaaacaggctaaacaaaacagactgaaaataaacagatgcagataagaaataatcaaaggtaatgagaaacagatgcagataagaaataatcaaaggtaatgagatgcatcagcaacggcaaaagatccacagcatactcatcttggtcatcgggttcaaaagattttgcacgttgctttcccgaacaataagcacatatatcgtaaactatttcatccctcttctgtccaaagagcggcaaaactaaaacgatattaactccgacacattacacccctgaatcagggaaagcttttaaagtggggaaagggggggagatctacagtttttcttcttcttatgtatggtacacacaagaacattacgatcttcgatcatccacctgggggtcagggtccaaaagatgaaatggcaattatcaactacagaaatcatcaaaagggcgaccggtcctatcttaactgctgactgctacactatgcctcctaaatctcacagttctacatcgtctcaacttggcgattgcttcttgtgccttcccttgaagaaggtccacataaactgatgctagcactggcctggggtttgtgggcaacaaggcaacgccacggcttaccatatagttagcctgctcaagctcttcctgca

SEQ ID NO: 93796 - DNA, 2292 bp, Oryza sativa
aggctcttctcagatgaccatgacaaatcaacgcaatttgtccgatcgacgagcccagcaacctctatcacaggtttatgttgatgttgacagtgagcatgggactgcagagcgtcaagaaataggtaatatttgcaaattcagtttcacttgttgtttgcatcaaaccttttttgtttcatattgctgctgaaactgaaattgttaaatgtttgtcaaatttagggacgacaaagagagccagatggagtcaccagatgaagatgttccttattgagctcctaacagatcatgacgtgccaggttttcgaacacaaaatgcttggagtaaggaagcatggacaaatattgtttgccgcctgaatacaaaattcggtacatcatttacgaccaaccaagtcaagcaaaaggagcaggatttgaagaaagattatcgcagtgttaaagatttgttggatcaaagtggttttgggtgggatagtgacagaatgatggtgagtgcaccacaaagtgtttgggacacttttgctgatcgcaagaacaaagatgcaattcattggcgagataagtcgttcccatattttgatgatttagctccactttatgatggtgagctttatattttttttatcagtggtttgtttgttttgttgaaatgttttaggcaagttatgctgatcgtgaggagaatataattgtgtaggtcgttatgctgaagggagaactcgccatggtatggaccattatgcaaggaagacaaagaatgcaccagctcattcaacacaagaagcaaatgtggttgatacatatcagtcaccatcccctaattcaaatgctccaggtgaatcaggtttgcaatttccttttggtgaagaggttgagacagccaatttggacttttcacagcattcacctacccctgtccatctcacaaaagtcccacctagctcggcacaaacaccttcagaggttcctgaatctcgacctgggaagaaacaaaagatcaaatctgttagtcctgatgatggatttcatgagagatacctaaaacttaaaaaagaagaaatagatcgatttgctgcaattgaggagaagaaattggaggatccttacagcatcaacaagtgtatcacagtgcttgaaggtttacatggtctacaaataggagatatattggtggcagctgatatcttcaaaggtaaggataatagggaagttttcttgtccttttcaagtgatgcattacgcctggcttggattagaaaggaaatcgcagcattagagtgagtacttttgtgaaacatatggcatgcaagtagtaggatagtacttttgtgaaatagatggcatgcaaatagaaggatagtacttttgtgaaacaaagggggtacttttgtgaagcagatagtagtaggatatacttttgcttagagggagtgcatgcaagtagttacttcattaagtagaatgtgacaaacttggagtacaagactagtaattgaccttgaatgccatggtggtcaaatgcaatatattatttccttcgtgctacgtaatggttccacatccgatgtgccatgtcatctcgttttctattcccagcttctctagagttgttaaattcttgtacatcaccattatagttctcgtctccatttggcacatcaacaatatgatctggatcaatctccaaacgacaattacttggccacaccatatctccattatgcaggcgtatgaagttgtgtagaacacaacaggcaaccgaaatatcaacttgtttacgagctgggtggtgtgagccggtctttagtataggaaatctcatttttaatacaccaattgctctctctatatggtttctgagttgtgcatgccgaagattgaataactccttataattttgtggcttttgattagctctgccctgttcctttaaatgatatcttgtcccacgatacggtgctagaaactgtgttgtatttgcataaccagcatctacaagaaaaaatttaccaggaggtacttcaaaaccatggtttagtgcatcttgaagaactcttgcgtctgaagctgatccctcccagccggcatgtacatgtacaaatttcagatcgaagtcgcaagctaccataacattctgagaaattgtttgctttctattccggtatggttcttgctggtctagtggaagtatcattggtacatgtgtcccgtcaatagagccaacacaattctatacaaatacaaatataaccttgattaagtctttttatgtacaatgattggttt

SEQ ID NO: 93797 - DNA, 2636 bp, Oryza sativa
taataaatctgatggtttggtctaccaatatatataggagagcagaagcaagcaaataagttgctaatccttacatacataccaaaaagaaaaaaaaatcatttatgacttaccaaatgaattgccacgtttgagctcttgtcatgcttggccgatacaatcgaaggtgaggtgagctagttttgttgatgtccagttgcagctacagcaatatatataaggacatgcaacggctagtacttgctttgaacgccaacggctatctgttcaaattcaaaccggaagagaaatcctgtatttttcctatagcactatcaaagggcacctttcattttttcctatgtttttgattcctgcgggattgaagaatcatactacttcaattcctgtgtttttcctattcctgtgtttttcctatcctgcgaatcaaaggggccctaaagttcatgcagaatttcctaaaaaaggaaacaacgatgcacaggagccgttaatggaagacgccggtaaaatcaagtacaccggccaagaagctagagcagtcgaagccgtcttttgcaccaaaaccaaaggtgtggatagaaaagccaaagacgcccgctccattacctccggagacgggtggaaaatccgcgcactgaactgaaaggaggtacggtcttgcacgtcggacttaaaatgacgcgaccttcaccaacaggtaaattggtatgtatccgcatatttgttttcaacaatttaaaattttgcatcatcacatgtttgaatttgaaaattgcatttaggatttttttgaattttgaggaaattcttcaaatgaatttttcagagcaaatcaaaataaaattttcaacgaaaattcactgtgccacgaccacactgaccgttggaacccaacggccgaaagtagggctggtttggctcaccaagggttcggccgaaccggccaggcaacggtcggctgcctccctttttgaggcaacggctagtgggccccacaggtcagttttgaccattgtgggtgcaccacttaagccaaccggccgggagagggaaatccaccccatttcaacacattttcattcccattctaaagtttgctctcaagttcattcaagctttgatagtttccctcaaattcaaatacttagctgcatatatacaagttgctttggtgaaactaaccggcgggtgaaactcttgctattctaatccccgccgagttagaccgttcttgctccattgtgcagaatgaggaggcagctgtctcgtctgttcaaggggtctggcttttcgtcaagtcatcatgacgagtctagtgctcattcatcagctgatgtctcgatagaggacgccgaagctccgcgacgtctcctgaacgacgccgacctcgaccttgttgacgattgggaaagacaagcctactacattctgagcgaccgggagtacgctcacatgcgagaatactctccggagctgctgaaaaagataggtatggatgttgattttcgtgctatttggaaagctgttggttggcatagatttgctgtggttgatgagcctgattctcgtttgcttacttttcaatttgtgtgcactttgaaagaaatagaagatggagtttccttttgctttttccataaagaatacacacttacatggaaaggattaagtacacttcttggctttcacgattcctgtaaaatcgatctccagaaaggaatttctttgttcgagaaaaataggttttgggaagatatttatggtgctccaatttgcaagaaacctaggacgaatgatatccataatcctacacttaggctcatgcacaggtggattgctatgactttgtttcctagaggtgatcttagacccattaggggggatgaattaattatcatgtttgccatggttacaaaaaccaaaattgctcatgtgaaatgtatgataaggcaatgttaggacgtataagattttttgctcttgttgagtgcacatctctgattactcggagcaaaagggctaggggtcgttagtgaccaaatagctttcatctcagccgctcgtccttgtattgatgagaattatctagtgcaagggcatattcttaaacatgaagtagatggatctttgatataccttttccccggttgtacaaatgaaattccgttgccaaatgcggggtatcatttgtacaactgctgtgaactaaccattcccctgcagaccatagaagaatctcgtgcaggtggagcatacagggagacgcgcaacatggcaaggaatgaacgagaaagttcatcatccccaacacccgtgcagatgtatgaggcaggttgggaaccaattggggatgcacccggatggacccaagctccatgccatagcattggagtctcaagctgggcaagtgccagtgaggaccgatggcatgtgtgtcacgtccgtaaataacccaacgggcgttccttacgtgcgtgcattattccttgtcccaggaggcaaggtacaccaaaagttgatacaattcagagtttaacaagcggaagcgtaattattttattacatgggcgccgaagcccccgcgcacaagaagacaaatgaaaacacagcggaagattagggcgccaaccaca

SEQ ID NO: 93798 - DNA, 665 bp, Oryza sativa
tggtgcattatgaactcggttttaaattcttgagcaaagtaatttttatcggagtaattcaataaacagagagcacaagcaatttcctagctgacccctttattgtcgtctgttcatgacaattagcaggaattaatgccatggatgaaataaacagaggatggcaaatacaccgtgatgccattaacagggaaatgcaacaagaatgccatatagcaacataaaaccgattaaaaccatcttgttgttattccttccatccttaccggattctcaccggttcataaattggtggaggcgtgatgagtataattttagtggagggccattgctcctgcgaaagatcgaaaccaaaacagagttaaagcaaccataaagcagcagcatcaattagttcaagttggggaaaaccaatcgatttcaatccaagcagaaccttgaagtaggcgcagatggcgcggaggttgctctggtactcgtcgagcggcacgtgctggtgcacctgcatctgggcgctgtggagcgatgtgcgaaggaaggcgtgcgacgatcgcgtacgtgatttttctgccagtgatcccgcgtgcgtgttctgtcgttggatgcgatgcgatggatgattttcagtcgttagatttgaggaatgaagtatgaaagacgtagga

SEQ ID NO: 93799 - DNA, 526 bp, Oryza sativa
tgagatctatacaagatgatgaaaacctctaagagatggtagatacacgatataatgtagattaataacgagatctaactctatcggcaacttcctaacaaaagaaacagccgatgacaagttatatagcgtaactaacagagattataaagtatatatgataactcaacgaattacatagacaagattagagtgtcataaagatggaagcactattcccgagaacgcaaaccgccatgacaagtttacctctagttgaagatcgaatcgatgcagctcaacccgaaagcaagaactcgtcgaaataaaataaaagggtggcgatgcgccgaaagtgttattgaacatgtgttaattgattacatgggttcaggtcatatttatacccgagatacaaaatatgtccttgccggacacgactcttatctctaacaaactctaagataccataagtctttgcggcagacttttacccaaacatatctctaaggaaattaaataagatatcctaattaatagatacaat

SEQ ID NO: 93800 - DNA, 931 bp, Oryza sativa
aacaggcccttaatatctacagccgatcgagtagatttagtcccttcttacttattaatgactgccgattgatgcatatatgacatcggctcaaagataaatgatatgtcatcagcatctagccgatcggctatcgtttatggatttaaccgcggtttctttgtctttgattcttgatgattgcaggatcaaatcaactggcacgctagcatacccaaaggcgagttttggacctgcactgcagttaagtagatctctcaggcctcgtgttttcacatcaacagttgccccatatggaggtcactatggagcattcaggcacacgcaaagatctggcagagtggattcttttggccatcaatgtatgatgacacaaaggaatttgttcggatatgtacaagttgccagaagcatggagggatccctgctcgcgatgcaatgccactgacaaacaatcttcaagtcgagctatttgatgtatggggaatcgacttcatgggacctttcccaaagtcctatgcctgcgagtatagcctagtggccgttgactatgtgtccaagtgggtagaggcaatgccatgcagggccgtaaacgccaagcacgcccgccggatgttccatgagattatcttccctcgttttggaactccgcggatggcgataaatgacggagggtctcatttcatcgataagaccttccgaaaatttttgcaagaacttggggcttaaaacaacattgccactccatatcattcccagacaagcggattggcttaaacgaccaacaaacaaatcaagaacattctacaaaagactgttaatgagatggggaaagcatggaagaacaagctacctgatgcactttgagcatataggactggttattaaacgcccatatggctgttaccattccaacttgtttacaggaaaa

SEQ ID NO: 93801 - DNA, 689 bp, Oryza sativa
tgtcattttagttcatggtaacatatgatcacatccatagtaatagaagtatgcaccaagtgtaacatcactggaattaattgcaaagaattggtatcaaagaagaagccattgaacatacccatctgatagttattctctcttcagcagcccgcttcagttctaccggtcggcgagcagagagaatttccacaagcagtatgccaaaggagaagacgtcgctcttaggagtcaactggtatgttctcagatactcaggatcaaggtagccagcggttccttttacttttgttgagatgtgtgtcttttctgtgtcactggggccacttcttgcaaatccaaagtcagacaccttggcccggtagctctctgtcagcaggatgtttgatgacttcacatcccgatgaattattgtcttctctgttcacatcggagaaattatcagatagcaatacagtattattaaaatcaaacttcatcaaaataaaaagtgtgaatttcataaaaccgcagcaatagcaaatgatttcatcaatatgaaattttctcccttatgtgtgtatggcatgtgggcccgatttgcataaagcatgtgtacgtcatgtgtatgataggtggggccaaaattgtagagatataaagttacagctttttgataaaatcgtatgctattgttgcagttctctgaa

SEQ ID NO: 93802 - DNA, 1540 bp, Oryza sativa
tttgcaacagaggcccgaagaccggtccttatatggccgaggtgctactatcaaaaccatgcaccccgagcccagcctaaaacccttttgaggattttgaatagagagggaggtgtgaatccaattccacaataatccaaccatttcacagtgtccaggtgatgagaatattcccaaagtctagagttgtaaaaccacctaatgttgcctaattaaccagcgaagcatctacctaaattcatactagtggtaccaggcatagggtacccactagttgggggttttgtttgttctagggtgaacaaggtaataataacaatagcaataataaggtcatataaagataaataggcatggctaaataaaacagtgataacgcgggaatttaaataaagcgataatgcattaatttaaatcaaaataattttataaactgggattcaatatgttcaaggatgatgtgacttgccttgctcgctttcccaaatgtcggcttcaacctccactaagagcggatcttccgaagctgcagcgtctacacgaccaacggaaaagaaaaaggcttttactctaataaactccatataacaagcaggaacaaagcataaaaatgggttcttgacttcttaaggaaaaattagagacttgaacggtccaattccgagttcaaatggccaagttatggccatttgaagtttatatgctctttaaatagatatttgcgaatttctttatttaaattttaatttaaaaagggttcagccgaggggagagggcgcgcagaccgggtccacgggagtggggcccacgcggcaacctcacggtccacggtggaccaggtgcacccgggctcacaccggccggcgccgtgggtcccacgcgtcagccgcacccgagggcatgggcggctgacggccggaccccacgcggcagccactcggcgggaggcggcgcgcccacgccccgatggtcgccgccggcgaccaccggtgcggcgaagcggcggccgagagaggggagggaagggggaaaggaggcgacggtccacggctcaccccggggcgatggcggcgacggaggaggcggccggagcggagggaggcggtggcgcggcttgggtcgacggggacagcggcgctccggcggtcggcgaccgaaacggagaagtggacgaggtcggcgaggatgcggcgaaaccgaaggaggcggcgccgaggtgggaggcggtcccgggcgacgacggtcggcggaccggagctcagcggcgacggccgagagagagagcgacgtcgcgagctcgaatccggcaaggagaaaggcgggcgagaggcggaaacggacggaggaagcgcggggagggtttaaatagggccggggcgagagagggcggccggaaaagaaaggaaaccggcgcggcgttctcgggctccatcaatggcgccggcgggattaggagaggggtttccaaacgaatccaagggagagagggagggaaattttgggggaaagggagagggaatcacggggagcaattcccccc

SEQ ID NO: 93803 - DNA, 698 bp, Oryza sativa
gttcttgctggtctagtggaagtatcattggtacatgtgtcccgtcaatagagccaacacaattctatacaaatacaaatatacccttgattaagtctttttatgtacaatgattggtttaactcaaagtaaaaaaaaaatcaaaacatgaatctgttcatacctcaaaaaaggggtgaaattttggtcttctcaagatatgatgggggtgtaggaaaggtggccgtatatatacacatgtaagttgtgtaactgcatcaagcacaaccccaaaatacttgcttattgtttgcccgctgtgttgaaactgatcttgcaaggtctcattacttgcattttttgctagtgcatacaagaatatagcaacttgttcttctactgagacatctcttgcatcagcaagtagttgtttctcacgcaacttatcgactaaagctcgaaaaacattaacttccatgcgaaaattccttttgcttaggctctgatgacctgttaagatttcattaacacgacaagcccctgaaagttttgatgtgtgcatcggtttcctactagatgatggttgtgacgaatctccttcgatggtagggagaacaaaaagcatgaactcatcttcattctgtgaccgtcgtcgataacttggatccatgacaatcacaggggaaatccacaacaaataataaatctgatggtttggt

SEQ ID NO: 93804 - DNA, 597 bp, Oryza sativa
atcgagcccaacgacgtacttgaggacctccccacttggtgaagtcagagtgactccggcccctgcacctttaaggttgagggagccgccaaaatgcataacccagtgcccagcacgaatgtcggcgtttgggtcctctccatctccggagagggagggaacgttggacggaacagggtcctccactggggtccactcccccatgaagtgagacaggacctggcttttgatcgcctgccatggttcgaaatgcaagtcgtactcaacaagctcgatggaccactttacgaccccgccagtaccctctcggttgtgcaagatttggccgctagggtaggacgtcactacggaaacccgatgtgcttggaagtagaggcgcaatttccttgtggccattaagactgcgtaaagcatcttctgggcctatgggtattggggattcacattccggagtgcctcggttacaaagtagacgggccgttgcacctttcagaggggacggtccttgttgtcaggggcaagagaccccgtgtgcccttgctcatatgccccacggggggctcgggtcatgtcaagactatatgcctctggaccacc

SEQ ID NO: 93805 - DNA, 508 bp, Oryza sativa
actatgctgtgcaacatgctttgaccaaccaataaggagtgcttgttaacactttagacaaatatgattaagtttgtggttggtggtaccataactgtgcattaaaacacggggccagacttcataccaaatggagtgtttccacagtacaagaatatggtgatagggaaccaacagcataacgtctatgcaccatcggtgcagacgatggcagcagtttcaggtctagtaacaagtgcaccgtggttgggacaaaggcaagtggataattcttatgttttgaccagagagcaaccacaacatgttggacacaacatcaattgtgtgactcaagagcagattgccgcaatgtttgcgccaactcaaccgactgtttagacattacattgtgtaccaatgaggacccacgttatccatgcgattaaggagtggacggtgcaacacatatctacacgacagaaaacacctatttgtcagaaaatgcatctgttggagaccagtttgtgcc

SEQ ID NO: 93806 - DNA, 5167 bp, Oryza sativa
ccacgtcaatgccacgtgggacgaaaaccaagtcaacactgccacatgtgcgccacgtcagcgaaaccgtcctccaaaaccaccaaggaagtcaaattgtaccggttttgatagttgaggggtcaagatttctggtattgctgttgagggatacgatttagattcggtggtcagttgagggagtcaaagtgatcttattccctatggaaaatcaggggaaggagcaaatgcctatgtcagcccacttgctctacatgtacacgttcaatagtcattagtatcggaaactctagggcttgtttggtttgataccaatttattaccctaccaaaattttgataatttcaatagtagcaagtgtatgtttggtttgctaccaaattttactcacaatagttcaaattgaatactacacaatttggtagtgccaaaatttgccaatgttttggcattaccaagattttggtagggcaaaaattggctccaaaccaaactagcccctaatgcacgatggatcgctaccgcgatcgggtagcgatcgcccaccctcccccctccctccctccacgtttccttttttggcaccgcattactttcctattttagtaaatttatacacctaaagtttatagacccaaagtttataaatcaaaagtttatatacccgattcaaatttgaatttgaaatatattcgattcaaatttgaatttgaattcaaatattttttatatatagtatttagtttcatctaaagtttatacacctaaagtttatagtcccaaagtttataagtcaaaagtttacatactcaattcaaatttgaatttgaatttgaattatatccgattcaaatttgaatttgaatttaaatatttttatatatagtatttctatacatctaaagtttatacacctaaagtttatagacccaaagtttataagtcaaaagtttacatacccgattcaaatttgaatttgaattcaaatattagtttatagacccaaagtttataagtcaaaaatttacataaccgtttcaaatatgaatttaaatttaaatatttatgatgtagtaggaagagaaaaaggaaagaaggaaggggggagaggagggagcgaccatacaagggaggagcgatcacccgcgcattaggcgtaccccattagtattctatagtacatttacaaaaaaaaatgttgaatgcatatacaactactcatattcatacatatctctatgagtattttttaaaatattaaactgcatatcttaaaataaaaaaaaatattttatttcttcaactaattcaatggacaccattaaaaaaaatctaatttttgactcggttcactttacttcgtaatagcatttctcattttttgttactctttatataagttgtattttaaactgaaccatacatgggattattatcaaagtttgttacggatgtttgcttgaactttaaattttgatgtttaaattagtcttaagtgctttcaacctacataaacaatgagaaaaaaaagaaatgttgaaatgtatgttgtaaatgcatgcaaaaatatgacttatatagagatttttttttaaaaaagggagagaaataacattaaaggagtaaaatgaaccgttttcaataattcgggatgtaaaatgagaaaaaaagtttagaaggtgaagtgctttggtgaaatagtataggggtaaaatagattttctcttaaaattaatgaaatcaccatatataactcattgtcaacatatatatcacctaccactaattagctgtcaatacaaattcctatactaagtatatgacttaaacccaacaaaacattatgactcctaacaaaacaaaattctagaacactttaattttttaaaaaagaaataccaacaccctattttattattagcaaacaatttaattataattttagacaaacaaaagaagaattaataatagcaatttaattataattttagacaaacaaaagaagaattaatagtacggacggaaaaaagagagaaagtttgacggatttctctacaatatgatcgattatgttaaactggaacacaaaaaattctattcaattatgatttttgcatgagtttcaaggaaaactaaattgatttctatattttttttatgaaaaatgcgctgattaataacacaaaaatattatatacaggtaataaatcgagcgcgccctaattttctagtctaatcttctaaagctggcaggcgttcctgcaagctgattggtcgattcgtcccccttactttggttgacacgtgtcctcgagcccgtcacgagttcgcgcgacgccctcctcgatgcttcatttttccgtgcgtacacactcgtgcaatcgtgcgcctcaggctccccgttgggccgtgcaactagcgtgggcctgatctgcctcgagatactacatgggagccaggtgctgtggcgtaagcaataataaaagcatataaaaagatttatactggaccatgttctaaaaagtacaaaacaatattctatagtgcagtcgtgtaatatatatttttatatggaaattgaactattttcaaggaaattttcaacatgatcatagataaaattagtttatggacgatgaccatctatcatacgcaacgctaagatcaggaaatagtgcaacggtatactagatcattaaatagagtgatggtatgttcaaaattatttggtggtgagcaaggcaacgtagttcagatggacagagccatctacatatatatatagagagagaatttcactaagacagacgaggaagcagacttgaaaaaagaaagaaaaaacaaaacaaaaataagatttaaaaatcattcatcggtattagacaactagcatcgacccagtattttctccccgtcaatcctccatgatccaaacaaatcacttttcgcccatgaaccgtttgtgccaatggattggtttgatcaaaaacttcaccaacattataaatttaaaacccattaaacaataagcacgggttataaaatgaatatactcgaaggtgagtgagagaccgtttccagcgaggtagatgaagtaggagacaaatcgaagtaacgcgagcagactattaatgcgaggaagatggtttctcatgaaattttgttccatgtgcgagtctcgaggagccgggaagcatgggaggcgcgcgggaggtggggagccggcgggtcggtcgccattctggcagcgccggcagatgagaacgctggggagtcaggagcgataacgacgcagtataatcggaatgggcctaggcagtggcttgggcttacccatgtatattgggctgtggttaacggtagggaagagagggactgcaatctgaaccattgctatttcgctgtggtaatttaaggtgacgtggctgcacgacaatacaggaaatttctattagtggggatgaattatataggtatataggataagagaagattcgaacgacggaaaaaaaacaaagagaaaaatgctgtgacttcagataaaatggttactgatcacgtgtatccaatatttcatcccaaggaacaagtacttgttcccttgttcccttgtatcaattctgattgaaaactagtttcacgcttatgcatccaacagaccaaagctacaaggtacttcgtgttggggaatacgcaagctttagctccatcagtacatcagaatttttcccttgaaaaaagtggagtacatcagaatctcaacactggaaatacctccggtagagataagagatcatatggagcatatcccgcagagacaatcctgctgccaaaaggccggccatggagtgaatgagcagccatgaatgaagcctccttgcacaagaactctacaagtatacagccagcttcgagtgcagtgttgttagaagccaaagcgttgtctctagcatctactgcaggtgccttggtgttgtcactgccagcaggatactctacgacatttatggatttcacagctccatacctgcaaaatcttgtccataatgtaagctgaaaccatcatgataagtaatacagcaagaatgcaagagaattatttctataccttgcacacttcacacgtacatcttccaatactgcatctacctcatattttgaaagcagcgagtattcctcctggtcaaactacatttattgcaagtttgtaaacaactcacatctttataaatgtaagaagtgtgaaaaaaattggttgttctgtttaccgactaaatgattttgatacgaagagagatatctattgggagagacttatgaacagagttaacactatgacataccacattttttagctgcaggacttgtgttggtactgcaagaagaggtttgggattggcaggaattccatgaaatgggcaagcttcattgccagcctgaacagagtggggtttaactcaataaaatgtataaggcagtaaatgaatgaatccaaaatgtcttaaagtttgaacctgcccaggatgatcagttaacacgccaacagcagttattacgcatccaccaagcttcatgccgttaaggccagcacatgcctttgatgtaatggagtgatcaatgtactgtgcatatcaaattgatcagaaattagtttgttggaggtatatccatatgctctagtttaggagtaagcagggctttccagacctcaagaaatgcgcatgctccaccaaggtcttcattaaaaagaaagcggtaagcagccaattgaccaaatgaactaactatatccctgagctgaaagaggaaaatgcagtaacttgtcagggataagagctttaataacaacatgcagagcgaagattactaggttatgcaaatatactggtggatgctgttatattaccatcttagatgaaatcactctaggaattccagcgatgaaaatctgcagagttaaaaagtgagatatccaatgaaagctactaaaattcttaaacaatcaaacccatatgtattccattagttcaaagacaaattttgctacatgacacttaaaatttgtgcaagttgttggtaggcatcgcaaacacatgtcgtagctgaaagacgctatagattattattggtaactagctagaggacactttcagcttaattggagaga

SEQ ID NO: 93807 - DNA, 2023 bp, Oryza sativa
cccatggccccatgtacattgccagcatatatacatcatattccatctttcactgcattcctaggttagaagcttttgtccctaggggtattctcgtctttttgaagaatttctctctccaattgagccaaaagtgtcctctagcaaattaccagctttttagagtgtctttcaaccgtgacacattttttgcgatgtctactaccaaattacacaagatttgagttcaaaataacagtaggcatatgatatgcatgtatcaaatatttaagccagaaaagcaagcatttctatctgtaaatattcttttaccaactctctctagaaatatagctatctttcatagagatgagaataaaacaactcagactgtggcaacttaccttgtgtggtgaatctctaacgacatcagatattaatttaatctcttcaactggcttcttagaatcagcatgctgcatgaaacaatatatataacacaagataaaataaaataagaaagattttacatgctatgatctgctgcaaagctgcaaaattcatgcaacagcaaaaataaaaaatgcaaaaggaattaagtatgctgaaaatatcagagtgatgttgaaaatcggacttaacccttaataatatttcttaccgacatgtctgaacttccaagaagatgccagatatcactgcatatggtaggatggttttgccgaacaatgtcgtcaacatttagctgcaaatatttatgttagaacttagtacagacaacctccatccatcccaaaacatagtgaactagtattcaattagacaccactacagattcatagtactaggtggtatctaatcgagtactaggtagcaatattttgggacggagggagtatttggctttcaacacatgcaaaatacatgtcaaaaaacattacctttattttattccagtgagcataagcaccacagacacagcgtacataatcttttaagcttctgaagtcatatgctggaattccttcatctttacgataggtttccatttcaaacaggagacctttaaagtcttgagttgttccttcattccaaggaagcttacggatttttgaagctctcactcttgacataaaagtgtcatcattcaacctaagtgatatatcctttgcaaagaagtttaccctcgtcatcaaatcccaaaaaagaggatgcccaagaacaatttctttaattgccggcaatgcagtcctgaaaattttgggaaaatgatgctctgcattagagcataaaatccaaatgctcaagtgatccgctacactatgttcaacggtataatgctacaatatcaaagtactgctacagtatagaacaattcaaaatccaaaggctcaagtgatctactacactatcaaagaagtactctgctacattataaaacaattcaaaacccaaaggctcaactgatctgctacagctacagtatcaaagtactagtgctacagtacaaaactgatctcagctaaagatgttgcattgtttttaacttacttatccagggttttcaatagagcagtcaaagattcaacatgtccgcagaaatatctatcacattgagcaagctttgagcttatttcagcagctctttctaaaatttcttcaagcattttaataaggcacaaccaatcggcccactgggcttcctccaagctcattgtctctgtaattcaaggagtaaatgtcacaaaatttaagaatgctacacagtgataaatagtacaaaacatgtaaaagtgagatcagtgatcagattgcaattacactatatatgttttaccttgttttctgaagttagcaagcttaacggtagacggttgaagatacaaaatcgaatcccaattgagattaccatgatacagtttgttcttcctcaagaagtcaagcccctcaatgacttgcctgagaaaagattcagcccaaaataaataactaaacaaataagatacatgcccagcagttatcattgcagacttgcggttataat

SEQ ID NO: 93808 - DNA, 902 bp, Oryza sativa
gctgagatgcccgatgtcagcgtcaaagaatcttggcacttcactttgtttctttggtggctgctgacattgcctatttcagcgccaactgatatggtgctgatgtttgttgtttcagcgccatttgtgttggcgctgaggatgcaaacactttgagccagcacagcaaactgctctctgcccaggaaaaatacatttaacaccgcatagcaacctatttcagcagcacaggaacacaacttttagaaaccatccatccattccagccattccatccatccagtctggggagccgttccaagcgccactcccgcgtcgttgacggtccgcaagagctcttgtgcctgtaaggttagaaagtgcaaaaagtcacaaaaattaaagcgagagcgtgcaaataacataacatggcaagtactcaccactctatcgcgaagaggtcctgtctcaaccgtggtaccttcacgggttcgagtgtcgtactcgttctgctcctccacatcttcagggtcgtccgctatgtcggctagcgtccaggccgggcgtaggacaagacgatagttcctatggagccacgccaagtatgcatcgaacttcgtcctgttgtgctgaccttggtccggtactccgttctcatcgaatttctcccattgcgtgatatgatcttgatggtagtaagtccaatcagtcaccttcttgttcttccgacgatcgaccctgcacatatgcaaaatagacaagtcaacaatttgaggatggcatcaaatcgatttggtctgttaactcaaagtacttacttgtggaggtcgatactagtggagaaacggtgcgggattgtttgaagcctcccgaactgccgcattatgcggttgcatagctggaactccactgcatagaagcaa

SEQ ID NO: 93809 - DNA, 10087 bp, Oryza sativa
atgaatatatgttaagtattataaagatgatggatacatatgcatacatacatacatgtatatgttaaaaatactatgaaaataatgtgaaggaagatgattggatgttgatttggagaattcaataaattatagatgatgttgcatgcttgcataagttttatatgtaattattgttagtggatgatgaagtggtatgtttgtatgttgaactttaggattagcgggttataactttatactaagatagaatatggagttataaaatttagaaaatgaattagaaatcaaacactagctatctaccagcagctacttaaaatcttattaagcttttcaaacagaccaagtatttttcttttttggcttcgtttctgaaccggagtctgggaatttttactagtaagatcatggtttaccacaatttatcttttttttttctgggaaggtcaaaaggaaatttaatgattgtattctgagctttcattttttttagcttacgtttttgagccgttaaccatacaaatataaaggtcatgtcccaaaaaaaatatttattgttttccctaaaaagagtatttcgtttggtttttctgtggcttatcaactgaagccacaatttagacatatgtatgcgcaacatatcatttagccatgcgcatacatgacaatgtatagagaattaatttgtgtctatgatgttgttcgaccgagctgaaatgtgtgagaatgtagggaaccttaagcataaaaaaaaagagagtagagaacctcgtacctgcgactttattcaatttttttcacggtctagcgtttggagccggaaattattctagcagttgcattagcaaaaacacttatcaaaatattactaacaggcagcgaagcaacacaaatacatcttagctagcaaagtagttgcattagcaaatttatttaccaaaataccgaacttatgtttaccaaacaaacaacatatgtttaccaaactttaaataacaccaaatctcctgtttaaaatttgcattagcaaaccatccgaacagatccgaaatgcacgttgacgaatgcgcgaaagcattaattgttcagaaacagcccctgaaggctgaagcttagtacggtgtgttgcgtccagttggaacttggaaccacctctttccaatcttgtccccgttcgtccggttatccggtgtagtgcgccagaagaagggaggaagggagagggagaattcgggggaccacattccaagttccaacggaggccggagaggatggtccatgtctgatgtctccatgatatccgtccgtccaacggagggacggccggatgggttcgccgtgtaacagagccgtacccgtccgtacacggtacatctactccaggccagtcgtgctgtaatagtagtatatactacctccgttcaattttagatgaatgtcctaggatacgttacgtccgtctaaaatctcttatattttagaacggagggagtaaataactagaaaaatatgcttgtgttatagtgaaaaaaaaattaaaattattgagcaatattaaaatctacttgtttagtgctaagcccttcgttcccttttctgtggggctcaaacagaagagaactcatttgaactacacatatatgaaccaccaatattactccaatgagaaaactcctgtgtaccccccgaaaattcacctaatcccttatatgcccttaagatttactcattctctttcatgcccctaaatttcagtttggatcctttctataccctttccgttagttgaccgttaaattcttatcataaagtccatttttccgcttgaaattgtgcatgaagggccgaagggtgaggtgggtggttcgacctcgaaggttggttcagcacgactgtcggccggaccagcgccatggttgcttgaggggctggacgcgtgaatatggtcagggtcggctgaaccaaatgaggtgaaacctaattgacttgggctgccgtggtcgaagcttgaatcacttgcgtcactgttgagggtcccgaagatggattgggcctcgccgaagccgaaggtgctgtcttggcttgcagggccgcctcataggcttgatgttgctcttgcatccggtgaagtgtgtcgtgcagccttatcatgttctggcgcatggcttccatctcggccctttgcgccgccggagcctcactctcggcaaccgcctgagttgtgcttgggatgatggaggccatcgcctgagtcgaagcttgagtatcaggacttggatggtcgaaggtgctgcttgagtccgagctagtttggccactgcttgctcctcgccaccttcaccttcttgtagctccgctcctgcttcggctcgtgcgggctcttcgcccgccatctccgcttcgccttcgctctccttcctcttaggtgcaactctctctctctctctctttgtgtgtgtgtgtgttttcttcggtgcatcagtggctccgccctgggttccctacggtcggcgctagctattgtcgaagcgacaatagcttcacattgaaggacgtgatttactcagtggagtgattgaacagtaaaacaatgtattaacttatgaaaatttgttgggatcccccattacatgcttctagtgggctatttataggctcagtacaaactcatgctctgtagggtttaatatgtttagagaaatttacatggatacctttataatatatataaactcatgcagtgtctattctaatgatgggcccctagatgggtcattggcctggcccataagaggggaatggtcttcatgggccatgctgcttggtgggctccctggtgaagcctgtcttccatggggcgaacccttcatgccttgcccagaggagagactaggtggtgagccttctcagcttggtagcgaaccctcttggcttcgtcttctggcttcacctcaaaacttcgcacgaggcaaatcttcttctgaacttggttggcgtcttgctgatttgatgatttcggtaggttcagctgaaaaccctcgtgacatgcctccggcacccatcttcctcgtgcaccacaatggtcaacgacctcctggatgctatgctgtctgtggcctctgtgttatgtcgggcacagtttcactgtcgcctgctgctgcagactagcagtgatcgatggaactactccactttttccttcgagctcaggcgttcggggccggggcaccctccgatggcatccagcatccctcaccaccacccgcgtcctccctcagccgcagccgtagccgcgctccggcggtctcgaccaccgccctggcgtcgtccttccgcgaggcaaaagacgagcttgatcaggaaacgaaaggcgtcgtcaggtggctgccaccaccatctgacccatcaggcccagtaacagtcggggcgcggtggcacagcagtggcaggcaagggaggcgatgctgtgctgcttgccggagctcctatcgcaagttcgtgttgccttgcagcaacttggtggccctcagtcttaaggtagagaagatcagagcaattataactaattaagttgcgtttttgctagtgatctgacgcgtgatttttttctcaggtatttcacgttttttttttgccgcacactatgtgcgccaagatttgtgcaagaattggtggccaaggctacatgcgttgtgcgttgtatgtttaggcccggttttttctaaataaaatttgttttctttaacggttgaaaaattaagatatttggaactaaaataaaaaaatataaaattatagtcctatataactaaaattatatttgtattagtgattttgttgagcaggatttgatggtccctttttttagagggaagttttatgcagtatgaaaggttccaatttcactcaaccattcatgatgtcaattaaccgcaaaactgtagtgcagagcacatcagaataatactgttttatcttcacccattgcaacgcatgaacattttgctaataacgatatttgttgcataataacgatataatagccaaacatttcgtaagtttgaatagaaaagaccttggagttcaagcctaattttcaaactaatgaaactttcatagggagacgagagaatacgacgctgttagagcaagtttaatagtatctcctgaagatgaagataaagattaagtgtttcacacaaaacgaggtggtaataacgtgtgattaattgagttttaattattacaaacttgaaaaatggattaatctgatattttagaacaactttcatatataaagttttcgcataaaacacaccgtttagcagtttgaaaagcgtgccactttaatccaaaattttatccgcgtttttaattggattcgaacgggaccacttgtcaactattagctccaatttatctatagtcaatctaatagtccattcatacaatagttacatactgcattattaatacatggtcacacatgtcatacacactgcgtcttggagtccagctgactacaaatctgtagccctttgttcttttctctcctcatatatctccttaaaatatatttatatgttcttttctctcctcatttactttcttaaaatatatttatagcaagcttatagcctgctattatacctactcacggctcacgggatcttttacggtgtattcgtcatgttgatgtcacattcctttttttaacaaaattaatgtcgtggtaaaatatagcaacttgaaatattccaatttcctcttagcttgccatgcatattttaggaccaaaaaagtatgtgatatctgagtatcacagcgctattacatgtagttaccaaacacctagttaccatatgcaagtatcatggcatttagctagtgtaccaaaattttagtttaaatcattatacaactggatggtctccaaagcagacagcgaacatttaaaatgatgaatgtattgtccgcatctgaataactgaggtatttggctaatgcataaatttcaattaagagccccatcgttttggtggcatatatttacaaacgaaaaataatttgtaaataaaaattttatatgcacacaaaggctgaaaaataaactataatgaaaaaccccccaaaatcaactccaattttaagcttcaaaattcaaagactaataagcattaagcataagcgaaaaaataagaccgtaacattacactgtaatagggttgcccagtgtaacacgggataaaagtatcatatctcaacagaagataataaataagaaatttgataataaaccgtagcgccaatatcctttcttattactaataatatactcaaaaagatttcagccgccatttgcttagttgtccatggcatgcattgcctcgctattgtctcccctgggctgtgttgtgcagtgaccttctaggttcttggctctggtcctctgcctatataagcaaatgatacaaaaagaactaaaatccacacattgttcccgttatagtgatgtataatcatatacaactgttgagaagtgtatgcatacttttggtaatcaaaccgatatcttctgcgatttttatcttgtttctggcgtaatccaaataagtctgtggttttggaatctgaagataaaattcgcctccatgttagcaaaataagaaaaatttggtgaaggcactcaacaccataatcaactaggaaagaaaaagagtctacttcaccccttaaagtaatggagttggtctacttaaccccgtaagtgtgaaatcggatattttagccccttaggtatgaaaaccagctcaaataaccccctagatggtttttaaggaggttttgccatgtaaatgatgacatgacagtattattatttgcatggcacaaatattagtccaaccctttacgaaatttcactcgctgattggtatgcctaaaaattatatattagcatcaatgtatattattctaaagccgttcaacttattaaaaaaaaaacttagtcgagtctagctatcatcatgtcattagaccctccatagtaaaaccaccgccatatcatcatgcatgttcacagtaaaatcgtctacaaaggagttatttgaaccgatttttatatttcagggggtagaatacccagtttcatgcttaggggatcaagtagaccatcctcaatactttaggggtgaagtattccactaggaaaatatcacctataccccaggatacatttgcttgatagggaaataaatcaactaaccatttctataatggcatctttgatcaattgacgagcttccttttctggcacctacacatagatgttccattagtgtgaagaacatatttcagttgagcatgaacctcatgcaaaaaagtatatgcttaccgtttcatcaatgcaagccacgtagagatcgtactgaacaacagaaagaaaaaagaattaaaaatggatggattgatgagttgtaatcatcctgatgtaacgaaactgagaagaggaacctacattttccttcatcgaacggaatctccctcgagtactgcgaagctcatccttaatatcaacattgcgcaagggaaacatatcttctctataaagttctgacagggcatcagtgaattccatctgacaaaagatgaaatagcataagtatacatcactaagaatataaagcaaagaacgaacagaaaaaaaaaagagcaccataagctgcgtagttctgcacattgaggtaatctaaccttctgcttagcaacccgcttccaaacctcaaaatacacaccatcaaaatccttgtagttacaacaatcaaaccgcatgctccatatatattcctaaattagaagatagtactattgttaaataccatcaccacttatgcttgccaattaaaattaacaggaggcattacctggaaagcagtcataacttgcattagagaaacaacacgaatgcgtagtgcgatcttcattgcttgaaggtaaactgtatttttaactttgtcccactaaacaatggaaacagttgccattaattgacgcattataacataaatatacattgcacaaatggcttttgggatggttacctgacccatggttatcttatcctcaacagcaatgagtaccaaataatcttgaaaccactgccatgtgaataaatgacatcagacaaggatgattagatggcatatggccagtattttcaccttgagtcagtcataccttagtcttatgtgctagctcttcacagaatttgacatatgctagatcactctcataggtactataatttgagtggtattgatcccagtccatgtacaaaccctgcacaaagaatacattgtccattacttgcacaagtggcatctactaggacacttgtactaacctaaacagtatctacaacaagaatataccaaatgcagaaatatggcacttgcacagaatgccagcttgcaaacaatagtatccaacatgcctgatgatatgaactaccaagttagtttgcggataacatggcaaaaagcaagtttcatatgcaaatcctactgaatatatcaatagagtgatctcaaatgagtcagtcaacaaacgaagtatatctctaatcaaatacttatgttccttttatctctaatcaaacatgtgcattcaacatttcaaaactttgatgccattagatttgctacttttgtcaacgaaagtaaccacaatggctaaacacacatatgcagacctatcattgtccaaaatggcagacaaacaatgttattttgattctatctctccaaattataaatgaatgggcatttgatggtttgcagttgcaagagaacattgattaggataaaaagttaaatactaaggcccaggggtgaaacggaccaaacaaaaaattaatagaggtcagatcagcatccataaaggtcagatagggataaaaccgagactgctctcatcgatgcagggcttgtcctgattgctaggtgactctgatcaagctagacctaactttcaataattatgtattgcttgattatacagaagtacatgtgccgcttaacttgtcccttaagaatacaattgatatctacattcataacaaactatatccataattcctaactaaaccaataccttcctagctactccctccgtttcatattataagtcgttttgacttttttatagtcaaacttttttaagtttgaccaaatttataaaaacaatatagtagcattttttaacacaaaacaaacatattattaaaatttattcaacgttacatttaatgaagttaatttcgtgttttagatgttgctaattttttctacaaagtcagatttaacaaagtttgactagaaaaaaaatcaaaacgatttataatatgaaatagagggattacagataccatactaaatatctatctctatcctaggaaagtaattgatcatttaggcactactccctccgttctatttcatatcatagtcgtctgacttttttcttagtcaaacttaataaagtttgacaaggaaaacaagtcaaacgtcttataatatgaaatggagggagtagatattattgttgtccaaggtaaactccctaatcctataaatgcagtacgcatttcttttcatataacagtataaacgctcttaacaataacaatgttacaaaagaatgtaacataactagcccaaattttaacctttacaatattttcgtttaattaagtaaattaaaattgtggtagcatgggtacagcaacgcaattgattataccaccaagtactgataaaaataagcatttaagctagttgtcatggaggagtcaagtgccgatacctacattatcacaaagcactagacgctggtagttatcaagggcagcaggctggaatcgttcaggatcaaagtaccattcaagactatcctcatagtactgaaagtaccccttctcataaagaatggagggagggtacttctctttcagttttgcaatatccagttcgtcaagctttctaccatttgataactgcaacagacaataggaaagtagtttataacaagcagagagatgcatcaaactaaaatatacataactttactcatcccaggtgatgataaaagatacctcataacctatgatgcggtagaaggccagctgctcatgcaactcagtgagctgctgtggcccatcgcattcaagccaatcatcatcatcatcatcatcaagatggtcctgaacatataactgatgaaagtagtaactgactttgtttgagatggtatcctcatccatgccaaggagatcttctaaatcctccattgattcttgttcttgtttgtgttctcgtgaaatcttggcaaggtccccagaagatggttttggctccccctctattgttgatgtgcttgttccatcatgagaagaggatgggctaccactgtggcatgatagattttctgtggattcgtccatcttgcgcctctgcctcttcttctgtttcttcttcttcttcggcttgctaatttcttgttgacttgaggatttaacatcttcaatgctgtttttcttctgctgtgcttcatatccaatatgcttgccctttcccttctcagcagtgggagaagagtccttagctgcttgcaagtcaaccttttccttaccaggaggagaaccataggcttcaactgcttgcaagtcacccctttccttatcgtctccctgtccatcagaagctgaagctgcagcagaggcttcttctctggattggctagcatcgtacgtgggtttggtttccagctccttcgtgtgtgacaaatccatcaccaactccggatgcaagtccaacctcgtccttttaaggagccacaacaaaaatttccacctgtactcattccactcgcatacatacctcaactccatacatattttgtccataagcttcaatcgggctataacaccgccatcctcaactcgaccaatcaactgacccctcagtagcctcaattggattagggaatattgcaacatcttcatagcattataattcttcttcttctt

SEQ ID NO: 93810 - DNA, 723 bp, Oryza sativa
cttaaatagggctgccttttggtgaagaaagctttgggtgaggatgctacactagtatctagctccggccttaaggatgctatacgagtttctgatgctttaaaaaatggaaatagcaataagggactgttttcatcatcccatttaagattgtcccaccatgttttctgccccatgacactctttaatttgacaattgcatgcccaaaaggcagccttctcagcttcggacaagcaaacacatcaaagtattccaaagaaggaaggtctaggctaaagttacagaagttttccaagcttggcaacgaattcaattgcaaaattctcagtcgtcgaaatccctggattggcatttcatcttgtacttcagtattgattttattctttatatggactagctgtttcattttattgcagaaagacacatccaattgctccaggtgcggtagtttcagaatgcaggacatgtccatcagttgatgggctttccctacataaaggacacgaaggttctgaatatgccccatactaatcttctcaattcttggaagatcccaaaaggtgagaaactctagcctcggaagatgatctccataacactgtggcttgtttgtgacagagaactcctttaattctgaacagtccgttatattaagaacaaggacactatctggtatagtgagcgcaagagatgtctcgccactcaatttatatagaccaagc

SEQ ID NO: 93811 - DNA, 6213 bp, Oryza sativa
cccgcgaacccgcttataggcaaaattagtaggtaacctacggatcacctactgatttgacttataaatgggtttatggatcggcccacttgtatctctaagtgcagcaagccgaatcacgatatgaaaacctacgggttatcacttatttgacatataagtaagttcgcgtgttggcccgctttcatccctacttcttctccctacattctatcaattatgatccagcggagtagaggggactcaagtcccccagcacccacgctgcactgacacatgggtcttatagctcgtgggccgacatgttagcaacctacgacagatgatagtatatcaaaggagcttctttaataggtatatatatctctctatcccgatggcttgtgtttcatttacttaggcaatgtgcatcaacatatgaatattaaattttgaactcgtttattgtggattattaacctacctctacattattccctccgtccaaatatatatgtggcgtattttattcgttaagaatataattcccatcacacaaaatcgatgtctttagatttgtattcgaaatatttatagttacacttttatatcacataaacggtatatatagggtaaaacaattgttagtcaaagtcttgccaatatttttggatgggggagttgtatatatcagctagcttagaatggaggaatttattttagcaaatggtgtggtgggaaagtcatggcaatgcacatgatttcatccaacagtgttcaaattctaatttctgtatataagaactttttactgtcacttgaaaggcggtgcattagctgcataccggcataacaatgatttgtaaaacgaaaccacacatgtcacgaagcagattaatgggttagtctgcattaaaaggaggggattaattactgtactttgatccgtacttactattgatgaatgtaggaacagttgtttaaacagtatttcgactagtcctaatgaatctgtaagtaataggaccggcaattcattcatagtgagagctgtagaaaaagattgcaattattatgcttaagattgattgacctatttgcctttcgccgtatggatattattaagtgttagcaagttgcaaggcaaggacccagtcattagggataatattgccaacacgtactacatctctatgcacaatccacataaaggattagtgctaattatttgcaatcagtacatatgtacacctatctgtgggaccataagtgcaaagtccatatatattttgtggttactgatgcgctagctcttaatttagtttataaagatctcagaaagttaaggcagaaatggtacagtattcatgtttaggtggccataatgtgtttagtttaggtgtaatgacaacccaaagtgatcatatctgtatctaaccatgaaaatgacaccagaatagatatcaacaaaaagctagagtagccaccaaataaccacacgaaagaaaaggaggggagaagaatgtgtgaatcatgtcacaaaaaaggtcaccattctattggctgagtgggagaccaatacatgaatcttccttgagatgacagctagccctattaacaataacttggctttcacctagctgtgaccatatatgtttagtgttttagtattgctctattatgatatactactagtaagacaaagtgcttttgcagttgaccattgtgaagtagtggaagaacacattctaagctacaagtagctagatatatttatgattctagctacttattaatacatacttacaaaataagaaaccatgttctaaaaaaatacaatcaagaattctggggttaatgagttttggaagtatatgtgctgctagcttttgggttgagtcctcagaaaggtcaaaactgttatgttggttttggtgtgtttcaccaacctttatattcatattgacttttgatgttgaacctaagctaatctgttactaactttgcatcagtactgaagaatgtgtatgcatgtatgacaaatagggtacttgttaataataagacatccatttggtggatatatgtactatatctgcaaaagcatacccatgggaatagaacaacatgctcattgctgtagacctttcaaccctgatctggccaacttgtcttcaaaaaaggcttttcatttttttttagtaaagaaaaggcttttctggtagaacagaatagtggaggttctccagttgcatttctaaaatgaaaccttgcgtcacaagtgatccaaagcaaacatttttcttcctctaaaaaaagtcaattgattcacatgtattatcttgatctcatctcaaactctcttaattagcagataacttagagcttagagaactttaatgatagtgacggcagcattatgcaagcgcattacatcttgagtagaaatttctctgacatgttcataaatcagatgctgcaaaatcattgttcttgagtagaaaacccaacagaaatgatgcaaccgcagccaaattcaagacaatattgtgatctatcaacgaggtgtgagtgtcgtgtgaactactcattatgatcacatcgaatcctgacctggacgtgaaacatcgttattcatcagagattatccaactgggttagacgttgatggcctaaaagtgaggtcaagctttcttcactagtacatccatcatatcgtatctttggtctgtcgctggtattgcatactttatccttttgacaactgtcttgcaggcaccaaactttgctttttgaccatgggggtgggccagtctgtaaggacctgcagaatatatcactgaatttggtgagagatgatgaatcgaagctgaatttgcagtgtattcacattcagtgtagatacacaaccacaagcaaagtgacagatttagctgataatagaaagacgaatctacatagtatcaatattgagtacatcagcaggccaccattagcatcatcctaaagaactgccagatatatatggaacgaagagaatggtccatgtcataaggtgatagcttactccaaagtgatgcagccatattcactgttatgaagaagtgtgctctgtttggcactcccaaccagttcctctatgataagtagataacagcgcaatttaattgtgtacttagtgcatgacatgctgttgtgatactcatgccgacagctctaatttctcaaaatgatactgctcgccagcaactacttttagaagctgagaatatctaccaaccgacgttgctttatggaccacaattagctaagaacataagatgtgtcttattggccacaaaatgcagatcaatcctgctgttggagttgagtactaacaacttggcatttgtttaaattcttccagctaaagacctttagtctccaagtgtttgcaacaacatgcctcataccatctgcaggatgtctggatcagatccaagtgccataaagcataaacatggaaactgctaatgcaggtgacaggtgatcatccacggagtttccattcaactgttcaagaaatccaaatgtatagaataggggtctagacagatgcaaaatacaattcgtagtcagcaaatgagttgatgccacacaaggtatcaccctgttaccttgaagcctccatgatcataaagaacagtgcctatattatctccagtctcatcatcattatcatcatattcactaggattagcttcttcgtcagactccgaagcatcagtgatatcagagaaaccatcgttatccatatgcgataggtccttcccttgactcggttcttccattttcagagaagcagctcttctatcatcacaataaacaggatcaacattctgggattgtgggtttccataaagtgcaatatgccgataataaagttcaagctctttttcagacacggcaataaaacgcctcactgtctccagtgattgttcatattttgatttttcaagtgcctgatgaaaaaaagggacagaggtaagtgcgcaaaatgatgcatagaaaacatcagttatctggcatttctacaagctaccaaccataggcaataatccatctgagacaactgaactgggtaaacagaatcaacaaacctacctttttctttgatagtgtatcgactggtgacatgacatctggctgaacatagttctttccccgatagaagactatggtgtcatttccaatagtattaatagggataccaccactcagtctggctatctcacttgcgtactcctggatttgccctggcttgcagggtttgcagatgacttttacagtctcatgtttcttccagtgcaaatgcatgtttagaataacaccaccaaagactcctctccttccaacagggacataatttgactttttttgagaaaccttcttcaaataaaatctttcctcgccatcaagatcatcttgtttagccatagggccttgtgctttagcaatctcatacttctttaacttctcaaccaacatagcttctttcaatttggcctggaagagaaacagatagtcttagtttgtactcccctagaaacaaaacaaagagaaatcaagcacattgtcttccaacatatttagcatatgtacttctgaaagttccttggaaaccaactacttctaaattctgattatatcatagaaatagaagaagacaaattatgaaggaaagtatattggcagtgaattgaagctagaatgcttattcaaatactgaatggcaaccagcaatgtcctactctgaatgaaagatgcttaatttgattcattgattgtaaagattgcttcaacaagaaactagtcgagcaaactaaattaagcaaatatgtaaaaagacataccttctcaatcttgtatttgagtcgagcttcaggtgtagaaaatttctgttttatcttctttcccttgggtctgatacgccgtggatcatttttattggcctctttcctcttcttcttttccctcttcctctgaagcttcaatcgcttctttgtcaaatacccccgcttcttggaaggttccacctcctcaatctcaaacttgggtttcccatcatcagatagaactagattgactgagctatggctagcccatctaaccatccatggaggactaaactgataaaagggatttaagcatttcccaaatgaagcaatagcaggcctgcaacaagtagcaggaaaaaaataccagggaaattaaacccgaattgtcattggttacatattactcacatcatgcttggtaagctacacggagtaattttagtgaacaagtaggcaactcttgccaaatgaacatcagtgctatattctttacagaaacaacaatcgtttgggaggaaactcctttatatgattattggaattaaagttgcacacatgcttcatgttgcatacatcatttttgccgcctgcagtttccagctcctcataaacaaacacctattcacaaattctagtagtaataatttggtatttctcccatctaaccaatgaggatgtactcgaggatcaggagagaggagaatcgagtaacagatagagttacctgagaggttcaggggaaggcgagattggtgccctctgggacagattgaggagtgagaacgaagccaactttctcaggttctgtgacaggacgcgggtcgccatagcccactagtcctatgccaacgcattgaaaagtggtgtagtcaggaatattttgttgagtgtgcctaacttcatataccgaaattttctaagaccgcaaatcctgtatgaaagtacaaattttagttaaaagtgtgatacaaatataggaataatatctcataatatcactaatcgacaaaaaaagagagaagatcatatataaaaggtcttacataaatatagcagattcacatagaacaaataagatgtgtgtgacagagggagagagaagcacttgtaggttgtggcatggccactgtcaatggtgatcgcacaaactcgtcatgatggaaataatgaatataatggttgtaaatacaagaacatatcactagaacggatgataatttaaagatctccgcaatttcaactctaaaaggtagtgaattaaaaaggcatagggtctggttattaccattgactcacatatacctaggttattactatggcatttgatcgaacacctttctgtcatgaaaaaaataat

SEQ ID NO: 93812 - DNA, 715 bp, Oryza sativa
atttttttttctgcgggcttgaaaccacaaccacagcaactatatgggctatatgagagtttatcaaaaatccacatgcagtggagaaagcgcaatcagatatacgaaaaatccttggaggcaaaagcattgtcgaagaagcagacatcgaagggcaacttcattactttcaaatggtgaacaagagactctaagattgcatcctcctgtgccattgcttcttccaaggttatggtctgaaccttgtaaaatcatgggttatgacatacctcaagaacacagcaatatttgtgaacacatgggcacttggtagaaaataaaaaacactggattgatgcaagtgagttcaggcctgaaatattcgaggatgggcatagtcgatttcaatggtttagacttcaggtttcttccttgtggtgccggtcgtaggatttgtcttggtttgatgtttgaactttctgatattgagctcacacttgcgagccttctttatcattccagctggaggttgccaaccagatcatactctaataaactggatatgaccgaagcaaacgggatcacaactcatcgtagaattgatatttggttagaagcaactccttttgttcctagaggctaaaaaaatatgtggttggtttgtgtttatacaattgtactatcttttaaaacttatgaaccatggcgttgcggttggatatcctaacttatatgt

SEQ ID NO: 93813 - DNA, 1361 bp, Oryza sativa
gctaatttcttgttgacttgaggatttaacatcttcaatgctgtttttcttctgctgggcttcatatccaatatgcttgccctttcccttctcagcaggggagaagagtccttagctgcttgcaagtcaaccttttccttaccaggaggagaaccataggcttcaactgcttgcaagtcacccctttccttatcgtctccctgtccatcagaagctgaagctgcagcagaggcttcttctctggattggctagcatcgtacgtgggtttggtttccagctccttcgtgtgtgacaaatccatcaccaactccggatgcaagtccaacctcgtccttttaaggagccacaacaaaaatttccacctgtactcattccactcgcatacatacctcaactccatacatattttgtccataagcttcaatcgggctataacaccgccatcctcaactcgaccaatcaactgacccctcagtagcctcaattggattagggaatattgcaacatcttcatagcattataattcttcttcttcttcttcttcctcctcttgagctgccgatcaggcctcgcttcgtcaccaggcgagcggtgttggccccgcttcccgtcgctttcctgttgatcagcgggtgcatcttgtccggatccgctagcaccgcacgcgggatcaggttcctggcaataaatctgccaccgcttctctggatcaagctgcggcggcgtcttgagcatcttctccctggagttgtaggagcaagcaggacgtcgaaaccctaatataacaagcgaaaatagtagtcaagattaggggttggcttcaggagcaattcgagggagtcggcggagattgatgatataatatttagggggggaacgagtgggatctggggattgtggaggcgatacctttccggtcttccgtgtgtggtcggcaccagggtttcaaaaaccgccgggggcccggttaccgccacccggcggtacggcggttaccggcggtacggcggttaccggcggtaaccgcggtaaccgcgcaaaaccgcgacaaatttacaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaacgggccggcccattttttttctttttccaattttcaaatttattctccgttttgctctcaaatttgaataaatattactcttttttgagaaatttcttccccataaaacactataaatcaagcactaccttcactattttttttgatttttttcttttttttttaaatttttgaat

SEQ ID NO: 93814 - DNA, 2799 bp, Oryza sativa
  unsure (1)..(2799): unsure at all n locations
gctcggtacccttgcttggggctgtttctgtttgataccaaataaccaaaacttgccctaccaaatatttgccaatttaaaatagtatctgctagatgtttgaattggtgtcaaattttgccaaaactaacacaactgatgcaaccaaactctatatgaaaacttgttcagtaggttgggcattgaaccaaataacggccctttgctttcaacatggcacataatttgcttccggcccatatgaatgttggcagcccacatatatatgggtcgtcctacaacagtgcgaggcccatcaaatcatgccctccctacaacaccgcgcgccacgacgcccactgcaccgggtcagcccattgacgcgacgcggaatcggagcgaagaaattcagaatccacgggccgcggtcgtcacggcaacatccaacgggaagtgcgcgtcacgtnccaccggggcacgcacgcacttcgncgncgncaccaccaccaagggtctaggctccaacccaggcaggcgccgcccaccttgacgaggaatcacaagaatccctcggccgaatcccgtggattccaagtttccaaccattcggcgggcggccgcaccaccattccacccgtccacctcgttgccttcgccctctgtctcccggtcttcgcttcccctcgcatccgcgtctccaaaaacccccaactttgcactgcaccgaccgcgccgagaggagagacgagagcccccgagaccgcgcgccgccatggccttccactacgcagcaatgccctcctcctcctcctcgtccctttcgggcgtctccccccagcccccgcttcacctcccccgtctccgatcccctcaccaagcgtcccgccgcctctccgcgctccccttctcccgcgcgctcccgcttcccctccgcctccgcctccgcattccccgtccccaacttcctccgctgcccctcgcgttctcccacggtgggggcggagataacgatggcgacgataataataacaatggcggcggagatggcgagggggatggcggcgcgcccgacaaccggagggaggcgctgttcgtgctcgcgcaactggggaggaagctcgagagcctgccgtccgacctcgcggccgccgtggagggtggccgcgtcacgggggagatcgtgcggcgcttcgctgagatggagggctcggcgctgctccggtggctgctccagttccaggggttcagggagcgcctcctggcggacgatctcttcctcgctaagcttgccatggagtgcggcgtcggcgtcatcgcaaaggtcccatgacgaattctccctctacgtacttctattttggcatcattgcactgtgttatgttgccaatctgacgttttattcatgctgctctcgttgtttagactgctgcggagtatgagaagagaagggagaattttgtcaaagagattgatatcgtgattgccgatgtggtatgcttctgaaagtatttctaacaatttctgacaataaaacaaaagaatctagctcgatgtgatttcacttgtttggtttacattgggtgttactagaacaaccacttatttagcaaataattaccatgtggtataccgcttcatgttcagatgactagtactctaataacatatacatcatggaatttatttattgacctcgctttgtaaattagtcgctaagatcgttagctgatagacctttttttaaaaaaaaaaataatcatatgctgagtattatgttatcaggaactaataaagctggtgatctaaaccaaatagacttgaaaaaaaaatcttataatgtggtgatgtttggttttggaactatttctgaataatactaatagatactatgtggttgattaactgaattcagcattgaggtttgtactattaagtccatgtgagtaccacacctgattctagttgctattgaccatgagcgaacctatttttgctagcctaattttagtttaggaagagagtttatctcatgccatgggttcaattttactttctttctgaaggtaaatggataatgaaatttgaagttttttttttgttatgatttgtgaaatctaattttgtgttgcttctgatactacccatacaggtcatggcaatagttgctgatttcatgcttgtctatcttcctgctccaactgtatctctgcaaccaccacttgcaacaaatgctgggcatattgctaattttttccacaattgcccggataatgctttccaagtaacctaaactttctctcttttcatctgagtagaacattcttcctagaatcctccatgttttgctaaaaacacttcatgccaactgttctccagattgctttggctggaagatcatactcaattctgcagaggctaggggctattctggtatgcagttcttttgttgtggttattatgatacttagaccgtcggactcatagtggcctcagtctattcagtgtgctatattgatcaactaatgctagtggcttctttgcagagaaatggtgcaaagcttttcactgtgggaactagtgcttctctggtaagcttgccattttggtttgctgctacatcatatgattgtgatgatcatgtgttagcaacctcttttgatttgtgttagggtttgcatttgtttttattttctttgagcaggaatcctgtcatgaagttttaatcctgtcatgaagttttaaataaaacatttcagcaaggcaggaataaccaatgcgtcctggtgttttcattatgtctacctatctctgtcgttaag

SEQ ID NO: 93815 - DNA, 3446 bp, Oryza sativa
  unsure (1)..(3446): unsure at all n locations
cggtagttttcaagttttcactacatatgcggtttgcactgtatatttttccgccttatatagtggtgtagagagaaaaccttatagaaactagaaaaacaacaagtgtgatgatatagcatgacaacacataagaaaggtgtaatgaaagaggatgagagggtgacggcagctctttggcaatgcaagcagcaccatgtgcaggtatatataaaatggtgcggggcagatccaagaaaggataaaaggaggggctaaacaaactatacaaaactatagcacccctcttctaatggatatataataagaagtggaggctcctatggttacaacgccggcaatgggggtttaaggggtcaccctaatgggcgactagtcgcgtggaggcacagacgcgcgacgagcgctcagtctactagtactactgactactcttctactacagtactactagtcttactagtttactactacagtactactactagtagcactaatactacactactattactactactgttatactattaatagtattactactataaaatatatatatttttatatgtactatatatttttttatgtataaaaaaatatacacatatacaaaatttgtatacggcgtgtacaaactttgtatatgtacatattaaaaaatgaaaaaacaaaaaaaaacatcatgtatattcgtatacaagtatacaaactttgtatacgatatatataaagtttgtatacacatatacaaactttctatacacgtatacaaacattttatacgtatccgcatatgcttaaaaaaccgaaaagaaaaaaacagaaagaaaaaaccggaagaaaaaaaaacaaaagaaaaaccgcaaaataaggaaaagaaaaaaccaacggaaaaaaccagcgggccccaccgtacagacgcggctacgtgctgccacgcagccccctccgcgcgcgccacttgcctcgccgcgcgggggcgcgcgcgcggatgattgccttttagcccttttggggtttgagaccccgtatatctcatggtggatccgccactccgtaagcatgttgtgggtgctgaatggtgagattggagaaggggattaatagcagctagggtttaattcttcttcttttttttagaaaactagcgtttaatttggaggagcagtgagtgaaggttgatgggccagagatttttctgttttttttcctcaagataatatgggcctggcccatttactaaggttggtggctagggtttcgaggaaaagatggtgtagtgaaagaggacgtccgtctgatgttgatccaacggctgcaaattagagtgggtgatcactgaacatgccagttataaccaagacaaacctctttaaatttcagcgacgcgctcaaacactcacctgcgccgcaacagtttcagacacgatctcgatcgtgtctgccatggcggcggcggcggcgcctgactggtccatgctcccctccgaccccatcgtccgcatcggcgactgcctcctcgccgccgacgacttcgactgctacgacaacctgcgcctcgtctgccgcatgtggcgctccggcaccgacgacccgaggacggccgacttcgaggacgcccgcttcctccccaagaagctggccatgctcgagctcgacgtcaaccccggagaccaccgcgccgccgncgtcgccacgttcgtcaacctcgacaccggccgcttcctccgcaagcgcgtcccgggcctccgcggctgcttcctcgtcgccgtcacgtccgccgccctcgtcgtgctctccgacgcggcgccgccacacgggacccgcggggaagggtcgccgtttcagggcgcccatccatgcggangangaggtgagggangttgccctgaagacgttcgcgctcatggtgttcgtctcgtggtaccaagggaggtccgtgaggtgggttgatcaggacaccgagggcttccccgatgtaatggtctatttccccgacaatttcatgaacctgacgcccttcgccgccgaggtgtacgtcaccaaccgtggatccatcgtatccaccgtcctcctcaccgncgncgacgaggaagaagaagaagaagaaggtgagcagcaacaaggtgttcgtccgcaaccccgcgccgcggacaccatcgcgatgatccccatcattcgtatgccaccaccagcggtgaagctgtacgcctacttccaccacctcgtggagtctgccgccgagctgctgctcgtgagcgtgctgtggcgcgtgcacatgaccgcacaaggtggacaccgtgaacaaggtgttcgtcccggtccggagcctcggcaaccgctccctcttcgtcagccaggccaggagcttctccgtcgacgccgacaagttccccaccgtggaggccggatgcgtctacatcgtggagccgggcccggcgacgtacgagcgtttccatctcgccgacgggaggctggaggaggccataccaatggtgaacaggcgccgtgccgctgaaggagaaagctgcgtccttcctctcaccctggagcaagtcatggtgaactactgcgtcgacacggagaattattccgagctcgagatcgcgctcgacaccgatgatgacgaagagttcttcctgcctgaagctgaaggccacggaaccaactgatcgatccagatgctggtgatcaaaatatatgggtgaaaattaagagggcttacgatataattttcagctccaactatatatcctgatgatatatgatcctctctgtagctagtctctacatttcatgtaattttcttcaattgtattccttctctgttcgatgacatcgatactgtgcgatctcgccttgtttgcttttgcatccagaaaaacatgtcattcgcttaatccgtactatttaattatttttttagcttcgctgtgccttggtcaaattaatgttacaaaaaagaagttctggtatggtgtattggtgttaccatgactttgcacttcaattgcttatgtagtaatgtaaatctcgtgatctagcgaagctccatgagcatgcaagatgtactacatccgtccctagatataagggatttttgttgaatgtgacatatcctagtacaacgaatttagacaagctttctgtccaaatttgttgtactaggatgtatcatatccaaccaaaatcccttatatttagggacggagtgggagtagcttaattgggtgaagtaagcagcagtcaggccgaagcgcggctaagcctgccaatggggcaagatccaccccatatccaatccactagccatcccataaaatccaaaccagaccaatccattttcctcgtcagtccaaaccgaaccaacccattccaattttatggtctcaattcactttcaaaaccatttaaacccacttcaaatccactttgtcgatcct

SEQ ID NO: 93816 - DNA, 5273 bp, Oryza sativa
caatgctagaaagtcttataatatgaaacagagggagtatatacatattctctataatctatacatgaaacactagataccatttattctatctcatgtgaattccagcatgcaccatttcgtaaaatatgtatgttgattataaataatcacatcttgcaccacaaaaaactaaaaaaaaattgtttaccgctccctttgttccaaaatataagcactcgtagcatttgaaattttaccaaaatataagcactcctagaatattacttgtcccatcaaccactcattcaattttcttcccatattacccccaaacatacctcatttaataaggggcatggtctttcctactcaaaccttaatctttgctaaaacacctagaaatgcttatatcttgaaatggagggagtatttactagtgcaagtacctacaaagctaatttagacatgaaatattgacacactctcccagtaccttttgactttctatattgtcatacattggtcgacttttttgatgtatgatattgcctgctttttatgattcatttgcttaattaactcatctatattgtttggttcttctccaggggagagttcgtatgcctttatgaaaaatataatacttacattgtcacaaatcgctgcgaaaacagacaaagaatcagagcggaagaatgtaagtttatttcttgattgttctcacatcaaagatagagcatctatttgcttctttgtgtgtactgcgtacatataccatgtacatgagcattgaaactatttcatggcaatgcttatgtttcagttcctcccatgggagaatccagacctcagaaactttcactccaaataggaagctagagccataatgcctgtgaaagtttaagtacagaataaaaacgagaagtttataagattattgtagtcatatcataactgaaaaaggcttgagcattgaattattgaaatttcatttaacttgtcgtgttttcaggttgaagagtgcattggggcagctgtcattgctttggggccagataaaatcctttcactaattccaataggttttgatgaggaccggctaacatgctcaaatacttggcttctgcccattttagataagtatatctatggggcctcaccacaacaattcctagagcgcattgtacctctagcagaatctgtacaacaagcttctaacatgggtaggtaaagccaattcattaggtcttaaatacatacgcaacatgatttcctaaccttctgctttaacttcagccaagtcagcacggaaatgtgaagacttgaaatcatgttccaatcagctgtggaatttgcttcctgccttctgccgctacccagttgatatatgtcagaatttcggttctctatccaagttgctactagagatgttgaaatgtgacaagtatctgtacaaatccgctgttaaagccctgcaggtgcagttttcatttacagatatactgcatttttcttatcttatctatactcattttctttctggaatttcgaactacaaggctgctccatgtcttctctcagacaacatgttttatttttctcagcaacttgtagatggaactagaagattaagtagcagtgagcaaaacagagaaatatatgtggagctttctactttgttctcctcgaaaattattaacttaagctgcccaagctttgagaggtgctctaaaaaagatgctcgtaagaacatgaaagttctggcatcacattctgtgtatcttctttctactgtcacagattattttctagattcttcaccagagaagcgttctcatttgaaggtgtgtcacttaatatttctaattattatcagttgatgagcatgttagatgtcttcaaaccaattaagtctaaaaaacccctacttaaatcagtcacggacggactcacatattgaaacattactgtattttctattatttggcatttgaagtttgattgatctatgcacattagagtaccactgatttaaatgaggttttgtgtcacaaacttgagaaaggcttaacgccgcttgatgcagcccaatattgactgctgcaggctgtgccctacacaattaaagagagattatattagtagaacatggttattttgttgtgtttgtacttttttactatcatttaaccatgtttggttgatatagataaaaccaataaaggtgtatcagggatgagttatataagtaaattttataaatgcacttttgcatattattatcaatacataagaaaaggaaccacaaccttatttcttctcagcaaggcgcactcaaatgactaaatagcaaataccaagtgaaaaatgtctgagagattaatatcctggtccagttggttattccatatccatgtgcacggtgtgcccatgaatggctcagtccaatggcactgaatacttgttacagttggtttgatactttgatgcactgtattcttgtagtgtatattaacaaaatacagttttaccttgaatacatgatttctccaacttccttagctgtttgtacctgggagaggttgagctgtactagttgtgtcagtaaattaggttatgtaccctttgctctagcacaccttctatttatccctgaaaacaacattagtttttagactacatattgcacaatatttatcatatcatctttgtcttcttgcaggatgcattgagatgtttggctcaactttctggtagcacgaacatttgcaaccttttcctttcactggttaaaagatttggtttagaagatactcagtcagagcaagagaatattgaatgccaaactaatgaggtagacaagaaggatgaagagggtactgatgtagatgaggagaaaaataaaaagaggtctgctattattcctttatgcatctatgatgtttgttttcaatgtaggttactcattctgtagaaaaagaacataaaccatcaaacttgcctggctctcagcggtacctttttaattctttttggtttgaaccatataagcaattactcctattaatgttagggaaatgctcattaaatttgcattctaggatgatatttatcaacaaacctattcaaattgcatgccctacatttttcaatggtgggactatatgattatttccgtcatcatgtattgattcacacatggttactttctgctagcgtgtgtgtattatacatggtatgattgtaactctacttgtgtaggtctcttgtaatggaacttatttcgacattcgctgaagctgctgacgaggatctgcttgatttgctttttggatttgtcaaatcttctttactggtacagcttattaatttgttctcttgttaacccaactcttatcggagcattcatgctcataccagtttatctgttcttcacagaacaacaagcaaccttgtgagggcaaagctctatttgctctaagcataattttgaaggtcagtatgactgtgtgggaccctcttgcgtaatttttatgactatgctttttcttattagccaccatccctttcttctttttttcaggaacacaatgaatattctttggctcggttggatgaaataatgatgcttcttcatggaataaaggcagacttggataatgaagttttagaaggccaattattatgctaccagtatttgttggttcacatgattaaggtaggtttgacaggttttcccccctcttgcaataatctttgatgtagcacattatctagatctttcctttttgatgacttggattgtggaatttcaaggttgttctatgttgatctctgaaccattgtgcagaagccaaagcctcacaccttgtttgccctgaatagaaagcatctgttgtagcaaaagaacatgttgttctgcctgcatgtcatgtttagtacttggagagttttgttgtttagtcaatttgtactgttcgcgcataaacatgtaaattatatcctacttggtgctaatataatatccatacattgaaatttcagttaagtaattaaacaatttgttcacatctacttcaaagcagcaaaattttatatgtctaataatataaatgctcagaactattcaacttaaattgcacagaaagtagacctctagaatgtatgtaattgctataactgtaataaacacacgactagaaaatatcaaagcactacaatatctgtggtagctagaggtgcattgtacatctataaatatttctttgaactgattataataacataatggattagttcggatgtcttctggattggatgagtctactgcaaagagagtattgaaccatcaacactttgatggcatttatcccaccttgtctatgatgtgtacctatagtctagttctatgctattttggtttgatgttaccaatcctgcttgtatatttatgtaatgtatgtttgtctgacttcttttctgcgttgtaaggctaatgaagagaacacgagcaagaaggcgttcctgattctaaacgagttaatagtcgcgttgaaggtttattccctacctttttttatcagttaccaattatgtatcaggaggatatatcatgtcagtcacaagccttttgctattagatggatagttttcctctttcaaaaacttaaaagcaaggttcttaaaatatacacacgaccactgatgacaattgttcttgccctgctgtcatcatctgctttattttatcctgacccaccttttctccgtacgcagtccaagaaggaaagtagaagattggcatatgatgtactcctggctattagtaatagcttgagaagctctgagtcaaacagtgaagattcagatcttcaacgactattcacaatggtatgttaaagaaaagttctctctgctctgaaggtatcccttatgttttatgattttatctggcataattggtgaagttaccttgtcagagggatgcaaatacttcttttttaaaaaaaaaaaatcatatccttatcataacacctaaaagaatcattttgcttttcatgaaggaaatctgggaacatgttctccatttctattgtttgaacttaatgtctatgtaatctgaagagttgtaccactaggtcctctcatccttatgaattgcttagtgcattcagcttgtagaaaaactctctcagactccaatgtacaaaggattaacaattcgcagctgccaagcttttgagtgtatatctaattagttatatctgagagagcctcaagccctaggatca

SEQ ID NO: 93817 - DNA, 1176 bp, Oryza sativa
acatgccgttcccggcgcgcgcggcacgggctggtgtcgctgcgcgacacggcctacttcaacagccacgacaccagcatgcgaacgctgaagagggtgggcaagacggcgtgcaagccagcgtgtttgggcgactgcgcgtgcatggcggcgcagttcgtgtacggattcgaccccaccgacggcttttgctacctgcagtcggaggtgttgtcgctggagacgatgcagccggaggtgtttcactacaactcctccatgcatatcaagattgcccagggcaggttgccaagacgattctgatcgcctttttacagtctactatactatatcaaggaggagaaatccttgtaaatacatacatgaataaattcacgagaactagctaggattctcgattcatatgtttttgtattcaacatttgtttgtgggttttaacaaaatataaagaaaacatttttttttattttttcatttttattttttaatatttacagaaatattataccatccaaaatatttacagaaatggcccctgccgtccaagtggagggaggcaaggtgtgtgcaattttcaccctgctaaaaatgcatttttctagttttttttcatcttgtctgtcacctgccgccctcagtctacttctgtaaatattttcgccggtaaaatatttctgtaaatattaaaaaaataaaaatttaaaaatgaaaaatattctttttaaacaaggacacagcagcgtgccttactacgagttgggctggaacgggattcccacgaacgtgttgggccttttaactcttgggccgtgggccgtggccagtcatccagtcatcgcttggtggcactcgccgtcgccgccgggtctgcgtgaagccccgtgcgtctcccctccggctccgcttctcccctcgccggcgccgtcgccggcgttcctcggctgcagatccaatcccgcgccccgccgagtgactctcctgattccctgacggcctattgaagagctgcctagaccaccgccgctcgcgactcgcgagcgctggggcgcccgccggcggccgccacgcccttgttggctaggctgctagctctctgcccctctcgcctgtcggcctctactccggctaaccagagctcctcctcccttgctcccttggctacacgggtataccat

SEQ ID NO: 93818 - DNA, 2641 bp, Oryza sativa
tacaacatttgccacaaattaatagatgatattatagcagcataaacaataacatatatgcttatggcagcaatattgaggtattgtttaaagggaaattaaattaacaaagtcaactcacttgtatgagccgacggattggcatctccaaccagattgatttttttcatcacttgggtgtgaaagcatactttggacccaaacctacaggtaaaacagtaaaaattaagaaatagatacgcagagcatcatctcaataaccaatagatatgcacaccttaaagttgccaccaaatgaagagctcacagccatgttttttccagggcggaaagcaatagcagaaattccagcatcgctgtatgaaagaatggtaagagaacatatgcaaccatttataattgaccttatatagtcatgttggtacctgtgcggctcataaatgacagtggacaaaaaatattgtccagcacgagacccttggttccaaaatttcaatgtaacaagcccacctaattcttcttcaggaagcttgacatcaatggtgcacataaacttaccatcaattgacaatgaaactaaggaaatgtacatctgtggaaaggaaagcattctcatcagagcaaacttctggatactaaaataaatgtgaaaaacaaagaaaaattttaagccacaagaacctaacaaaagaaatctacggtacaagcaaaaggaagttgttatctcactgtgatatcatcaacagggtgaaagttcctctcacaaacttgcacctgtagaaagtaaaaatattgggatgggatattcttgcacaaaaccagaacaggaagacaagtaccgattcaatatactgagaaccacagaactggataaaatatgatgaaatgctctcatatgcttactgttttacctctgaaacttcagtattctcaaataaatcgtagaactgtatgcaataatcttctgttggcacagcaacaagtttgttactgtaatcaaatccatacacatctcgataacaaccacccaggtttggtgaagatataggtagctgaagagataaacaaataaaagacatccattagcacataatataatcaccaaaaagtgaaacagcagagatcatcaatacaatttatttggattagagtgggctcttaaagggcatatttatgctattacaaaccttaattccagcaatagatttcatgacctccatgttgggcatttttagaagatggacttggttattcatacatgacacctgaaatacaaagaacattaagctctacttcaaaaatgaattgcaaacaaatgaaacagaaacagacaaaaagaaacggtagtttgaaacaatcatagagccaaaaaaaagtctaatacaaaaatgctacctgctacactttatgagcccccatcatcagtacagcccattaggaagtaaatgtgttaccataaaaagatgctgaagtgctgaaccattctagttttctcatatggttctaataacatcatgtaacctaatgtggacatgtatgattatgatatataattatgctcactctggccacaaaaaaacaagtcaatttaaaatgcatgcagtcaacacgagttctttgaccataaatatcagttaaaatatagtattccggtatgcaaatgaaactgataaattcaattttgtcataacaagagctttcataatattacagttatataaacttttttaaaatttatgctaaagaactaggcagtaaaaagttgtataatgtggacttagataagtccaaaacaacttgtttttgtgactggaggctactatgtggcaacatcatattcaaataactcttaaatcaacaaaaatagtgtgtttttcactcttcagattactatatcaggtgcaacgaagttcaatgggagatgtaaaatatggggatacttacacaggcaatggaagaatccggagaatctacaaaggacaaaagaggagaccctagacgtggtttatatcttctcttcccagtatctagttgccatacaacaataactccctccataccacctataagataaggaacttgtcattgaaaagcataaaaccctagaatcacaactgaatgaacacaaatcagcaagcaaaacctgagaacaagtaagctccatcagtagaaaatttgagaaacctcactccgcttgaatgccaatgccatgtagtgcaagtatctgcatcaccattacccctcacatcacccctgtcttcatctagttcagattttgtgccatctgatccagaaaactttgcatttccaaaacctctccagatcagtattcgccccgttgcatcaccactagcaacaattctctcacttggatggaaggccagtgtgttcaagttttttgtgtggctaagctttatcttccttatcttgtcgggcttgaaattttttgttggtatcctccatacatggagctttctcttatttgtaatacccaaaaattcaccagagctacttgcaacaatcatttccggtttacgggtctgtttaaatcgaagcaaacaacacattgatgtaagttttaatagaaaaccttaccacagatactacagcacaatattattgttatatttctaattgcaat

SEQ ID NO: 93819 - DNA, 649 bp, Oryza sativa
aatgagaaattgcgcgggcagttgcgaatttatgacttaaccaaagggcgtcaagtgggtagtcttctggctgaggtacaaattttacctgtcccagttcgttttctaaccattttcctgcgacaatatgtttttagatattttattattgatcatgctatgaatagtgagcttccatttggaaatgtagtttgctgctaatgttgctattgcaattagaaatataacaataatattgtgctgtagtatctgtggtaaggttttctattaaaacttacatcaatgtgttgtttgcttcgatttaaacagacccgtaaaccggaaatgattgttgcaagtagctctggtgaatttttgggtattacaaataagagaaagctccatgtatggaggataccaacaaaaaatttcaagcccgacaagataaggaagataaagcttagccacacaaaaaacttgaacacactggccttccatccaagtgagagaattggtgctagtggtgatgcaacggggcgaatactgatcttgagagttttggaaatgcaaaagtttcttgatcagatggcacaaaatctgaactagattaggaacagggtgatgtgaagggtaatggtgatgcacatacttgcacttcatggcattggca

SEQ ID NO: 93820 - DNA, 1234 bp, Oryza sativa
gctcacgagtttatgcaaattttaacattttaaaaggaaaaaaaatatgttttctatttaaaagatccaaaagtttgcacccgcaacaaaagattgcacaagttaaagaataggacaatcgctaccgtagcctgttggagtcacctaccgtctagaaggatgcttttttatgaagagaaaaacatgccgctcctcctcaaacccaatcggatccagaattgcagattcatgtgacaagcatcaatcatcatgcctgacgtctgatcttcacaatggtaaaaaaaatgttgaacaattatttggtcagtgggaggaccgactggacagtaaccttgggtaatctgaccatccgaaggataggcagtaaaagaaactccattatgttcagacactataagcaatagaaatgttccatgagatgatcgcgatcttccgtgaaatgcaattctgaaagtctcagattttcaatgtgttccgtttccagcaggctggtagatcagagaaccctatgactgtcactgattcactgattttcaatgtgttcttaaaccggtagaatggatatgtagcctgaaaacaggacagttaacaaatcaatccaatttgggagcttcggaagcgtgtacgtgataatccatagtctacaagaaaaggaacagggcctaaacaggggtaaaaatcaatccaattttgcaattgatctgatacataaaatgcatgtcaaattatcaatactcaatatgtcatcttagcaaggacgatgtctcagtgtgaggagcgccagtgctgccgctgctgctccctgtcacagccaaagatgacgtgtagccaaaagcatcaatcggtggcaggaacgtcgccaccggcatcctcgccgggaggctcggcggcggcgcctcacccctcagcacgctgatggcctgcctgatcaccggcctcacgctccggtcagggtgcgcgcaccagagcccgacaaccatgacacgctccatctcgccaccgtcgaactcgccggtgagccgccggtcagcagcgtcaagaatcctcccattgccgtacaaatcccagacccattgagcaaggtggatccggtcttcgtctacctcggattggtggtccgccattatcggtcgccggccacaggcgatctcaaggaggaggacgccaaagctgtacgcgtcggactcggcgttggccctgccggtgatcatgcacttcgggtccatgtacccca

SEQ ID NO: 93821 - DNA, 825 bp, Oryza sativa
agagaggaagagagcataagtagatgacaggtgggtcccacaaatttttttataatatagtgctgattggactgccacgcgcacgtcacgtggaccaaaaccaccgcggattggatcgaggggggtaatttgtccggtttacatagttgggggtgaagaatacccagttttgtggttcgggggtaattcggacaaccgcgatagttcgggaggggggtaattcgtactttttccaataataaatatggtcaattatcaactgattgagtgtcgttttttaaagagatgctatcgattccaactgttttcatcccttgggccgtagcaacaccgggctgaaattgtcacagcgaggggaaaaaatggaaaaagaaaaaaaagaggaaaaggagaggtcgacgtcgatgtcaattgtcaagctcgatttgcggcggtggccggcggcgaggaaacaacgggccggagatgttggtcgtcggcgccgatgagtggcacggcagctggattgattgggccggagcccactggatcattaattacgcgtgcggtttggcccgaaccaactgcagggttgggtgcacgtactaaaattcttactaaacctttagctttagtaacagtcatattatggtggtttcatgttgctgaattcggtggttgtctaatacacattttgtcctgtaataaaacaatctaataggatgaaacataactgagtacaataaatcctgatagcatctaatttgttttataaaacggagagataatatatgaatttatagtggacatgtcacatgtgtatagggtaccgagctcgaattcgcc

SEQ ID NO: 93822 - DNA, 897 bp, Oryza sativa
ctcagcatagagcgaaacaatccttgaatagattggggtgcatttgatgttgccgctttcatccttcattacaatgccagggcggacttcaatgttctggttcaccctcaaaactccctataaaagaagcatcacaatttaagtcatacctaataacccaaaagtagtgataaaaaatctaattacatgacacacgagggaatacatactctgaggatgctgccaccagctacaccacccctaatttcatcaacctctgaaccaggcttgttgacatcaaaggagcgaatgacaatcatgtttggaggggaagtgaagttcctttcaggaatggggattttcttcacaatgtattcacatatcacatcaatgttatacttaagctgagcagatattggcaccaccggagcaccttcagctatggtaccctatagagaaataaaataacccataaacaaatagacagacagatgtacccatctacaagataataatggacagtagcaacctggatgaatttctggatcgcttcatgttgattcattgctgcactttcctggataagatcaatcttgttctgaagaataatgatatgttggagacgcatgatttcaaccgcagcaagatgctcagatgtttggggttgtgggcagctttcattggctgctatcaaaagcaatgctccatccatgatagcagctccattaagcattgtagccatgagaatgtcatgcccctgttaagaagaaataggtatgtattacatatgtaatattttctcattattgacttcgagagatcaaaaaataaaaaacaatatgcagtgacccataaaaatatttgagatgacatcagtttatacttcttatcgggtaccgagctcgaattcgccctata

SEQ ID NO: 93823 - DNA, 1314 bp, Oryza sativa
agtgcttcttatccatataccctgttctccaaaccctagcccaaactccatccactccatccactgtgtcgccgccaccagcatccactccgccgtcaccaccgtccccttcctcctcctcccacccgccgctgcgggcgccgctgctcatcaccatctccttcaccttctctttccccaccctcacgccgccgcccaccacgccgtcgtcctcctcctcctcggtcgcgcttcgatccccatcgccatggccttgggtggcgtgtccatggccatcatcgccatggccttgggcggcggcggcggcggcggaggcgggagcgtgaaggggagggacatggcggggagcggatgggcggccgacgcctgctgcacggcggcgacctcctcgacgcggcgctcgaggcggccaatgcgcgcatcggcctcgtcgcggaggcggcgcacgccgtcgagcacgtggtagggtcgtggcgggacagccaccgcgcgatggcggtgtcggcggcctccatacggcgggccagctgggcggtgcgttacatgttccaccgccggcgccaacagccgagcggctagcagatcaggtggcgatggaaggccagcgccgccgccgccaggaggaaggcgatggagggcgcggaggtggaaggggagggcaaggggaagcactggatggaggatgacaaagtgggccacgtaagctattccccgagttctctcactaaacgccactctgctctttgctcttcctccaggaccccaaggccatcaagatacggcggcacgccttccatctccaccagtgcgtcgccgcctgccctcccctcctccgaattccttggctttgcttgcgagaatttgaatcggattgacgaatcgtgtgcttggttggtttctcctccaggtcggggtcaaccacgctttccgcgtcggcgctacgtactcctgccgccgggatcactggcggagtcgccgccgcttctcgatcgcatctgcttggctcacggccactcagggggagttgcgcttacctccgcgtcgctcgtcgagccgttcttggtcgaggagcagcacaatagccccagccaggttggatttagcttccgcaccagtgtgatttgaggtgtttctactttctaatgataatttttttttggttgcttgcaggatatgcaaccgaggttggtaccagaggctcatcttgatgtgctcgttgaggtgaggatagtaaactgatgcatatcttcgggagcattaagactcgatatcaatgtttgttaaattaaggatacataggatcatgtgtgtagg

SEQ ID NO: 93824 - DNA, 831 bp, Oryza sativa
tgcaagcttggttatgctaatgcgaaaatctacaaatgtgaagacgagaaatgcccacgaccaatgtgctacaagtatgcaataaaccactaaatggcatgatttgttctatgcaatgaacttccatttgtattaccatgttaaaaacacttatctatataaaattagttttccagttaatatctggtagaagttatgattaaaatctcatgattgattctccagaaaagtaacttataattatctgccattcacctacttaggactgctgctttgatgtcaagctaatgcatgtgagctctgcactatatgttgactttttttcctgttatataaagggcttatggaagtggaaaagaagatagccctcactgtgatgtgcctgggtttgaaaacactaggatgaagctactgagacatgtttcttttgttgattgtccggtatgatataaacctcttaccctttgttgcatatatgaatgttctttttctcaagacatttctctgagcatttattgtcttcctgaatgtttcatgatattactttatgtggcttttcactagcctgtatatttgttttaaaacattttgttccgtcaattatgatcatggggtttcacttgcattggtttttatatgcaaatattttttccactagaaggcacatggccatacaggagtgaaggatgtagataagaagtataaactgatgtcatctcaaatatttttatgggtcactgcatattgttttttattttttgatctctcgaagtcaataatgagaaaatattacatatgtaatacatacctatttcttcttaacaggggcat

SEQ ID NO: 93825 - DNA, 1408 bp, Oryza sativa
ctgagattgttgtgtgaatgtatttgattggatctgagattgttgtgtgatgtatttgatttgtgtgtgatgtgaatatgtgatgaattttgtagaagttgtgatgtaattttttttttaagattttgtgatgtatttgaatatttgagatgatcgatttgtggatttcaaggcaatttgaggatgattgatttgggattttggggatggaatggggtgaaatcaatatatttaaaaataatgaagaaaaaaaaataataaagaggaaccggaaagagcaaccggattagcctctttagtcccggttggtatgctttatctttagtcccggttggtgttaccaaccgggactaaaaatagatttttactcccgatttttttacccgggactaaagatagcgatctttagtcccggattcgtagttccggtttgaaaaccaggactataggggggttacgaaccggtagtaataaccctttcttcaccagtgctactagctttggatcagagtgtagatattggatccaacacaaaaggtaataagaattattacatcttgtgtcctgcctaattggtaattagtgtggcactcaacctaagcttagttggtaattatgaaaaccaagggtacgtagttcaggaggtttatgttctaagcaaccaaaattagttacactacactactcataccaatttccactcgctcgatcaagaacataacattctttgaattggaagtgtacacatcaacgacctgtccaggctagaaactgtagcaaattttataagtaggcctaccaatctagctagcagcttaattagttcacgcgtcataaaataaagtgagcatatagatcaccaagttgtcccctaagggtctctttgagaagcctaaattcccactttatttttgtagggtctcgtttgaaaaataaaaagcgacagcaaaaaactctaaattgcgaagtgagtatagttcaattggttagatttctcatggtgaaaacaacccacccaggtggacgggtttaagttctaaacttaacacggatgcttctatttacggctaatttttctttcaatggtaggcgtcgggtacgtactcatgacagcaagacgcccgtggtgacttcgttaattttaagataagttggcccagttttttttggagatgctcatatggttattttagtggtaggcacgagtgtccatcgatagcaaggtgtccatgatgactttgtcaatctcaagacatgtcgacccaatcttttaaaggtgctcgtaggagtgagtgtgcgtatgttgtgggtgtctacatttgtactgtgtgttttttataaaaaaaagacctctaattatttctaaaatttaaatttagctatggctggtgagagcctgatcatggtt

SEQ ID NO: 93826 - DNA, 1616 bp, Oryza sativa
cgagctcggtacccctctttggatgcaaacagaaaagacaggatagatggagaggcatcatcgctggtttatgtcaacggttctcatgagtatgttatatttgatccccgaagcaatgaagaattgcatattggcaagagtgcacacaaaaatattcaaactgaggagcctggtgagttatggtttgctgcatttattctaatcagcttctgtatacttgtatttttcattgtgttaacctgctcttctctacggctatatttgctggtggcaagattatatagtactccctccgttttaaaatgtttgacaccgttgactttttagtatgtgtttgaccatttgtcttattcaaaaaatttaagtaattatttattcttttcatatcatttgattcattgttaaatatactttcatgtacacatatagttttacatatttcacaaatttttttgaataagacgaacggtcaaacatgtaataaaaagtcaacagtgtcaaacattttgaaacggagggagtatatgaacatcatatcccaacattttctcatgctaaatgttttacgctccagaaaccattctcttttttaatgctagccttccagaaaccctttctgaatattgttgcattgtgcctggcaaaaccatttatttgcccctttttcttttgtactctaaaacatgttgaaaaaggctctgaagctcctttttgttattccaggaccaattggttatgcttctatttttggagaacttccgaaactggagtcaaagaaagatgttccagaaattctatttataccgtcagagagaccttgggagactatattcagtggatcaactcatgttcttccgcctctcacaaagttatgtcctgcattcttggcatcattgcttgagaagagaccagttgcaaatgagtgagaaagtgccgaagttttgtcccgtcatacaatgcaacaaggaaccctgctagttacaaatggcattgcacatgaaatccttatgactagtgctgcccgaagctcgtccaatactgctgaagctggttgtgggcattgattatctgtcagctcagctcacaagagaacacatgcgatgatggctacagcaacgctgttgggtgaatgagccaccctacctctttttgtaggtgatatctagtgatctatcttcagatcctagcaaattttgtttccataggctaatctgtaattctgatagcaaaaactagctctttttggtgaaaatgtaacgcgctaagatatccagtaacacggtgagtgaatgatgctgttttactgactctgaatgaagtgtgtgttgatctggtaaactgaaaactcgatgcttctttcagagtttcagttgtctgttgcttgcatacatgatggaatacttttttcttctagaactctataacaaccaggcaaataatttgtcttcctggaaaaaaggcaatcttgtcgattatgtactgatatctggcaggctaaacttagcaattgcattagatgccaaatattgccatataagtcttccagattcagaaattgatggctaagctgcactgacaagtacgaaatgcatgcaggcttgtgaacagtttcagtc

SEQ ID NO: 93827 - DNA, 2208 bp, Oryza sativa
ctccttcctcccctgctttgagctcttggacacccttttaatggcgacgtcaaggttcaactctttcaagaatcctctgtacactgatccgaacccgccttccccgagcttgtgctcgtcggagaagtcgtcggtggcgatggcgagctcgccaaagcggaatctcttcggccctgtccccttctcgaagtcgtcttccatggccgtctcatcatcgaagatgcccccctcttccatctcctgctccttcgtcaacccagcatgcttccgccgccggcgcaagacaaaccggactgagaaaccaagaaccaccaagaacgagatagcgctgacagtcaggcctgccacaagccccgctgacactgagggaggaggtactggcgtcgccggaatcggcggcggcggcgacgacgacaatggtgacggcgccggcggcagagtgatgttgaatggccaaaggtcgaacctcaggtagcagctgtaccccttaatgttgccagcgctttggttggtgtagtactggccgaggtcgtcaacgtacctcttcaggcacttctggcactcgctcccgctaggtccctcgtgcactgcgccagcccgtacaaccgcgacgtgccgagcttcgagtcgacgtacggcatgctgtcgttgaacagtctcagcttgttgtcaccggccctgtccgcgagtttgttcatcagctcccgcctcgtgtcgttcatggccgtcatgttctcgacgtaaagcccgttgaacgtgtaggtggagcgattgacttcgaccttgccgtaggtgagctcggagaaaaaggacgcatcggagtagcggaggaggcaggcgtcgtagttggccttgaccgtccggcttccggggcacacctgcttgatcccggcgggcgctccggcgaggcatttcttgcactccgtcgcgttgtagtcggcgtggcacatgataaggccgaatacctggtaggcagtacccgtcccgaccgagctggtgttaaaccaaccatcgtcggtggcggccgtggcgagcgtggagaggagctggtcgaggttcttctcgaactggttgcccacggtgtagttgccggtggtcgagcagtctggccagagcggctcttcgtagttgctccgagcaactgccgccgaggcaaccacggcgaggaggaagaggatgatgacaaggcgaggagccatagctggcgacgccttgaatttgctaggaacatgaatgctttggtcccaatttatcttggatgacaattgaagggacggggttcatgtgcagttttttcaaagagaactagtgttcgattacgcgttggatcatatagtatacactactggttggccacttggccagatcactgtttggtgtttgcaccgtatatatgtaccgtgaccgagtctgtctcgcggttaactaaaaggggtcgttagctgattggaatgaatgggtctatctctctagtaaggggtaatttttttggacaccattggcgataatgcataggaaccagtcagctttgcaattgcatagtaaggattacgtacgaaaatgattcggtccaccgcaaaagaaaaaaagaagaagaagaagacgactcggtccgtgcgcccgatccaacgaaaagtaatcggctgtgtttccactgctggagtgctggtactgctccctgtcacagccgaagatgtgtagccgaaagcatcaatcggcgctaggaacgttccctactaccgaacacgcttttcgcatacagttgagcggactgcatgaaagaaacggaaaggctaaaaaactgtcgacacatttttctctagaaatatgtcgatttctgatccattagatcaactgtaggattcgggctattttggttgacgaaaataaaattgtactgtaaagaatcgaactaggatctccagtggcttgtccagcggccctgaccaactgatcgagcaaagattttggcttgaattaaaattacatactaattacacttaaattgcatattatttacatatgtaatttagagacttacattgtaaatacactaaaattacatatgtaatttatagacttacatatgtaattttagcacttacattgtaaatatactaagattacatatgtaatttatgaacttacaatgtatgtacataccgactattttttttgtgaaaaatatggcgctataaatatagctgc

SEQ ID NO: 93828 - DNA, 4432 bp, Oryza sativa
cagctcgattacttgccatagtaagtatttctcctggttataattctgtcatatgcaggacaaatgtgccaaaaaccaactgaaccgtgaaaaagttcagtttcagcagcgtaccggatctcggtcttacattgcacatgcctatgtcgtggtaaggaaaaaatgatgatgtcatctagttggatgtagtttttgtgtttcctgatggaggtgtttagatccagtggagatatatatcttcatattgatagtggctctacataatgctatatgatttaaagctttagtaggctccctcttcatgtgagattatctgcagccctccctacatgtttttctgcagcagcgtgggttggccctctattcagcttttgctgcccttgttttgcattgtataggtatagcaatatgccattctgtagtggcatacctctacagtgcaaaacaaggacaacaagaggtggcaaagctctaacccctgctacagcaaaacatggagggagaatagcaggttatctcacactttgaccatgtaaaaatatgctcatgttttatccataaatttctatcagtttggtttgattgctcttgtcatgcttatgcttatttggggtgacatcaattaagtttatacatggcaaccactgtcaatgtttaacaaaaagaatcaatgtcaaccagaatgcttgttctggaggacatgtttttgtgttatctgtgtactttaacataaccattactcatgccatcatgtttctctcaacattgcagaagcaagaaaaatacaaagacagtgagcccactgcaattgatctctttaaggagttgcattgcagcaaaactaaaggttgcattgctgcttggtggaattttttttgctggctgctggcaagatatacgccgaaacttagtagtggctgctaggtggaattttttggtgcaggaacttggcactacctgtaggaactttgtagtcggctgggacttgtgtagttggatggtggatgaatcattttgtattcatgttttgtgcttttgtatggaaactgtattctggaacttgcttttgtatggggctggaaaattaattatagctagaatgtgattgtaatataattatagaaatggttgtggtttatattctatgattgctttttaattgggctggcccataatataggctagaattgtactattgggctataatgaaaaaaacgtaaaagcaaatttgtagctgggtcaaaaaaaaaaatatttgggccaattgggctgattgtaattgaaaataaaaaagcccatgctatatggcccgaatgtgaattgccacgtcatttgccacatcgcctgcccttgtcatttgcaacatcacatgtcatcatatacgtggcgctattcggttcaatttgttatgacgaatttgtctcgtcattcatcaatgacaggagaattatcgtcactgtatcaatgacgatgtcctctggtggtcacagaagctgattagtgacccaccttctgtgatgacagccatttcgtcactgcaggcagacagtgacaggaaataagctgttatcgtcgtaatgtaatcgtcatagaagcccagaattcctgtagtgtatagtagtgtgatgaacagcgtgggcgcgagatgtttggtgctgcgatgaagcggcagcttttcgttttctcttcgattgcaatatatagaagtaacaagaacaagggtagctaggcacgatgccatcaacctccactaagcataccacggtcaacagaccaaactagaaaacatgaaagataaaaagtaactacacatacatctccacgcatgatatacggattatcgaacttatcaagcaactgtcccagtcgtcctggatgactgagttgtgtttgtgctggtgctggtgttggtgttccctgtcacatatgaagatgtgtagttgaaagcatctactggggacaggaacgttgccaccggcatcctcgtcgggaggctcggcggcggcacctcgcctcgcagcacactgacagcctgcctaatcgttggcctcaggcttcggtcagggtgcgcgcaccagagcccgacaaccatgacagcctccatctcctcgccgttgaactcgccgcccagccggtggtcggcggcgtcaataatcctcccattgccgtacaaatcccagacccattgagcaatgtggatcatgtcctcttcttcatcagcttgccgttgcggcgccattatcggtcaccgaccacaagcgatctcgaggaggacgacaccgaagctgtatacatctgactcggcattcgccctgccagtgatcatgcactctggatccatgtaccccatcgtgccagctagcaccgttcgtgtgggagccccggtcgtggtcgacaagcctagctagcccgaagtcaccgagcttggcattgaaggcggtgtcgagcataatgttgctcggcttgatatcacggtgcgccacacactgttccgactcctcatgttagcacagaagcgctgatccggtcccaagcacgatctcgtgcctacaaattaatggagcaccgcttgttaattagaatgtcaaatatatgtttgatagattataatatagttagacaattaaagctataattgtagtgtgagattgagtccgcgcgtgttgggctatctaaatgtttttacagcaccttctgctgctagaggtagtagtgtagtttgtttagatctgaccattgattcttaaggctattttagacattagattaaagtattaattggagctattttaaccgaactaattctcgctgttctcgccgtcaaattcaatctctctcacggctagtgccaccagctaaacaccgcttgctatcattcttgcagcctgcattgcttaggacgaacatacacgaaacctggatagtgaagaactaatagtgttgatccattgattcagaattcagatcatacatataggtgcatgcaaatcctgtggacatatatatgtagaagcaagaaagctgaaactatttcatggatatagtcaatcatatatgcatgcacgaagaactcggttgatcctaattcctctcctaaaaagtaggcaagtaaactacacggaagaaacaatctttcaagagcattaccaatagattacctataatcttccccaaaaaaatgtttttaggtttctaaactgaaaataggtagtgaaaaaactcctccctccaacagatatcctaaattcaatccccaaaacttaaaaatgggcccttctgttaaactaccaacagaaatgttccgttttttttttctttcacagaaagatcgctatctcccatgcgcgggagccggaggagagaggcgggagtgtgagattgggagcgacgcgtccacatataaacggagcaaggaatcaggagaagggaactccaaaactcgggtaggagagtaggggatttgttggagctatttttttactaaaattcctcaaaatcagttttgggaatcagataaggtagactgttgttgttgctcaaagggaaccaaaaaaataagagatggttgccaaaattcaatcgggacggtcaatgaaatttgcaaaattatttacctgccatatgcatcttcttccaaatatatccctacacgaattctaccgtccatactacagggtatagtataaatgaatatgatccattgatctagatgaatggatggctcatattcatccaagggtactctaaaaaataatacgcctttaaatcggttagtgtgctatgatgattgggaaggaatgttcgatcactactgttagcaactttttgtgacaagttgataactacgatcgcagcacctaacgccttgcggtgattctagagtcgccaaccacctcaatctagcaaaaactagaccaagatgggttttgataactaaagcggctagcagagccgatttctagataactacccgtctcgtaggcaaaacgaaaggttttcaagacaaacctacgaagaggtgttgcactctcgcagctgcggcggacgatttacagcgcaaatagacaaaaatggacaaactaagagaaaactaaaagcaatatgaaaaacaattcgattgaatgattgtagattggttagttacaattgaaccggccatgtcccttatataggggttggtcttgccctctataggccctcctccacgtacaactcgggatagaatccaaaggaaacccgaaacatgccttcccgagcaaggaaacttcgagaccctgcgaaacagacccggactcggactctgccggtcagaccggccacacaccgccggtctgaccggccaacagatggcagtcagactggcccaattagagaaaaccggcagacttccaaactttggcaatttttcctattttatccctaggtacaaaat

SEQ ID NO: 93829 - DNA, 1335 bp, Oryza sativa
cagccatgcaggtcagcaggtgctggttgagtggttgtgatactgatgatatgactagatgattaaactatttttgcccctggcttctcatctttttttttttttgcccctggtataagtcataacctttttttttcatctgttctcaggcacaacaccaaccaaaggcttgcctgaccaggcattcctattccatcaaaacctcagggaggtctcaggcactgctcaggccgtccacaaaacatgcccttaacaacatggactagtattactgggatgagacgtggattgaagctcaagttatgaagaaatgaggtatactctgcctttagcaaatatctgtattgcaatattttcaagatatccatattattactaagtgtgttggtcatgtttgttactttcggttgcaacacgtgaatgccatgcacaactgattctcagccatgcataactgattctcgctgagatgtgtaaagatgatcctgatccaaagggtagtaggtttctcgcctacttcaacatggcaaggaaaacgattttcccagcattcagaatgtaaacaaacttagtaatgtaggcaaacttcagtatcgaccgtaggtgaattcacgcaatgacatctcttccaaactcatttgttttctcctccatctcacgaaaatagtgcctaggagctctctgcccttccacatttccttctctcttacctcaaactgttggtagacttctgcctaaacaactgcacttcagagcggacacggtggaacttcgagcgtcgtgccagcctggatctggccccatccgatgagtcgccaatgcttctcaacacgacggctaagggcaaccttctcacctttgcttgtgcagacaggggcagtgagctgaagtttggcaagatcgttcttgacagcaaccacacgagcaccagtcgacatggatccgatgttaagcatgaggatttcacccttggtgagcttggagaccttcccagccttctcagtaccttttgtcctcacacccaacagcctccgaagaaggaagaagttgatctgcatgcatgaaagtccagatttaagcaatgaatgttttattctcactaaatcttgatgcaacgaagagttgacaaacctcaagctccacatagacatcaggaagtgatccaacttcacctagaacctgaccaaccagtctatcagcacgtgtcaaggttggatccatggttgttcccacaccaataagacctccaggcacagcaaattggagctcattctgctcagcatagagcgaaacaatccttgaatagattggggtgcatttgatgttgccgctttc

SEQ ID NO: 93830 - DNA, 648 bp, Oryza sativa
cggcgccgcgctgatgtacctgcaccacgaggcggagcagcgcgtcgtgcaccgcgacatcaagccgagcaacgtcatgctggacgcgtcgttcagcgccaggctcggcgacttcggcctcgcgaggctcatagacgacggccggcgctcgcgcacgacgggcatcgccggcacgatggggtacatcgacgcggagtgcttcctcctcgccgggagggcgagcgtcgagtccgacgtgtacagcttcggcgtcgtccttctcgaggtggcctgcggccggcggcccgcggtggtcatcaacggcggcgaggacgcgatccacctgacgcagtgggtctgggacacgcacggcggcgccgccgggggcggcatcctcgacgccgccgacacgcggctgaacggcgagttcgacgtcgcggagatggagcgcgtgctggccgtcgggctctggtgcgcgcaccccgaccgcggctgcggacgtccatcaggcaggccgtcagcgtgctgcggttcgaggcgccgctgccgagcctcccggtgaggatgccggtggcgacgtacggcccgccggtgtccacagcgtcggcgccccccatcaacgacacctccgcaggacggtaggaactatggtttccatggccgccggac

SEQ ID NO: 93831 - DNA, 3582 bp, Oryza sativa
gggccaaatttggcccaaaagaaaaggaggattatttttaggtttttctttttaataaactttgataattgtttttgttgcttaataattgtttccggtgctctgaaaattcaagtaaaatttgagggctccttttagaccaaggagaatttaacaaaaattctccgggccacattcgaatttttcttgtacgtattttagtgtttgccattttctttttgaattttaattaattctattattccttttagcgaatgatttttaatttcgggatgaatttatcaggacgtgacaggatggcatgaatccttttggagagatgagcagcggccatagcacttggcccgttacgatgtgtatccacaacctcccctctggctatgcatgaagaggaagtacataatgatgccgattattattcaaggccccaagcaacctggtaacgacagcgatgtgtacctaagaccactggtcgaagatcttaaactgttgtggaagaaggaaggtgtccccgtgtgggacgaggataaacaggaggagtttaacctacgagcgctgctgttcgtaaccatcaacgattggcctgcacttagcaatctatccggatagtccaacaaggggtacaaggcttgcactcactgtatggatgaaacagaaagtacgtatcttaagcactataggaaggttgtgtacatgggtcatcgtcgattccttgcagcaaaccacccgatacggaagaaaggcaagcactttgaacataaggtggaccaccgtatgaaacctaaatatcgcagcgggaaaacagtgtttgctatagttaaaaatcttaaagtagtgttcggaaaggggactagaaactagcctatagagagcgaagatggttacgcggcgatgtggaaaaagaactctatattttgggagttaccctattgggaattcttggacgtccgccacgcaatcgacgtgatgcacctcactaagaacctttgcgtaaaccttcttggcttcctaggtgtatatggaaagtcaaaagatacactggaagcacgtaatcatctgaagcatatggaacaacgcggcgaccttcacccggaaccaaaggagaaaggaagccattacttgagtccagccagctacactcttagtaaggcagagaaggaaagtatgtttgaatgcttggagagcataaaggtaccgtctggatactccatgaatatcaagcgaataataagcacgtaggagaagaagttcaaaaacctaaagtctcatgactgtcacgtgttcatgacacaactggtaccagttgtaataaggggtatccttccagacaatgtccgggcaacaataacaaagctatgtgcattcatgaacgcaattttgcagaaggtcatcgatccggatagattagaagcccttcagaatgatgtggtgcagtgtcttgtcagttttgagttgatatttccaccttcatttttcaatataatgacgcatctgctttgtcaacttgtcaaagagatcagtattctcgggcctgtgtacctccacaacatgtttcctttcgagagatacatgggcgttctgaagaagtatgttcgtaaccatgctcgtccagaggcaagcatcgccaaggggtatggaatagaggaggtcattgaattttgcgtagaatttattgaagaccttcgcccaatcggggtacctgaatcacgccatgaagggagactacggggaaagggaactctcggaaggaaagcaataatgacggtagacaacaatttattccgtaaagcccatttcacggttctgcaacaatcttcattggtagctccttacatcgaggagcacttggctctacttcgcaccagaaacatcggtaagtccgatgcatggattacacagcatcacattgatactttccccgtgtggctacgacaacatctcatgggtaacgagacgatcaacaaacaactggccttcctggtgaggggaccatctgggtcgatcgcgacattccagggatatgagatcaatgggtacacattctacatgagagcccaagacatgaacagcacgaaccaaaacagcgctgttcatatcgatgccatgggacgcgatggaacaactggcacgtattatggtgccatcgaggacatataggaacttgactatggtcctctcaaggttgactggtcgaggcgtaatgattgatgacagtgggatgacaacggttgaccttaacaaggttggatactcggacgaacattttgtccttgccaatgatgtaacgcaagtcttttacgtgaaggacatgtctagcaaaggaaagaagggcagagggcctaacgagtcgaagcgtcacgtggttctcccatgcaaaagaaaaatcatcggagtttaggacaagactgacgaggattacgatcagtttgatgggcaaccccctttcatggtgacgattgaccctagcatcctcctatcaaatgaagataccccttactcacgtagctatctcaaggagggaacaatagtgaggagaaagtacgtgcggtcaaccgtcaccgccgatgtattgccgtaattattgtgtatacgatgtaaactattttagatgtattgattatccatataaatcaatttttgtatggcatatgttaattacttatgattattagaggttttaacaattttaaatcatgtaattgctagttacatgcgataattagaatttttaaaagttttaagtcatgcatgtggcatttacatatgttacttagagtttttaacaattttaaatcatgtatatgctagttatgtgcgataattagaatttttaaaagttttaagtcatgcatgtggcatttacatatgttactcagagtttttaacaaattttaaatcatgcatatgctagttatatgcgataattaggatttttaaaagttttaaatcatgcttgtggcatttacatatgttaattagagtttttaacaattaatttaatatcattcatatgctaattatatatgattatttgaatttttattaattttaaatcatgcatgtcgtatgtatatacatatgttaattagagtttttaacaattaatttaatatcattcatatgctaagtatatatgattattagaatttttattaattttaaatcatatatttgcttattacgttttatccacttaatttactacaaacaacaataatttttcgaagtaattgtcattaatttttcgactttaaataattttaatgcattattttctattttagaaacacatatgtaatggatattaatattcagtgagcttatcagtagtcccggttcttaaccctaaccgggtttaaaaagaatttggaaataacgggaaaatatctttagtcccggttgatgagaacaaccgggagtaaagatatctttactaccgggactaaaaatctaggggtatatatattcccgatgcgcgccctcgtcttctccaccaacacttagaagttttttccccgatcgatctctctcggcttctccttcgccaccactgcctagggcatccccgcaccgatgctgccg

SEQ ID NO: 93832 - DNA, 1413 bp, Oryza sativa
agaacgggcagtccataagctgccacaagctttcctcttcactttgtatacccacttccaaccaatgatatttttgccttgctaaggaggcacaaggtgccatgttttgtttctcattaatgcagtatactcaacatccattgcatttctccatctttcatcagttaaagcctcatctaaagtttgaggctcacctgtagcagcaaacccagtatatttatatggaatggttccatcagtatataccttaggtttgcggattcctccttgcaaccgtgttttcggtgttgtaggttctccccctgtctcaggcatcagtatcgtctgctcgacagtactatcatcaggagtactacttgcatctgcagcaggagccatcccctattagattgattctttttgggacgcagggagtaggtgggcataattaaataggcttatgtgtgattagttgggaagataaagtaggtggaaaattaaatgaggaatgttgtaattggttgataagagaaaaataggtgaagttaatatatttggcacaaaattcaactgctagaagttgttatatttttggacgaaggaagtagtacgagtgcttactggtatttagaatgattgagaaatttgatgaatatcgttaggcattcattcttttatgggcatgagccggatcgaatcctgaatgtggtggatacttgtcacgccccgagctagtcccgacttgaattagcccgtgacgctccaaattaacctgttaatcgataccagtcccaagaaacagtgctggtatcacaggaagatagaatatcacagcaacagaggtctctttattatagagtaggagtacagtcatgttgggctgcggacagatcccgagctcacaactgcattacaaaagggaaacggaagccgggacttggaccaaacaacacaggcgcgacttgggaactaggccgaaaccctaaaactcatcgtaaccggcttgctcctggaagaactcctcatcagcaggatccgcttcatcttcatcagcaactgggggggaatatttatatagagcaagggtgagtacgggagtactcagcaagccaggggaaataagtgtttaatgcaggcttcaaggaaaggctgttgttttcgtaattgattttatttgaactcttttctaaaaacatctaggtgagtgcttctcaaacgacacggttgagacagtgcgtctcgtccggtcggagtatgtgcaatgtatcaatctttagaatttaaacaagggtggcaccccggcaacagctttttcaacggccaccccggccaacaactttttaaacgggcaccccgggctagctgatccattagctgcagatttttcaaacaccggaacccttttaacacagcaatttcacagccggagtcaat

SEQ ID NO: 93833 - DNA, 967 bp, Oryza sativa
  unsure (1)..(967): unsure at all n locations
cggcgtaggatggacctatgagatggnacagnacctcatcagggcggcggagcgcgtgggggaggaggctccgcggggttctgggcggcgcgcggcgccggtggttgctacccggcggagacggagacggtcgcggtcgcggtcgcggagcccccgcgccgcccgcccgcgcgcggagtcctcgcggcggcctacggcccgccgtgcccgtgcccgtgcacgtagcccctcgctagagatcatcgacgtcgacagcgggagcgacaggggcgtggtgcgcgtcaaggaggagccgcgttccggaagcgactcggactacaatggtgcgagaggtcgtgcgcgtgcgcgggcgcgggcgccggtcgccgccaccgccgcgaagaagaagaagaggaaacgaggaaaggaagctccaagcagagcccaggagagccgggaggttgtccgcgtcaaggaggagccgaattccgacggtaatggtgcgggaggtcgtgcgcgtgcgcgctcgccggtcgccgccgccgcgaagcagaggaagcgaggaggaagagaagccccaagcagagcccaggagagccgtgtgcccgttcaaatcaaggaggagccgtattccgggagcgattccgacggcaatgtggccggtggccgtgcggtcgtgccggccgccgacgcgaagcaggggaaacggggaaagaaaaccccaagcagaggcaaagggcggcgggtggttgttcgcgagacttccacacccgctgctccgtccaatggtgctccctccgtcggcaggggaaaaggtagagggcgtgggagaggtcgccagagaagcaagggcgctgttcgtggtcgcgctactccggtgaaaagagtgagcacgggtgttggttgagaactcggtcacgcttgcagancaggggaagttttttccaaaanntnngngnggnccatgggacgtatcaccaagcgcgcg

SEQ ID NO: 93834 - DNA, 663 bp, Oryza sativa
  unsure (1)..(663): unsure at all n locations
gtggggagtgagacctaactnnnnnnnnnnnnnnnnnnnncattcgcgccgcccgttgtttcccgcgcgcgcgtgccgagtggccgaccgcccggtcgccgccgccgtcaccctctgccgcgccagcccgcgcctgtcgcccgtgtcgtcgcgccgctccaaaccgccccgccgtcatcgccgtcgtcatcgcccggcccccgccactccgcgcgctagcctccaaggggcggaggcagagagcccctctccctctgccgagtcgccccgctccctcctccttttcccgaatcggcaaaggggcgagcccctttctctccctccttttcctctttttctcccctttttcccctctcgccagcgtcacctcctgtcgccgctttggacgctagccggagcgccagctcgccggcttgaccgcccatgtcggttcccctctctcaaaccgacattgccacccttttaaacccgtcttccccctcccttcctttcctctcccattcgcctcctcaccgttgtcgccgctcccgtgctctgccttgcctccgccgtccatcgccaagcgccgggagagccggtgcgttcgtggacgcggaaagggactccgggggcgcccccttcttcctctttctcggcccgaggccggagagatcactcccgcgc

SEQ ID NO: 93835 - DNA, 6059 bp, Oryza sativa
  unsure (1)..(6059): unsure at all n locations
aataacagcacttgtatacaaaggaagatatattgccgccagagtttctaagatgcattgtgggtatgcgaggtggggccatattctatgttgtatggnnnccacctattgaatgaattggttattagattggctatagatgaattgtagctagtagtgggctatactattaaacttgctctaaaaggtgcctttagttagaattccttgtaaatnctagtgacaaccaacactgtaccagattgtgccaatatattaccgaatgaagattttgaattacaaaattgaggtgattcctcaacagattctcatgcctcccatcccctcaacagagtagcctttgcaacccggttaacccccaaagtgaatgcccccatcctaaggttgcagttttgggatttgcacatgtccttgatgttctgaaaagcgttcttcatgtacttttggagctccctgttcaccttctcttcatcccacatgaagccctgaatgttctgcaccataggcgtagcacaaacatatgccattagattcatgggaaagatccaaagaaggcacaaaatcttctgttctattacctgaacccactcaaaatagctgacgaccacgccgcctgaatttgcatagatatctggcagcacaatgactcccttctttgcgagtatcttcaaggcagagagtaagctcaaaagattagaattataaataaattatcattcttgatgtcttgaggatattcatgttccttgaaggagagagagagagagagagagagagagagagagctcattgtggttttgagcttacctcatcagcttctgtatcagtgggatgattagccccctcaattatgaatctggccttcacttcagctgcattttctctgcagataactcatgtgaattagcaattctgcaacatgcagctagactaaggtagaaaactaaaacagaaaactccacaatacacagctaacaatttttggtatcatgacaccgcacacactaccaaataccaaggtgccaatatttatatgaatggaaacacaggaaaatataaagcaaatctcatttgcagtttacaaacctagaaactaccataggataaaaaaaaactgacgtctaagatttgtcctcatcaccccgagtaaaacttttactctcagatttaataataagtaaaaagttttattgggagtaaatgctttactcagaatatcttagacggtttatttttaattggatcctacgttagtttttaggtttgcgctacatatgaaatttgtactacatatttctttggaaacactacggcctaataatgagatattggaaaccaggtgaaaatgtagcaaaaacatcaatcaaattaccataatacgagattcttttatcaaatgcagcaatgcgccgttcttacatgttgagaacaccacccaaggcgcacgggacgagaacatcacattcatgcacaagcagctctgcagcgtccataacttctgcaccgtagaagtcctccaaagatccaccctcgctcctgtgcttcaagagagcaggtatgtctatcccggatttatttctgattgcacctgttacatctccaactgcaactatcttgccacctttctgatggatgagcttggctgcccaagaaccaacattccccaaaccctgcagaaaagattagtagttgatcaagtacaaagttatacaatttttggcatcctaatattaacatattgttaagtcaatcaataatgttgtcattgttacctggataacaaaggttgatcctgaaattgactcgctgtattcagtcaataaagcctcagtagcatacataacaccgcgaccagtcgcagcatctcttcctaaggatcctccaagatcctatatcaaataagacaataagttaagttaatgataaaatatgaagagtttgtctagatgaaataggtttttcatgactcatgtaaactcacaattggctttcccgtgacaacagctggggaggggccatggaactttgagtattcatctagtatccatgccatggtctgtgacagttgaaaataaaattttcagaaacatgtaaagaagaagcagagtatgaagacagcagatgataaattataaggcagatggaattggatgactcacctgtgcatttgttcccatgtcaggggctggaacatctgtattgatcccaatgaggtcatgaattttctgggtaaacacgcgcgttaaacgctcaagttcacttctactcagttcaccaggagtgcacccaatgcctccctttgctccaccataaggcacagcagcaacagcagtcttccatgtcatcagctgagcaagtgcattcacttcatctgggtcaacctgtccagggagaaaccttgatggttacaatactaatcgatccttctaaagacctactcttttggaacgcaagaaattttgtagtttctaaaggaattggcagaaaaacatcatctcctcacctcagggtgatacctgatgccgcctttcatcgggccacgggaattgtcatgctgcactctgaacccaacaaacgtcgccaaggtgccatcgtctttggggatggtgcattcaacctgaacacacaaatgccaatggttcagtgaagccgatgtgaaccactgaatcaagcatcaaattgcgagaaacagagaagcaggaaatcacacaaatcacacagagcatctatcaatcaatctatgcaatgcaagcagggaatcgggtaccttgatctcgcggagagggatcagaaggctcttctggagtttggagtcgaggccgagtagcctcgccgcctgccggaagttgcggctggtggcggctagcgcgttcatggcagcaccggagatcgccctctttttctcacagaattgcacgaggattcgacggaaaacaagcacaagaacgacgagaagctcacgagacggaaatttggcgaaccaaaggcgtgattttcatctctggaatccgaaggcattaatagctgagtgactttgaaagcgtgccgggaacaaacaggaactctttcgagaatacaaacaggaactctattaggctcggtgacacggcattgcaccgctggttagagcctaatagaattattcatcaagaaagttattctgcaagggaatcgttgaaagtagagagtttgtcgaagaagaaagggtgttttgatgctatctttctgcattattttcttcagttcagttggctggtggatcgaactgctcgagtcatatactagtacgagtcaagaattctcgacgttacacaagcaggacatctgtggaggcacaaagcacgtaacaagtcccggggatttccaattggatctgcagttctgcacgatatcgagaaggcactaaactgttttcggacacgtttttaatcaagtagccaaagtgttttttgctcagcgcagagcttagaggtcttggaccggcgtctcggttgaaaaaagaagcgttttgaaagcatggacctttgaacgtctgttctctcagttctcagttgtcacaaaatttccaggctttgcaccgtgcaaacacaagctaaaacgtgaagctcaccaacgtgtgattgcatggttgaacggtggtagctgcaaccagcgtttaccttaccgccggtaaccgcgcggttaccgggcttaccgcggggtacggtaatataaataccacggtaacctccttatattcaaataaattttaaaaataatttgattttttgataaattttgcacggtttttcgcggttaccgcggttaccgcgcggtaaccgtgcttaccgccggggcgcggtaaccccggcactggcggtttgggaaaccctggctgcaactagcctgagacgcgatctcccaaatacccaggacactgaaacgtcaatggatttcgcaaagcacagagctagttagtcaaatgaggactagtactgcaaccagaatgtagaagaagcagacaaaacaatcgccaactgggtatttgtaaaagcagtacaaccaaatgtcaaccatccattgtgccattgtgcagctcaagaacagatcatctcatggttcagtatacgagcttcagggtcatccattcgtgcatctggcctaggaactcaaggaagccctggaactctaagcaattaaaaaaaattcccctattctcaggccttgcaggtttttctacaatttctattcagtcctttgagcatctatagctgagcaaaattccaggcagcacagtatggcggtgcagacacattttcctctccacagataagaagcagcgctgcattccctaaattaagaaaacacataagtaacttgtatacgtaatttccagttaggatatagatgctgatcaactagtaacttatataccgatgtgcctttccatatacttaccaaggatatgcaacctccctacaaaaaccgtaaggctcagttacaagatcgtacatagtatgaagtatgaaccgagaatcttcggtcaggacatagggacataaaaaataaggcacatcttcatgcttccatcgctacagttctaacggtgcctagatcaccacaaaacatggtagcaattaatcccagtttcaacatttgagcaatcaacacttcaatatcagtcgcatagcctgacagtgaataatttattcacatcaacattcctgagcttaccatcctccaaaaattcaggtgattttcttcttgagaagccaaaaaaatcagatatggatgaaacttgagtccgcatgcctacttttccgcaaacaacataaaaaaggacaacaaagtttagtcttagatgaatcaaactgacattttaatctcaaaagaatcaaattgcattttagtctcataagaatcaaattaccagatttagctgtaagtttactgttagtgagaatggagaatcttcacaaacatgtctttgagctccctatgtgatgtcattgcttccaatatcttgtcattgaatatcacttcttgagacaagttgaatcctgcagcatggggttcttttgaaaatagcagtttggacatatgatccttcttagcttgcctatcatatttgtccttctcctttgtcccttctgtgattagattgtatgtatacacaatcttctcttgaccaattctataagctcggccaatcgcctgccttccaactgaagggttccatacaacatcaaggagaaccacacgtgatgccccgataagtgtaatgccttcacagcatgccttcgttgatgcaagcattaccttggcattgcttttcatgtcattgaaggcctccatcaaagcttctcgattttgaacaaggacatttccactcatcagtaggatctcctcaccttctgtccaattgaacattttactaagttggtccatgatcagagatagtggttcaagatattgactgaaaacaagtactcgctctttcatggcttcacacaaacggacaatttccaaaacaaattttgttttgactcctacgcacgggtttggccgtaagctcttcagcaaagagacatccacagaagatgtttctttttccgacagttttgcacatgtgacgaggaacgggtgtatagatgcaagggagatcttgtattctgcatcaagagtccccattgtcactgtgttctccattgctgtgatgatttccttttgatgaggaagaggattcagaatcacaactgattctctcaatcctggaagagacttttgaagaatgtcaccgttatggatgtgcacaattggatcgagtatttgccggatttcatctatctttttctctgttatgttattcagtgtcaaggatgtccagtaatcctcaaggcctattttcttgaaacttttagaagcgaagtgtcttgcaaactttggtctaatcaggtacaggacattagagagctcaagaaagcttttctgaaatggagtaccagatagaattattcgctttttggtgcgaacttcttcaagaaccttncatatgagactnttcttgntccttggtgtgg

SEQ ID NO: 93836 - DNA, 3534 bp, Oryza sativa
  unsure (1)..(3534): unsure at all n locations
gatgggcctttgaaatcagatctgcatgtagnncancatgaaaagcgtatagctcacaccaattatactgctccctttacgccatgatgccaacttcaactttcgcctaaatttgtgatccaatttgtttctagccaaactttgggccaaattttcatccatgatagccagctgtttgatggtcctgtcttctttccagttaatctccttggagttcaatacatgaaaagggaccttcaccttccattttctgaactcctgttcccatgtagcaagcatccctctgggagcaattatcactggacagcactcgggaaaaaacgcaaagtaggattgaacaaatgtgattgctagtctggtcttccctgtccctggtgcatgagaaatcacacagccaccttcaatagtgtttgcattgttcctcagctgttcaattgaagtcccccctgctagttttctccacatgaactcaaaaccttcttgctggtgcgggaacatgtcctcccggaccccaggaactagatcccaaaccaggccagtctttttaccaccaaaatcacgtggtccttcatatcccgctgatgttaggatatcatcaaaaaacaagtctaactcgtgatcttttctcatgtccctttcagtacaggactttacctattgaatgagaaaaaaaagaaaacatatataattttttgcaagataatagatgattaatcagaagaaaggcaaaagcatcagtcaggtgaagtataaggtctttgggaaacatgttggagtgtacggtagtagcttaccatggagggaagtacgaatctgatttcaagatcaacaaagttgcagtgcttgcatcgaagtcctatttgctcatcaataatgagctcatgcttcccttggatgcatgaagctgctttgtccgcagggatttcttgctcatcttccttttcaccctgaaaacaacgatatgagcatcacttttgtatttagatttttttactggagataaaaaaacacagaatttccaaaagaggtttacatttgaatgcatacaaaagttaatgtttgtcctaacatgctgagaggacaaacaaggcaactcagacctccctatagggaggctttacaaacttattctgacaaccacttcctgaggctgatggatatccacaaagaacattaagctaactcgtgtattagcaagggctattgatgatgcatttattttgcatacttatatgcatataaaattttactacaaattaaatgatactacagctatgaataatcttgtgaggcagcaagactaactttctttttaaatatatattctttcttttttctttttttttgaaaccgagcaagcaattgctggtgttatattaagaaaaggcagcaatatttacaatggtgcaagtaagcagttgcacttagaaagggaaacaaagcaagaaaaatgggactgcgactgcgccatacatatatattcttatgcaaacaaaccttttgtttcttaattactctttgttttgaatttttatgtacataaatatctattcatacacaaaagacaaaacagtttattgttctataaattaatgatcaatagtcaggtttggagcaggctgatttaatttcaataatagtttcagaatccaaaactagtcattagacacatttacttggcttatataagatatatatagaatccatcctagctattattcctgattaaataataaacctcacattaaagccattcaagaaacacaaaagtcagggctgatagcgcacttctattgacataattagaattatcattttagataataagtataattctaactatatttgcgtagcagagagcacgatgtacctcctcgcagttgtgagaacaaacatttatggattccaaagcaaaatcaaattctttccacagttcatcttcatcctgtaacttgtcatgtttggatttctcttccagcttatcgtcatccccaaatgcgaataccaggggcaatctcctgtcaatttgctcttcaggaacaggctcatattggttgctctctatttcattaaacatggggtcgagcaaatgaccatacttttcttggtctgccgttgcttgcctgcgcttcctcctctgagcaatctttacatttctcttgaaggatacaccaccctgtccattgagcccatttgtttgtctcccaacttttggtccattgtttctgacgcattgtggagtggagccatcctttttcttgttggaaccctccttcttaacctgcctacgaggtgctccttcttgtaccctcctagaacctgatccttccttgacatcacatacaaatgttgtatcctcctcgctatcactatgggcactttgcctcctgttcaatttcctcctcttcacagctctatgctcctcattgccatcgctgccgccatcgtcatccgcacaatccccaccgtacgccgactgctccggctgtggcacatcctcctccgaccccgagctagacacatcgatacaataaggcttcgcgaacgtcccacgcttgagcagtttcttgtccaggagtttcttgcgtttgaaatttgatcgtgtgcgagctctgatatccctgccagtcgaggtgtccacctgttgtagaaaactaaatccctcaaacatcctctttcccatcagcggcattgccatgattcttgatcggggaggagattcctcaccggcctcacccggttgatcaggtgcatcacccggttcctcctcctcctcgtcatcatcatcatcatcttcttcttcctcctcctcctcctcctcctccaattcctcttcatccccttcctcatcgctgaagttctcatcgctatcatcactggtttcatcttcatccgtacccaattcctcctcctctatctccgcaacatcgtccgtacctccaccttctcccctgattccaccattgccatgatcgttgtcatctgaacgaacctccacctccacctccatctccatctcctcctcaccttcttcttcgtcctcctcttgttcctccacttgttcttccttcacttgtgcaaaagctctcccctgctcttcttcttcctcctcctcctctcgttcctccacttgttcttcttcctcttgtgcaaaagctctcccctgctctgccaagcgtgaccgagttctcgaaccaacacccgtgctcacccggttcaccggagtagcgcgaccacgaacagcgcccttgcttctctggcgacctctcccaggccctctaccttttcccctgccgacggagggagcaccacttgaccgggcaccgggtgtggaaaatttccgaaaaacacccgccgccctttggctctggttgggggtttcttttcccgttccccctgtttcgtgttggggggcgggacgaacgcacgggcaccggccacattgcctgcggaatggtcccggaatacggctcctcttgatttgacgggcacaccgttcttctgggtctgttggggctttttttctcctccttg

SEQ ID NO: 93837 - DNA, 3015 bp, Oryza sativa
  unsure (1)..(3015): unsure at all n locations
cgcgatgtggttcgttcttttttttaacattctactatacttccctccctcccgccacctttacttatatttcttcntttattgnccgnctggccncccnccnnnncggtggtgatgactcggtcgcctttaccaancagcctatgcatacaggcagcccacgccttatgaagtcaattatcccacccatgatctcaagttggcagccgtggttcatgctcttaagatctggaggcactatttaatcgggaacagatgtgaagtatacactgatcaccaaagtcttaagtatatcttcacacagactgagttaaatatgagacagagaagatggttggaactaatcaaggattacgatcttggaatccactatcaccctggtaaagccaaggtggtcgctgatgcgctaagtcgcaaggcctatcacaatgtagctcaaatacggcctgaccaagatcacctgtgcagagaattggagaagttaaggctgaccgtggtacagtcaggtgtccctgccagcttgacagtatagcctaccctagagtcgcaaatccgggaggctcagaaagacgacgaagggataaaagaattaataaaaggaatacaggagaagaaagacaccaatttctccatagacaaccaaggcacagtttggtgcggtccacgcatctgtgtaccggccaagaaggagttaagagatctcatcctcaaggaagctcatgagtccgcctattccattcatccaggaagtacgaagatgtaccaagatatcaaggcatacttctggtgggctggaatgaagcgagatgtcacagaatacgtagccctgtgtgacatttgccaaagagtcaaggcggaacatcagaggccagttggtctgctgcaacccctaccgactcccgagtggaaatgggaagagatcggaatggatttcatcaccggtttgccaagaacccccaacggatacgactccatttgggtaatcgtggaccgactcacgaaatcagctcatttcgtgccagtgaaaatcacctatgatggaaagaaactagcagaactctacatgacctatgtcgtatgtagatttggctgtcccaagaaaattgtgtcagaccgaggcactcagttcacctcaaggttctggaagcagttgcatgaagccctcggaattgatctgaattttagtacagcctaccatccgcagaccgatggtcagaccgaaagggttaaccaaatcctagaagacatgctacgtgcgtgtgccttggatttcgaaggcacttgggatcgttgtttgccgtatgccgagttctcatacaacaacagttatcaggccagcattcagatgtcgccgaatgaggcaatgttcggaagaaagtgccgcacccccttgtgctggaatgaggtgggcgaagcactggtattcggtccagacatactcaagtcagctgaagaacaagttaagctgatacgagaacgtttgaagacagcacaccgtcagaagaattacgcagacaatcgaaggtgtgaccttgagttcgaaaaaggagatcatgtgtacctgcgggtatcaccactccgcgcgctagcctccaaggggcggagggagagagcccctctccctctgccgagtcgccccgctccctcctccttttcccgaatcggcaaaggggcgagcccctttctctccctccttttcctctttttctcccctttttcccctctcgccggcgtcacctcctgtcgccgctttggacgctagccggagcgccagctcgccggcttgaccgcccatgtcagttcccctctctcaaaccgacattgccacccttttaaacccgtcttccccctcccttcctttcctctcccattcgcctcctcaccgttgtcgccgctcccgtgctctgcctcgcctccgccgtccatcgccaagcgtcgggagagccggtgcgttcgtggacgcggaaggggactccgggcgcgcccccttcttcctcttcctcggcccgaggccggagagatcactcccgcgccgtcggcctctcgtcactgcgccccgtcccgcacggtagtgcctctctccgttcttcctcctcgctccatctcctccccctagctttcggtagtagcttgagtagactccccgtagttagccggcgccgccccgaccgttgccgtcgctcgccgtgtgctcgccgccgtcgccgcccgagctccgtagcacccgctcgtcgccggcctcgctcggcatagttccgtccaatccgacgctagcgtcgagttcccgacgccgcgtagatgctctcaccgccgggaatcgacccctcgtagcttcgtcgccgttttccccttctcccgccgccggttgccgcccgcaatgccgtcgagcaacctccggcgaatccgagccgttggttcgtctcccctcgtcacgaacaaccgcccggtgtgctcgctttgcccgtatcaccgtggttcgctccgccgctcgccgcgccgccgcccgccgtcctttcgcggacggatcgtcgtctacctcccgccagcccacgtggcagccacgtaggcgccacgtcggtgccagctcagccagaccgggtcgggccgaccccggtcggtccctccgcgtgcgcgcgatccaccgcgagccgtgaggctgcgcgtgggcccgccgcacctgcgttcaccgcggaccgcgcgcatgcaccgcgttcctttcccgcccgcgcgcgtgcaccgtgtgctccctccgcgcggtgagccgagccgctgacaagcgggtcccacccgggaccgcgcgcggtgagcccggtccaccgggtcccttttttcttccctcccgcgcgcgctctgggccgccttttgggcggccgggccattagcttggccgagccgcccaaatcccttgggccgacctaaccgcccgaggaaatctaaatttctccctccttctttttttttttttgcaaaaggggttaattaatccttttctttaggccaaaaatcaaaatctta

SEQ ID NO: 93838 - DNA, 5935 bp, Oryza sativa
gatttcacaggtgatctacatgtactactggatttgtggtccggtcagaccgggcatgtgctgccagtcagaccagcttgtattgcccggtcagaccggcgcagcccgcggtctgaccggccgacgctgtgtcggtttcggtttcgggttgtttatttggatatctgtgattgtttcatatttatggcttctagattgatactatgcatatgtaatactgttgtttgctactaatgagtcaagttggagatagcttggtctcgaaatatggtttctttgtttgtttcatgtgtaggtgactcgatgcctcgggagagtatatttgcggtgatggaccgggagtcgacttggtgggaaggagatgtccgtggtggtcagatatcatgcgtgatacttaggctagagttcaatgcacgtggttggtgaagattccatatggcggatacgatggaggtattgtgtgcgtatgggatacggagtcgaatttggaaggagtccaaatttggtatgattggttatgtaaagtttgtttcttatacgaaaaggtttcctagggggattaggacttctagtatgagtttggttcatgcctttaggctgcctacctcatgtataaatagagagggagcgtgaggcttcccggtatcgcttttgagagcaattgagttgatagtttacttagggtttcgagtttagtcgagatttttgtaaggagtgctgttgttgcactttgtaaacacagagagaatcaataaagtcatcatccactttaagagttcttcgatttgtgttttctcgggtgtggcggtccaaccgacgagacaccggcggtcagaccggcgggcacacggtggtcagaccggcggcggcgacaggtgctggcgattgacctcggcggttcgaccggtgttacaacctcggtcagaccgacgtgttctaggcggtcagaccggcacgtctacttcggtcagaccgcgatccatcgaatttgagggtaacttttaattccgataaaagttttggtttttgggtataccaaccattcacccctctctggttggcttagttcttgtgtttcgatcctacaaatctatgttgtttaacgctagttaataataaaagggagttgggggtttgtctcattacctatcgtccctttttatttgttgaacaaacttatggttgtgtgctttagggcagaagccggagaaaaaaatatcatcagctgccacagcatcatgatactcacatggatcgatcagcttcctgtcctagaagaggtgtacttatacaaccgcaaccaatggtgaatccagaacaaaaattaccatgggtcatatacatatcatagcgtatataaaacgctaatttttaactattagagcctgtttgaatcataggaaggaaaaaaacaaagaaataggaaaacacatgattctgacatgaatataagtgttaacaagaggattgcaaaacacaagaatgattgtttgattggaccgtaggaaaaatacaggaatcggatgagagagatagagtcaaaggaaattttccaagagattggagctcttgctaagtttcctccaaaatccacatgcaatgagtcattacataagatttggaaaccttcaatcgtttgaatcaaagagccaaataggaaaatttcctataggatttgaatcctataaaattcctacataaattctttgattcaaaggggcccttaatgtagttaatataggctaaaataactaaatattgaaattctacttaattaaggtcctaggttaacataggtcactgccactgactgcaattcacttttggaggtagtgagtgatgatgaagaataaaaggtgtattgttgcccctctctctatgatgagtttgttgtactcgtgccatcatttttaagaatagttaatattgcaagacgatgtcccttgctagatcatatgcctttgatgttttatgagaggcgaattttatagctgtaatcaagcaagcactcactggtggggttatatcatgcatgatctgtcagcatggagatcgtttgtcactcaaagaaaacatcagatgttgtgtcacggtcatgggacacctgcatcaagaacacgatgaaccgaacggcttcttcctcctctggctctcttccttctctctgctattcctcctagctcaagctttcatttctctgatctcccggtcccctgctttccaccaccccaatctagcttctaatcccactctaaacccctgtttctcccaaattgtatccctgacactttgatatatggtgttggagacttggagttggatcatctcagttgtgcttgtgttgtcgggtggaaatcaagatgggtacgtaacaatatggtatgagagcaatcgatcccgggttttccggtgttaagatggtgtgggagagcaacttggtggtggtgtctttggaggagacgctgaccacctgttcggtgaaatgccggaggcgactcaggtgccacccttcgcgtctccgtgagccacattgtctacccagtgacttctgagatgctgcatctagtgtacaatacccatggagcagtttgatgctagttgtacgttcctagtccatccaataattggaaagccctggccatatataaaattcactatcctaaagatttaagcagagtgtccatcttaatagtaggatctgacactagtctggtatttacactgtacttctaaaagagacaaaatgacctactcctaatggttcttacatgtacagagctcatgaaacacttctgagttctgacatttaaactcacctaaggtctcaggctaccagcaatatctaaagatgatgactcattggtgttgctggatgatgcttgtgctgcagtcatgctttggctctgatcacttagtgtttgccagaagttcctgcgctgaccgcttgagctcaggctgtttgcagcaaggctgaggtctgacagaaatggttgaagtggtatgtgcccctcaagcaggctcaaaactttggtcatctttggtctcagtgttggtgctgcattggtgcacaggagggcaacattcagcatgaggagcgcctcttccgttgagtaatcggagcctaactctggatctaccagctccaggagatttcctcgctcatgtagaacacaagcctgcaactcatttaggagagaatacttttgaggtatgtacaatgtgaatgtagcatgaattgggaaatttaagaatttcggtttgatgaaaatactgtttgctttaacaactttctaattaaaatgcttgttgtgttatctttgaaataaacaatatgttggacaaaattaaaccagtaatggatgctgtttgtttcaaattagaaaaaaaatgccatcacattgataactaaagatctattcctttggttagattgttacataagtcaggtataatattagcggagtttggatggaattcatcaatgtccagaagaagtttaagagacaaaatgccggctaagattgagctaaattttagtgttcataataaggttcctataaatgtgcttccatggtcatgcacagaacattattgcgttaattggaaattgaccaatgtgccagtaactggtaactggttattctaagcatggtttaggaattacccaatcgagaagataaacaaaatcttcctttggcctgtagcttgtgttactttttccactaacaatttccaaagcaacaaccccaaaactgtaaacatcagctttgtctgtcaaataaccacgcattgcatactcaggagccatgtatccgctgcaggaagaataacaacaaaatgattgagtcaaatatctgctctgtagttgaatggaattatttggaaggggcatggagagaagaagtaatctccatcaatagttgttcatatggaaattgatttcagtagtaagaacattaattcctttgaattgttagtctacatatggtggcatctatttgttactgtttttgtgcaactacgtgccttgtaggatcctacattttatttcggttttttactatattagctaccctcagagtttccataaaccatacataaaggtcgcaatgttcatttttatctaagttctaactgtcatgtcatttaaagacttcctattgtagatcaatgagacttgggacacgatcgaaattaaatttggggggaaagggggtatggaaatcaaaaagaaaacttacatagtcccagctattcttgtacttatgtgtgtgtgatcatcatcgttaagctttgctagcccaaaatcggagatcttggcactcaagtctttgtcaagcagtatattgctagccttgatatctctgtgcacaatccttattgcagactcctcatgtagatatgctaaaccccttgctattcccaggcaaatcttacgtctcgtcggccaatccaagctcagcctgtattgttcgactgtacctaatcacagaaattgcacatgagttctaacatgaaataagttaagaggggaaaccaggaaattagaaagtaagattaccgaaaagagcacgcgctaggcagttgtttcccatgtattcataaacaagcaagagctggtttccttctgtacaacagccataaagcttgacaaggtttgggtgctggagtgcagatatcatgcctatctcattcacaaattctcgattcccttgtttagaccttgatgatagctgtttgacagcaataatggtgccatcagacaacagaccatgccagcagctcaaggatccatcataagaattgtgtacatttttagataatggatattcattaatccggaagaattgtgtacattgccttatcagactgccgagtttaagcatggagtcagtgatgatggctgaccttgtaaactgaaccaaaaccaccttcgccgatcttgttggccgcatcaaaattccttgttgccactttgatttgtctcaaggtaaaggatccagtttggaggtcaaaggctctgagatctaaagagaaagagacagggatgatttatctgttcccacataaatatataaatggtttgcaatgctagcctaactactttaactggcaattgtttgagaaatcaaagcatcctaggatgggttcgtctggtatagtgtaatctcttttttttttagataatggattttcattaatccggcctctatatccaccaaggatatacacagccaaaaggatacacgagcacttagactcacacctcaacaaggagaagaacacacaaccaaaaaagaaaagaaaatcaaacgacctcgacacatgcaatttagattgttggatctattgctagtattgctgaactgttggaacaagaaagatactccaatatgtggaagatagatgccactatgtcattcatgcaaattgaaataaattgagcaatcaagctctcatgtcacctttatgcattgagttctttctcctccatttaatccaataaatgccgacaaaaagtgctgcgcacattgctaaaattggcatggcaaccaggaatgctttagatatccttgaaagctttttgctacctccaatttgcggtggttcaacagccaaaggaacttcaaagtctgaataagcataatccaaaaccacaaggtcagtaaagaatataacatttttctttgaaaatcattatacaatcagtcagagttttgaagggcactgaatgtgttgttcaacgctgtaccattgctcatagtgattaatgaaacatgtcattcaaattcaatagattcaaatgtcaaaatgccatacttggtactactgatattgcagatatcagaggaccataatatcctctttttggaatgcctgttgtcccccttcctgcccaataaaaatgaatttccagtgtatgatttgtgacgtt

SEQ ID NO: 93839 - DNA, 1238 bp, Oryza sativa
tgagtgtaggagttctctaccctgcttttcttgcttgcacaactagttattatgatatgaattttgcggtactcatgcctctcatgatcattttgcaatattcttacaggtcttgaattatctggatgataggtgcagagttcacaaggaaacaatcaatctctgcaaaagcgtactgcagcgtaaatccattgactggatttcagtgcagcgaaatgatatgtctaatccaatacatgatgtggatcttgtgatttctgttggtggtgatggcactcttctacgggctagccattttttgaatagctcaattcccgttttaggtgttaattcagaccctacttgtcctgatgaggttagttcttcagattattgtcaagaaccatatgatccatgtttgtcaagttgcttttggcatgcttccaagcagactgatgcttacctgtatgcttggttaggtttatatatagattattcctttgcaggttgatgaattaactgatgaatttgatgcaaggagaagcacaggacatctttgtgcagctacggctgcaaactttgagcaggtaactttccattgcaattttttttggagcaatccaattcttctattacaggaactcgtactaatctaaacattaattaatgatacattgaacatgacgattcccagatacttgatgcaacccttgatggtagtaggcaaccttcagagttgtcaaggatctcagtgaaactaaatggacttcagctaccaacttatgctctgaatgatatattggtctcacacccctgtccagcaagtgtatcacgattctcatttaggtattgccttcaattctttgcgttaattttttaatttttttaatcaattctgatgttattgccatctcaggaagagaagcaacactggagagagctcgcatttaattaattgcaggtcaagtggtctcagggttgcaacgcctgctggatcaactgctgctatgctatcggcaggaggattcgtgatgccaatatcaagccatgagcttcagtatatgataagggagcccatttctccaagggatgctgacaagccactgctgcatgggttagttaagcaaggtcaacacatacttgtcgtttggtacaatgaggaaggcgctgtttattttgatggttcacatgtaatgcattcaattcagcatggagatacactggagatctcctgggtaccgagctcgaattcgccctat

SEQ ID NO: 93840 - DNA, 1637 bp, Oryza sativa
cctgtggagtggagccgtctgcgccgtttattttattttccggtggttagatctttattgattgagaggaactatctacctctgtaatgacattttatttcgcttattaattagagtaataattggactatattatcaatttgttattgtgtgcctcggctgattcctggacgagggttcacacacatgtaagcgtttagaattttggatagaaattccgggcgtgacagacggcgcccttgctgaggtagctgacgcgcgggtcgaacacagggccagcctgccggtggcacgacaccgagcacaaggagcactgcagctaggtgagcgatgagcccatgtcgacgaccatcacggtagaaggtcgccggcatgccgaggcccaggtgggtgacgtagttgcctacggctaccgacgcacccagcgtcagcggcacggacgacaacgacgcctgtgagccgcgccgctggccttcttcttgtggtggccgtggaggagagacgaccacgccgtgcggcaggaggtatactcattggagcaggagaacaggaactgatgctcagattgacatggccagaattttatccagcaagaaagaaaatctggagaccgcgggatcaaagtgcaagaaggatagcaagatgctcttcagacattagtcatctatacaatagaaaaataggagacttgatcaaaagaagctctgcacttgaagatcagcttgcgactgccttggcgagcacagaacaggcggagaatatcatcgttgtttggcgaggcacgagacgaggtgggcgatgcgtgcgtcatcgtgtgtgatgacgacggagacggcgggagccatcaacccgatctacgctgatgtcgtcatcgacatggtcgctgcccattcgtccaggacggcggtggccgtcgtcagcgacgatgacgatggcgctcctccagcgttggtgtggcggcaaggggtggcgccgaggacgggctgtgggaggcgatctgggcgacgagcacgcgcaagtacccgctcagccttggccacttccgtcttctgcggtggctcggctacggcaacatatcggcagcgtgtaccctcctcgagctccgtggcggcggcggcggcgccctcttcaccctcgtcgagtttgtgcggaggcacggccgaccgacggggaggagaagaaacaaagagaaggaagaaggagaggagaagaagagaaggaacaagacggaagggatggaaaacgtgacggcgatggcacagtttcaattttgcaaaatttcaatagcacctaaggatatcatgaatagtaatggtatttttctaaactggcaaagttgcaatggcatggataaaattaagagacaatccattatacgccactgactttatcacacgtccacgatttgccgctgactttatcacattctacaatataccatcaacttttgcttaacttctacgatttactatcgccgtccggttagtctcctttaggactgtacaaatttgtcaaaatgaccaaaatacccatgggacaaaaaatttcaaattttggataaaaattctgaaatatcaaaatttaaatttttggccaaagtttggatgtttacaatcttatgtttataatatgatatt

SEQ ID NO: 93841 - DNA, 678 bp, Oryza sativa
aaaaagtaaatcttttattcaaaccaatcaattatcattagacgctttacttaaaccttttaaagaacaaattgatggttttcaaaagcgggtgaatgaagtgcatagtgagtctgtcaaaggtaacacaaaccttgaagcagaaattaaacgtgtgttacaaattggtatttcaatgtcaacagaaactcagaatctaaccacagccttaaaaggcaataataaagtcctgggtaattggggcgaaatgcaattagaaagtaccttacaagctgccggacttttagccaatgaacattatgtcgcacaagaaaacttccgtgatcaaacaggtaaacgctttgcaccggattttgtcattcatctacccgataataaacatttaattattgatagcaaagtatctttattagcttacgatcaagcggtcagatcagaagaaaaattagcgataaaccaagcattgactgagcactgtaaatcactacgaacacatattgatggcctttccaagaaaaattatagcagtttaccgaaagtctctagccctgattttgtcttaatgtttgtgccaatcgaaccggcttatattgaagcaatgaagcaagatccacaattattcattatggctatgaacgtaatgtcgttctcgtttcgcataccaccttaatgcccatt

SEQ ID NO: 93842 - DNA, 685 bp, Oryza sativa
agtgcttgtgtcgttgttgccttacaaactgttggtgcaattttggtcattacgatggtaattacgccgggtgcaaccgcttatttattaactgaccgctttcctagcttggtgattattgcagcattgattggcggtttaacaagtatgttaggcgcttaccttagctatttcctaaatggcgcaaccggaggcttaattgtttgcttgcaaccttagtctttttatttactttctgcttttctcctaaatatggcttgctctcacagtatcgaaaacgtttagaggtgacccacaatgactgatttaattaaatggtttagcgagccttttcagtttgaatttatgcaaatggcattattaactgccgtacttgttgcttcagtatgtgcggtattatcttgctatttaattctaagaggttggtccttaatgggagatgctatttcacacgccgtgctacccggtgttgtggttgcgaatcttgcaggattgccactggctattggcgcctttagttcaggtttattttgtgccatctctattggttatctaaaagaaaatagccgcataaaagaagatacgttgatgggtattatgtttgcaggcctttttgccttaggtattgtactttttaccgcattaccttcagaacagcatttaactcacctattatttggtaact

SEQ ID NO: 93843 - DNA, 526 bp, Oryza sativa
gtacacgactaatcaccagttcattttcggcgatattttttgtaatagttgcaccggcaccaattgttgcgccatctgcaatgttcacgggggcaatgagctgtacatccgatccaacaaatacattattgccaatagtcgttttgaatttatttgcgccatcataattacaggtaatgactccggcacctaaattgcaattttcgcccacttcagcatcgccgacataagctaaatgattgacttttgagcctttaccaatgtgagcatttttaatttcaacaaagttgcctacgtggctttctgcttcaagcttagctccgggacgtaaacgtgcgaaaggccctacttgtgctttattgccaataattgcattttcaaaaactgaataaggtttaatatctacatcatcacccaccacacagttttttaaaatacagcccgcgccgatacgtactctgttacctaatttaacttcaccttcaaggattacgtttacatcaatttgaatgtcttttccgtattg

SEQ ID NO: 93844 - DNA, 709 bp, Oryza sativa
cgtaaaagattcgctcgccctattgtggataaagatcggccggatattcgtattcacgtttatttagatcgtgagaagctaattgtatcgctagacttaagtggcgaagcattacatatgcgaggctatcgtgaagataccggtaaagcaccattacgtgaaacccttgctgcaatcattgtgttacgttcaggttggcaaaaaggaacgccattagttgatcctatgtgtggatcaggcacgctattgattgaagcagctcaaatgcaagcgggtatcgtaccacaattacagcgtaaatattggggattcaacgcttggaaagggcatcagcaagcgatatggcaacaagtattagaagaagcacattcgcagaaaaatactcaaattgacccgcttttttatggttttgactcggatcatcgcgtccttgctaaagcaaaacagaatgctcaaaatgccggtgtagcgcatttgattcattggccacaagcggatattgcagcgttaaaaaatccgtgcctagatcagaaaggtacattggtatctaatccaccatatggtgaacggttaggcacaacacccgccttgattgcgctttattctgtatttggtcaacgattaaaacagcaatttgctggttggaatgtttccatttttagcggtgaaccatcattattgaactgtttacgtttaagatctacacgac

SEQ ID NO: 93845 - DNA, 827 bp, Oryza sativa
gtgagtaagtggattgcttgctcacttttttagtgagcccaaccgttcttatttgtttttatccaaattaacaaagatgaaggaatttgtaaaatgaaacaaaaattagaccgattacttgtgcaggcagatattcagttaactgaacggcaaaaagaacaacttattggctttgttcatttattgcataaatggaataaggcttataatttgacctcagtgcgcgatccagaagaaatgctagttaagcatattatggatagtttagtcgtcagtgttcatcttcaagggcaatcttttattgatgttggtacggggccgggattgccgggtattccgttagcgattgctaatccagataaacagtttgtcttgttagatagcttaggtaaacgtattacttttatcaagcaagtattacgtgaattagccattacgaatgttacaccggtgcttagtcgggttgagcaatataccgcacgtcagtttgatggcgtattaagtcgtgcgtttgcttcattagatgatatgttgaattggtgttatgccttacctaacgatagcggaaagttttatgcgttaaaaggtgtgtatgacggcactgaattgcaagcggttcaaaagccgattaaattagttgacgcaataaaacttaatgttcctcagttagtgggggagcgccatttaattgtattagcaaaatagattaatttttgtaagattaaccatattttctaccgcattaagcaggcttataatactgagtaaaccattacttacttgtatgaaattgttgaataattgtattaaaatataccaatgtgttg

SEQ ID NO: 93846 - DNA, 564 bp, Oryza sativa
ttaaatgcgtttgatctttataataagcatcttcagaaataatatcgatatcattggaatttaattcttctttcagttctttataaatggtagaagcaataaggcttttacctgaagcagaagcacctgcaatagcaataacgatacaagcttgattttcaatggtttctggcatagaaggttcctagtgtcagcgtataaatgagtgaaaaagtagcctattataccgtatttttgtaagtttttagctataattgaccgctaatttagcatacagaaacctaaacaatggcaatgctagtaattttccattgaatttataaaataaaaaacgtccaaactatttgtctgaacgttttttatttagattcaattataaataaaatttttcaatgaaatttaatttgctgtctaattttaaaactaatggttgacctgttagaatctcaaaatccataatttcagcatcagaaatcccgataatatgtttggcaagtgcgcgtaatgaattaccgtgggccgttactaaaacgcgtttgccagataataatgccggggcaattt

SEQ ID NO: 93847 - DNA, 655 bp, Oryza sativa
ctatttaataagctaaataagccccttatccggcatatacgggggattttattgcaaatatatataccattaattgttactatcctgttttatttgtcgaatgtaaaggtaaacggtatgacgagagatatttaagcgcgtacaacttgattaatcgcgtctttaatatcaaaaatgcctttttcatagagtgaaatcacaatgtggcgatttttgttgttatttaatatttgccgatctaccactgtttcctcaatggttttgtcaatggtttgtgcaactaattcatctactgaactagcaaagtttacgctgttattttcgtcatcttgtgtgcgtggaataaaagaagttaagaattgtgctgttggtacatctaaattaatattgatgcaaatgaatccgatgacatgttgtttgctattgcaaatagcgatggtgattgatttcatcaaaatacccccttttaagcgggtaaaatagggttttgaaacgctatcggtttgcatttgatgtaatgattttagtgctttatcggttaatggtgaaccaatttttcggtcagtgttatggccattagcgatataaattgcagagttttcaaggaattctagtgaatgtagtacaatctcacaatgttcaccaatcagtgcag

SEQ ID NO: 93848 - DNA, 1423 bp, Oryza sativa
acttcctatccaaatataaaaataattaattcccacttagcgcgagcaacacacatcaggcttagttaacctagtccttgaaagtgtgaaaaagaacaatagcttagctactgcgttttttcttcgctacaggttttttagtgactgacttattagtttcagtggctttttttgcaacttttttagttttctttaatggcgcgactgttttttgttgttctcgccattcatttaacttggctaataatacacttcccataggactaggatcgccggtaaataaagtagctaaaccattattctcaataatatgtcgacgcaatgctaaacggttccgtatgtttttccgctaaacgtagcgcacattcaatatattcatctacagtatcagcaatttaaccactctggtaaacctaagcgtttaaacagtccttcatcaatatgttcatgtacttaatcaccggttttacaaatgccgaccagtcctaaagtcaccatatcaataatgccattagtattcccaaatgggaatggattaagcatcatatcgcaattatgtaacacggttaaatattgatgataaggtgcgtgaggatatgctgtcgctgaatcgcctaaataggatttaataaaacgagcaatatgaggatgagtaacgccggtcgattgccctaatgcaaagtggaagtgaattttaactttagctcgatcacgaatcacttttaatgcatctagaaaatatggattcaacttcattgtagtggcagcaataccaatattaaccacttcaagattttcgcgttgcagatattttacttttttaggggctaaccccgatggtacgtaaggtaaagcatcttttggaaagggtataatgtttcactaaaacaagcctctgaaccaatataatcttcttcagcaatcacataatcaatgaattctgaatatgttgtggctgggtggcataatgcaatcacttgtatcggtgctagacgcgtattactcacaaaaatagtgcttaaatccattccaacgctaggcatatacagtactgctgctccgttttgtttataaatagaacgaatatgatctaatttatctttcatattgtcatcttctaacaaatgaaattcatcaaatactgcttgtccattagcatcaactgctttgctccccaaaccaattaaataaaaatgttcacgagcagcaatcattgaagttgaatgagtgtgataaatagaatgggttgaatggaaatgctctagtaacaccaccatcacgggcttatcattccgataaccaatgcgagttgtatcacgatcttgccaaccatattcattaacaacatggcgacgaataacatgatttaaagcttttttaaccgcatgcttattttctgcaatatcataactacagtgcatat

SEQ ID NO: 93849 - DNA, 753 bp, Oryza sativa
ggtttcaaatctagccctaaaagaaagtaatgaagatatttcagatgcaattgaacctcaaactagatcaagaaaacttgatgagccagagccgatttacggtacaattaataaatcaccagaagcaattgcacgagcaaatgcaaaagcagatgaggccatacaagctttaggctatgatccacgaattaaaccggttgtgcctgaagaggcacctccagcattgccgccgagaaacttgcaaactaaagctattagtgattacgatgatgtttcatatgtacctgacttcaaagtaagaaaaacagatgaaccagagccaatttacggcacgattaataaatcaccagaagcaattgcacgagcaaatgcaaaagcagatgaggccatacaagcttcaggatatgatccacgaattaaacccgttgtgcctgaagacgcacctccagcattaccgccgcgtacgcaatccttgatagattcaactgaagtaccaagctatagaagtgctttagctaatgtaaaatttgatgatgcatccccatggccacaaccaagtgcgttacgtagtaaggcttttgctgatgaaccttcatcagaaacgcctaagtctcgtggtaagcgtggtatttctaagaagtctttatcaaggacagttcaaccacgtagtagaaagatttcagaggaatatagctcttttggagcgtttaccattgcgtataatagataatgggtcagactatgctgaaatat

SEQ ID NO: 93850 - DNA, 602 bp, Oryza sativa
agtcgtcagacaaacagagccagaagtgatttatgaaaaaatcagagggcaacaagtagaagtagatgacccatcatcgttgtatgcgaaagtgaatagaaacagacgtttagataacgtagaaggtttttatccaccggaacagttacggacaagaagtgacaagttagcaaagcaagtgagtcgtgtaccgacaacagagccagtgtatgcggacttacgcttcaaatcggcggaggatgattacgcaccggcgctaccggcgagacggagctgggtaatgcggctggttttagaaaagcgaaggtaaaaggtgaagagagtgaatctacatggagtcgcttgaaacacttatttagcagggagagtggcaagaaagcacaagtagaaggaccggagataaaacacttaggcggagtggtagataaagatgcgttctacttccccttggataagatagtgacacgtcgagatgcggaaggagaaatccgagtgaacatggataacatcaagaaagcgtttaatccacgagacaagcactataacagccaagaggcgagaagcttaaggtcgttatataatcaagacccaagtatgtcagg

SEQ ID NO: 93851 - DNA, 790 bp, Oryza sativa
  unsure (1)..(790): unsure at all n locations
ccattagaaaattaagacggattggaacaatatccggaccccgcatganaaattctcgagtctcccacgtaaagcgcaatctgatttaggtgagaatgcattatcttatggtttacaaagaggcagacnagcattaatcagtaaagcgaatgcggcagataaagaaggcaaaaatgcgatattagcagacagttacataggcaaactgaatcttggttttgaatttggagaattaccaaaatttgcaaaacaagtgaaagatggcaaagtanccgagcaagatatacaaaatatcgcttcatttaatgacgaaacagctaaattagcgcgaagaagcgaaccaaaaaatcgtattaacgatgctaatgtagatgataaccaacgaattattcgtgagttaataaataatgaagcggcagttgatgcattaaaacggatagctacgctaagtgaccaagaaaaagcgatgcacagtacattaagagcaaacgaaaaatttgatatggatgaactagaggagtcccctaactatactactgcggaaaataaatcgattcgtgattataaagatacccagaaagcattaaatgatgcacgtatggacttctttaccgagaagacgaaatttatcgcgaaagaaacgctagaacgaggaggacagctttactttgcattagatggtttagtgacaaatagcccaggttttagagctgatacgcagattaatatggataaattgaagggtaccgagctcgaattcgccntatagtggatcgtcactcactgccgc

SEQ ID NO: 93852 - DNA, 681 bp, Oryza sativa
aaattaccgcctgaacaatgtgtcatcacgcgtaattgcggtaatgcattacgaatttgctcagcaatttgaaatgcctttaacgttgtattatcgccagcataaacaagataaatatcaactgcttttggtaaactcatcgttttatttacttcttgaacgagtaatactaagcgttctaatcctattgcaaaaccaacgccttgggttgcatgtccgccaagctgttcaactaagccatcataacggccaccaccacaaacggtaccttgtgaacctaaagcagaggtaacccattcaaatactgttttattataataatctaaaccgcgtactaattttgggttgacttcataacgaattcccattgcatctagcaactgacataattgtgcaaaatgctgacgactttcttcgtctaaataatctaataacttaggcgcatcatttaacactgcttgcaaagcttgatttttagtatctaaaattcttaatggatttttaactaaacgttccttttcttcatcattcattaacgcggtatgatttgctaaaaaatctactaatgctgcacgataattagcacgagcagctaaagaaccaatggagtttaattgcaaagaaaggtgttgctcaatgcctaatgcttgccataagcgcgcagttaagagaattaattct

SEQ ID NO: 93853 - DNA, 570 bp, Oryza sativa
tgacattaagctacttaggtgctgaacgtgcaattcctaactacaatgtaatgtgtttagctaaagcctccttagaagcagcaacacgtgtaatggcagcagacttaggtaaagaaggcattcgtgttaatgctatttcagccggtccaatccgcactttggccgcttcaggaattaaaaacttcaaggaaatgctctctgcatttgaaaaaacagccgcattacgtcgtacagtaaccattgatgatgtgggtaattccgctgcatttttatgttctgatttagcttcaggcatcacgggtgaaatagtacatgtagatgcccgttttagtatcacagcaatgggtgaactaggcgaagaataaataactaaaatcacaataaaaacggatgcaatagcgtcggttttttatcatcactatagccaaaacacatactaatttactcgctatttagttcattttattcagacaatttacaaaaaaatcctttataatgagcaacaactactatcgcacttttgtgtgctttttatacataaataagagaaattatgttccaaaacaatcc

SEQ ID NO: 93854 - DNA, 1856 bp, Oryza sativa
  unsure (1)..(1856): unsure at all n locations
acccaatttctcagctagttgagcattattacctaattcaggatgaacatctaacggcaaatgatagctaaataaattaatatcattcaataataactgctttatccgcttgcttttcattccacgaatacaaggcgattcatttttccaaaaatagccatgatgcactaatattgcatccgctttcttagcaattgcttgttcaattaacggcaatgaagcagtcacaccggtaataatgcgttgaatgttggttttaccttctacttgtaaaccatttgggacaaagtctttaatagcataactatttaatttttgattaataatctgttctagttctatatgggtgagtgccataatctttccttgtattgagaaaaagcggtctattttttgcaaaatagttcacaaaaatagaccgctttacctaaaatgtattaaattattcaagccagagtggtagtctagtttcaactcttaaaccaccaagaatacttttcattgcttcaacacgacctttatgttgttgagcagcatttgctnnnnnnnnnnnnnnnnnnnnnnnnnnnnnnnnnnnnnnnnnnnnnnnnnnnnnnnnnnnnnnnnnnnnnnnnnnnnnnnnnntatattctgattctggtacaccttcaccatcatcattaactgacataaccaattctttatcatcaatgtaaatcagtacagtgatactttgtttagcataactttgcgcattacgaattaatttttctacagcactggcaagaataatttcatnaccgttaataaaatagccttctacattatcaattcgttgctcaataaataagtctatttgattctgttctgcctcaaactttgcatcttctaaaatatcatcccaaattttattaattgagaagacttctcgcattagatgctgattaatttgctgacgtgaaagagaaagcaaatcatgtaccatcgtatctagtttcataatttggttatcaatacgcgttagctctgcagaatctccgttacgttgacggattagcgctgttgctaattgtaagcgcgcgagtggtgtttttaactcatgcgaaatatcagaaagtagtcgttgttgatattccgtcaactcctgtaacgaagtaatcatttggttaaaactacgacctacctctctaaactcatgaataccttccgtttctaattttgggttaatcgccaaattacctgtggctaccgcattggcacagattcgtaattcttttactgggcgcgcaattttccacgaaagccaaagtagaataggcacacttacaattaatacgatcataagcattagccaaggcgagtcaaaaattctattaaaaaactcttcctgaggatccactatctgtgcaaaatattgcatatattcgcgcttattagacttaaccaaaaaaggaccggaaatttctaaactaccaaagcgacgttgtaatggttcaagtggtgtttgtgcacgataaaggaaaacttggaatgattgaattctattagagtcagctcccgctccaacgaaaatgcgagttttggggtcgaataaaataatattaaagccattttgagtggctacagaaaggcgacgttcaaaaatttcatctaaattatattgtaattctgtttgacggctttcttgaataaaaaattcatgttcacctttttctaaacgtgagaatgaacgcgcatcgaaattaggaatggctaaggtaatagctaacataatagcaaatgttaagccaaaataggcaaagagttggtaagctagataatttctaacagattttatcttttttaaaaatttaggcatatattaaatactttaaaaa

SEQ ID NO: 93855 - DNA, 595 bp, Oryza sativa
aattaaatttttagcaaggggttgtttgataatagaactacgtcctgaaattgtgccatctacgcctgcaatagggaatgtttcaaataattgtaagttagcttcattatttgcaatatattctaatgcttgtaatagcgtttttgcattcacttgattatgtcttgataagcctgaaccatcgactaccacactgttattaaattgtacgccagcttttgattttaataactgacgtatagtttggctagcaaatggaaaagaagcggggcgatttttttgttggttagcaataatgcgaaataaactatcggcaatttgatttatccgattttttcatcatttttctcagtaaggttggtaatggttcagaattatgttctgcaagtaaatgcccttgttgtttattgagtgattcttgaactttgccattaaacgcaatgcctaaacgagttaagtttgctttgattagatttgcaccatatgctacaggatcttgcacagaaaaacttaaaccgaaaggttgcgtttggcgagccatacagccttttacgtggtagcggttattatcatttaccaccacatctaattgaca

SEQ ID NO: 93856 - DNA, 682 bp, Oryza sativa
tggcgagtgagtggaaaactgccagcttgtatcacttctatttcacctaagcgcgtaggaaagttttgcataatggttaatgctaattgttcaggtgataactgtgttagttcggcaatccgctgtggtgcatcgtaccaaacgacacaaccattttgatctgcaagcggtaaaaaagcacgtggacctgttggaaagaattgttgccaagtaacagattgagtgggtaaagcagttttaaccgttgcgagtaaacagtgttgccgatattgccagctagttagtccgatacctgcccaatggcgaacttgagagttagcgccatctgcggcaatgattaatgaggtagagaaagtttgatcgtcaaccgtaatcgtccagccagctgaatgatattcagcagtaagttcggcaaaaccaactatttgttggcagttggaatagaggttaagtgcctgccataaactcatttgaatgagcttattttcgaccataaaacctaaggtatctagaccaatttcctccgcagtaaagcgggtgctaaagccttcaacttcccaagtttccaagctatcgtaacggcaaacacgcattgcttggatctgttgccatacacctaattctgctaataaatttacggaagcaatgctaattgcagaaatacgtaagtcataagcagaat

SEQ ID NO: 93857 - DNA, 771 bp, Oryza sativa
aagcaaatgcttgctcaatttgtgcggaatcaacaacatctaattgaatacattcaaacccttcagcttgcaagcgctcaatatctgccgtttttctgcaacttgcaatcactcgccaaccctgttgttttaatagtttagccgttgcataaccaatgccagatgaacaacctgtaattaaaattgtttgcatcacatgatcctattacaaataactgacaaaaccctctgtattttctgtttcacgtgctaatgaaataccatctcttgcttccttaggcgatccaactaacaataaccctattattttatctcctgtttgacaaccaaaagcctgtcgcaacattttgccttctacccactgattactaatccaaacagtatcaaaccctaacgcattcgcagctaattgcattgcataagttgcacagcctgcactgatcatttgctcccaagcaggcactttttcagattgatgatctatttttgccacaatgccaatcataagcggtgcttgctcagcaattttatccgctttaagcgcatttttttcgtccatctcaaactcaatggccgcatccaccaaacacgcttttaacattgacatactctgtttttcaatcaccacaaaatgataaggcttcaatttaccgtgatcaggcgcacgtaatgcggctttaaacatatgttgcaattgttctgcgttaggcgcaatttgccctaattttttatttgaaaaaaaaaaatgtaataactctaatgttttcatgg

SEQ ID NO: 93858 - DNA, 892 bp, Oryza sativa
cgcacttaatgatttaaatgccgattgcaaacgttttaattttgccggtacatctggacgatttgcgatagctgaaataagtacattcatatcaaccccttgcaattcaactgacaaaatcgctgggtactctattggcaaaggctcatttggctttaaattcaataagttacgtaaggtttggtcccccacttttagagtagtgcgatagccaatcaaaccattacgtgcattcaaagggccttgcttggcttgttcaaccgctaagtgatcaattgcccccacttccattttattttctagaatatgattaatctgttcataatttttaatggtttgttcactaacattaatcacatctttcaaataggcaatttgataatagctagccacaacggcattaataatagaaagtcgagttgcttttaagtcttctatcgttgctttatattcccattccgacgcactagcactatcagctaaacgacgccataaatcaagcgtataacttaaattgaatgaggcattgtgtacaacatttgacgccttggtaacgctattagatgattgtaatgagccatcagaaaccaacaattttgatgccgagcttgaaccactaccactaaaagttggtactaaactagcaccaactaaattcgcattatatagcgctttattaaccaaaatagcacttttggctaagttaacattattagctaaggcttggctaacaagacgatttaactgcggatcgttataccctttccaccattcttcatcaatattaaactgcttagtcaattcttcatattgctggtagctggtttttgcttgttcaagcgagccatcttttgtcatactcgatgtacaaaatgacaaaaagcttgctaac

SEQ ID NO: 93859 - DNA, 929 bp, Oryza sativa
aaaggcaggggctgatatcttaaatgatattcgcgccttaacagaaccacaggcattaacaaccgcagtcaaactagcgttacccgtttgtttaatgcatatgcaaggtaatccacaaactatgcaacagcgccccaaatatgatgatgtgctagcagaagtcagcgattttttaaatcaacgcatttttgaatgcattacatcaggcattgccaaacagcatattatacttgaccccggatttggctttggtaaaactgttcaacacaattatattctgctaaaacacctaaaagccttcgccgattcaggctttcctgtgcttgctggtttatcgcgtaaatcaatgatcggcgccgtaacaggcaaaagcgttgaacaacgcacagcaggatcaataaccgcagcattattagccgtacaacatggtgcacggattattcgtgtacacgatgtagcagaaacagcagacgcattaaaagtttggcaagcaatgcaagattgtgaataaggaaatatatgacaactctcgtttatggtatcaaaaattgtgatacagtaaaaaaagcgctcaaatggttacaagcaaataatcagcaaccacaattacatgattatcgccttgatggcttagatgccgaatggcttgcacaaatggaagccaaatttggatgggaaacattagttaacaaacgttcaacaacgtggcgaaacttagatgaacaactcaaaaatagtttgaatcgttcaaccgctttacaactgttacaacaacagcctaccttgattaaacgccctattgtaattaaagacgatattgcgttgattggctttaatgaacaagactatcaacgcttaataaaccatatttaaccgcatccaaaaataattgaacaacaaaggtaaacctctgcaacatttcaaccgct

SEQ ID NO: 93860 - DNA, 756 bp, Oryza sativa
attagccgccattgaaaaactagcaaaagcagctcacaggtagtattccagattcattaagtttgacagaccaagcgattgccctaagttataccaatattacattacccgatagttagcgaaatgttaggcttaatcgatgatgatcaaccgcttgaattagtgatggctctagcccaagcaaatggcgatcaagttatggctattatccaaaacattgcaacaaaaggcattgactggcaacaattgctaaatgatgtggcagaaaccttacaccaaattgcaatgttgcaattgcttaaacaagaaacaccatcagacacgccattacatttgctcgcaaaacagataccacctgaagatgtgcaatttttttatcagttaatgctcatcggcaaaaaagaattagcttatgcaccagaacaaagtattggtgtagaaatggtatttttacgtgccttagcatttcatcctaaacgtactgaagaaattaacaacgtgcgcaactaaatcaagcaaataacgaacagtcggcaatggttgacaatacccaacataagcttgaacagctcaaagccaattttacacaagtaaccacagataaaacaagtgcacaagcggtcgaattttcaagcaaacgatcaataaagccggcgcaacaaactgtgccggctaatattacagatagcacaaataatacgctaatctcacccgcacttgttgcaatgcaagcgcggaaacaattacaacaaaagg

SEQ ID NO: 93861 - DNA, 631 bp, Oryza sativa
cataaaagaaattagaatggcaaaaaaatccgttttattgacccgctttatcaaaaatattttaagctatggcctgatctttattgcactaagcgtcataattgattggtatcgtaaaccgactgaaccacatcagtttgcccaacaagtactatacgatcttgatcaacaaccacgcattattgcacaattaagccaccaacaacccatgctactttatttttgggggacttggtgtcgctactgtcaatttacttccgctgcagttcaacaattagcgaatgaaaagattcccatattaaccattgctcttaaatcaggcgatgagcaagatatctctaacaactacttaacccaacaaaaatatacttttcctaccatcaatgatcctgatggtaacatcgcaaaaaattggacaattcaagctacacctacgattatctttataaaagaccgcaaaatcgttgaatatacaacaggactaactagctattggggcttaaaaagtgcctttggctagcaaatttaaactaaaacaagcggtctactttagcttttttgagcaaattagaccggttaatatgatgagaaaaaaatgatcactgttcaattatcaacaagaacgcgaaaa

SEQ ID NO: 93862 - DNA, 595 bp, Oryza sativa
gtttctgagttacgtagtattttaaaatgggcaagcttattacatgaaattgggattgtaatcaatcataatggtatccataaacattcagcttatattattgcacatcgcgatttaccggggtttgatgttgaacaacaacatttattggcgattttaatgcgattccacttaaaagcatttaaatgcagtgatattcgtagcactaatcgttatcaacaccgcgatattttaaccttattacgtttatttcgtttagccgttttattaaatcgttctcgccaagcggctgtttttcctcaaatattaacgcttaagacagaaaaaaatcactggcaaataagttttgatttagattttttaactaaaaatcctttagtgttagctgatttagaagaagaacagcaatatttagctgcattaggtttatatttgcagatcacttcgttaagttaaaatttgatctagttcgtatttttcctttttattgcttgttattttattaataaccttttaacctacttcaattggagtaggttttcattaattgcaattttatggagcaaaatgatacaaccatattccattattaatt

SEQ ID NO: 93863 - DNA, 562 bp, Oryza sativa
ctaaatgttgtttggtttgctgataacgcggcgatgatgctaattgttgaaaatcaatggttcttcgtttttttaaagttaagtatttttgttggtctaatttatttggttgataagttaagccattcagtacttcaattacaccttcaggttgattacaaagtagtagtaaatcacaccctgcgttaattgcttgctcactccgttgtagaaaattgcccattaaattagcaccttgcataccaaggtcatctgaaaaaataatccctttaaattgaagttggtgtcgaagtacttgttgtaaccagtatgtagaaccgctagcggggtgtggatcacattgtgtatataccacgtgagcaggcataatagcagacagtttatttttagcgataaaatactcgaaaggttgaatatcataattaaaaatattcgctttggcgcgctcatcaaaaggggtttctaaatgcgaatctgcgataacctgaccatggccaggaaaatgcttacctgtagtcgccatttctatttcacgcataccatcaataaaaccttcagcaat

SEQ ID NO: 93864 - DNA, 682 bp, Oryza sativa
ggaaagttatttacaattattccaaaatgtgagttattcatcagatattattttacccactgaaagtgcggatgaaatgcttgaacacgtgttggcattacctcggtcaggggtgatgagtgagaaagataactttggtgaaatgattcgcttagatcgagaatcagccgtattaatgacctattatcggaataatattcagcatttattcgttttgccgtcattagtggcgagtatcgttttacataatgaagcagcgtctaaaacattgattcgtgaaacggtgagccacatttatccattcttaaaagcggagctatttttacattttgatgaaaaagaggtgttagagcaagttgagctgatcttaacggaatttattcgtcaacaaaggtgaaatatgatggtgacgtgttaaccattaaccgtcgtcgtttgccaaccttgcaattacacgcggcggggatacgtgaaattctacagcgttattatattagcttaagccttttattggagtgcccagccattagtcgtactctattagaaaaaagagagcagaatgattgctcaacgtctttctattttacatggcattaatgcgccagagttctttgataaagcaattttttcaacctttacagccagcctaaaagcacaaggttattttgatctagaaggtcat

SEQ ID NO: 93865 - DNA, 521 bp, Oryza sativa
taaacaaaatgccaaaaaatgtaagccaaattcacctaaatgaaatgttaatgctgtctgagtgagtttcacaccttttaatgtttcactgccataattatctgacattaaaataataattgcggtacaagtacacaccacaatcgtatccacaaacacccctaacatttgaataagcccttgacttaccggatgttttgcatttgaggttgctgcagaattaggtgctgatcccatacctgcttcattagaaaataatccgcgcttaattcccattaacattgtctttgaaacaatactaccaaagaatccacccgcggcggcagaaaaatcgaaagcactatcaataatattagctaacacggcaggaacagcgttaatattcatacctaaaatagctaaagcaataatcagataaaataatgccattactggtacaattctggctgaaataacaccaatgcgtttaactccacctaaaatgattatggcggttaatacgactaaaatcatgccaatat

SEQ ID NO: 93866 - DNA, 561 bp, Oryza sativa
aggtctgaattatggcattggttttgccattatttttatgttgcattttacggttgctacaaaacagcctgcaatgaccgcttctcgttttgctgaggcggtcgaacgaaattcacaaggtagagcagtgaatatgaaattagcacaattattagtggatgtattgcgttcgcaaagtgcggcggtatttgggaatgtattggtgtcagtttatgttgctgcaggtattgcttatctctatgcctctcacatggggcagccgttgttaacatcagagatggtgcaatatcagttacattctattgatcccacgcaaggcacactgtggtttgcggctattgccggcttatggttgttttgttcgggtattatttccggttattttgataatcgcagtaattatttaaacacgcgtatgcgattacgtcagcatccagtgttgaaattattattaccacaacgcttacgtgagtgtttagctgattatatccatgataattctggatctattatcggtaatatatgctttggtatgttattaggtttaacgggggtgatagg

SEQ ID NO: 93867 - DNA, 522 bp, Oryza sativa
ggcggctaatatcgctggtttagcttcagaggtgaaacgtgaagcctacaatgctgatattacttattcgactaatagtgaattagggttcgattatctgcgtgataatctagcacacacaaaagaagaacgctttcaacgtgaattatattatgcattagttgatgaagtagactcaattttaattgatgaagcacggacgcctttgattatttctggtcctgcagaagatactacacaaatttatcaagcaatagataccattattccacatttaatttcgcaagataaagaagattcagatgaatataccggtgagggcgatttcactttagatcttaagaataaacaagcccatttgactgaacgtggtatggtaaaagttgaaggcattttgactgaaatggggcttatgcaaaagggtgaaacattatatcatccagcacgtattgcattattacaccacgtttatgccgcattacgaagcgcataaattatttgaggtagatgttgattatattg

SEQ ID NO: 93868 - DNA, 833 bp, Oryza sativa
tatccggactcaccttatcaacagcgcttaaatcaattaatgtttgagcgtttatatcagcaacaaaaattttcagcattattagcttatgcgaaaaccattgcaccggaaaatgctgataatcaatgtcgtgttttttctgcgcaatatcagcaatttatggcacaacaacagaataaagaagctcagcaaaacagcaaaaaaacgatttggttagccactatgatgcaggatttattggcacaatttgagaaaatgtggttaaaaacagcagaattaccacagcactggcggatattgaacaatattggcgggatcaaggtagaaaaaccgatgaaaatatcagattaaaagcggttgaattagctaagcaaaatgctaaaaaaggctttgaaattttggatcaacatcatcaaaattcggagttaagcgattggttggtagaagtcagcaaattaacggcaaatgtcaaatatttgccaacttttgttgaaatgcaactgcttaccacacccaataaagcgcttatattagctttttttccaaaatttattaaaaccctttcagaaacattagcacaacctaactttgatacttatcaagcatgggcagataaatggcagttaagcacggatgaactgcgggagtggaaaattgcgtttattagtcgtttatttgacaatcaagatccaaactttaatatttggcgggataaacaactatcagaaatacaaacagatagcttgattgaacgccggattagaatggcactctggcaacaacagccattagcacaatggttagcgctcctttcgagtaaagcgcaagaaaaa

SEQ ID NO: 93869 - DNA, 537 bp, Oryza sativa
  unsure (1)..(537): unsure at all n locations
tgagcgtttaatgcctgcatggcaaacatctatcgccgcttgtaaaaaacgcgcggcagaatggtgataatcaccttgctgaataaatttttttaaatgttgtttggcttcacgcgggtgaatatctgaaatgaccttaccctgttcgtctagtaatccttggcggtcgcaaaaggctattaatttatccannnnnnnnnnnnnnnnnnnnnnnnnnnnnnnnnnnnnaaacgccaaattaaacatttttccggttactgatggcgctattggaccaatcacgacaattgcattttgcgctaattgctgttgaatggcctcaatattaatccgtctatttttaccactcaagccataatctacgccgtcaatcacaccaagcggttgggcaagaatagcattactgctgactacattcagcaccggtgaatggggtaacttaagcgataagcgcgagaaaatatcataatgtaagcaacaaaaagcttgtttaatgatttcaagcatattgctgtctgtaacacgaatattatgatg

SEQ ID NO: 93870 - DNA, 542 bp, Oryza sativa
gcgttgcgcgccgtcgaacgcttgccagttatgtaccttatccgtctgcatgtactcaataaagcgcacaaactccgatttagttgaggagaagaagatatacggcggtcgggtgatattgactaagcgcaggaagtcgattaagtcaaaataatgcgcctgcttgtagctctcttgtttagtgcataaatagggtgggtcaagcacaaataacgtctttttggctgcgataaactgcgggagcaacgcatgaaacgactcgcttgtcacctcaatcccgtccaaatagccttccgcgcgcggatagtcgctttgacggatacaacaccaaaagtcttttttaaagagatcatcaaatgttgcaacctgctgcccggaaaacaacaaccagcttgacaagctcgctaaatctttggagccgtcaaatgcgttaattgttgcaataatcttagttttgagggctttgtctgtaatacgtttttgcgacggcacgtcacgcaacaacgcatgaatttgcccacgcaagcgggtaaagtcatcaa

SEQ ID NO: 93871 - DNA, 617 bp, Oryza sativa
ctagcgccgtttctttagcaaaatcacgtttagaacgtaccggtttctatgaaactgttgaaatgtcaatgccgaccgttaaaaacacggatgaccaagttgatattatttataaaataaaagaacgtaatacaggatctatcaacttcggggttggctacggttcaggaagtggtcttagctataacgcgggtatcacacaagataactttttaggaatgggatcaagcttaggcttaaatggctcacgtaatactgactccactaacgtcaacttaagttatacagaaccatactttactaaagatggtgtaagcttaggcggtaatattttctatgaagattacgataactcagcacgtaaagcttctgccgcttataaacgtaaaacctatggtgctagcggtaccttaggctttcctgttgacgaaaataactcctactatctaggcttaggttatactcatgataaattaagaaatgtagagcgtgaatatacccgtgaaaaatatgtgaattcaatgaaattcccgattaatccaaaaaattcccactatgatcgtattcagtcagctgattttgatttatcatttggttggatttataccaatttaaat

SEQ ID NO: 93872 - DNA, 733 bp, Oryza sativa
agacgacaacatcggcgtatatagcccgcttgttgaagaattgggtcgctccgctggcgaaacagcctgacgaattagtatttggcgcgttaaaaggcggttttacaaccgaatgctacgacaaacaatacttttttgacaccgaccacccggtcggcgcaaaccctgacggcaccagccctacttcggtatctaacatcaccgatgacggtacaagcgtgaccgcagacggcgcatggtatttgctcgactgttcccgtgcgttaaaaccgcttatcttccaacagcgcaaacctgcaacgccggcgcaaatgaccgacgccaacgcgcagaaagtgtttgaggataacgtgtacacccgttgcaacgtgggctacggattctggcagatggcgcatgcggtgaaaggcaaactaaacgccgagaacttatggaaagccattaaagcgatgcgcgcggtgcatagtgacggcggtcataagcttggcattaagccgactcacattgtggtgccgacaagcttgcaagaagaagcggttaaattgttggagcgtgaattgcgcgtagaagacggtgcagccgtggacaacgaatttaaaaacatgaagttgacattaatcgttgccgattatctgtaaatttcaaaagtgcggtggattttaaccgcactttaaatccaatttaaagtagttttaaacggagaaaaaatgcgatgtctgacgttaaaaaatat

SEQ ID NO: 93873 - DNA, 730 bp, Oryza sativa
cctctgctattgcatcttttgaaaagatgggttcaagaaacgtacaagcgaatttatttggtgaacaaattcaattaagtttaatttttgctcattataaaaccggtgaatattataaagcactaagcctggctgaacgttttgtacgtgcttatccaaacagtaataatatggattatgtacattatttagtcgggttaagtaatgttcgcttaggagataactttattcaggatttcttccatgtaaatcgttcttcgcgcacaattgagagcattcgtaatgcttacggaaatttccaaatgattgtgagaatttatccacaaagccaatatgtaaatgatgctcaacagtggatggtttatttattgaatcgtatggcagagcatgaattatctattgtaaaattttatgataaacgtgatgcatctgttgcggtcgtaaatcgtgttgaagaaatgcttcgtttttatcctgcaagcaagtcaacctttgatgcattgccttatatgcaaaaagcatatcagagaatgggattaaaagattcagaggcaaaagtcgcagagttgattgaaatgaataaagcaaaagtattccctaaaattactaagccagaatatagtaaacaattctaagtagttttatcataatattaacttaataaggggcgttatttgagataatgcccctttccctatttgattaatcagacgaacataatgcgaatttt

SEQ ID NO: 93874 - DNA, 976 bp, Oryza sativa
  unsure (1)..(976): unsure at all n locations
caactcgactaaaatgctcttctttaccgccaatcacttcacgcaaatgccaagcaattgcttccccttctctatccaagtcggtcgcaagataaatatggtcagcttttttggctaaggatttcaattcggaaaccactttatctttatccggtagaatttgataatttgctttccaatcgtgatatggatcaatgcccatccgtttaactaatgccgctcgcgctttatccgcttttacttttgctttctgctctgctgttaaacctttagttgagattggtttgactttttccgctttttcactaccgcttttgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgattttcccattaatgactatccacaaataaaataatgattgaagaaatttataagataatttcttattagttgatatttaatactaattgactcaaaataccggcaacaatagcaagcatttcgctaaaatacaatatatagataaagaaaatggataaactaaatacgcactcatcgccaataatggttatgggttacaataaaatactaattatccaatgccaacattaatacttttgacatacgttgataattataatggcgttgtttttcaacgggtaaatccgttggttgtatttgcacaaaacctcgttcttgaaaccattgtattgtttgggtagttaatacaaataatttttcaatatttaatttataggcgcgtcgtttaatcgcttctagtaaaatatcgcctctcgcagaatcacgataatcaggatgtacggcaacacaagccatttctgccattttctcagcgggataatgtatcaaagctgcgcaagcaattacaataccatcacgttcaataatcgtatattggctaatttccatttctaa

SEQ ID NO: 93875 - DNA, 531 bp, Oryza sativa
taaattacgcgagcaaggcaataccattgtcgtgattgaacataatttagatgtgattaaaacggcggattggatcgttgatcttggcccggaagggggggcaggaggcgggcaaattattgcacaaggtacgcctgaagacgtggctcaacaaccaggctctcacaccgtgcgatttttaacacaaatattggcgaaaggttaaggctattagccctatcaagaatgatgaaaaacgataaaattatccatacttttagtgaacaaggtttgctaagtagcaaaattaaaggctttcgttctcgtgccgcccagcttgagatggcactagcggtgggaaaagcaatcaattttgcgacatcagtggtagtggaagcaggtacgggtacaggcaaaacgtttgcttatttagtcccggctttggtgtcgggtaaaaaaacaatcatttcgaccggttcaaaaaattaacaagatcaactgtttaaacgtgatttacccaccattcaacaggccttgaaatataaaggcagg

SEQ ID NO: 93876 - DNA, 1055 bp, Oryza sativa
ttttcgtttactgatgggtgttaaagccagtattcgtggcaatttacgtgaattactggctgatcaaaaagtcgtaaatggcttaaccaaaatagcagaaaatatagaatttctacaagaagtgattaaaaaatcacttggtcgctcagaaacgttagataaaatcttcgaaagattggcggaagtcaaagttcaattacaaaaattgagtaatactagcatagttggttattgctattggtatgaagccaacgggcgttattttggtttacatatcaccccgttaaccgtggcagataaatttggtgaacaactcaaaaagcaacaaattggttgggtttttgcttcagcaactttagaagttggtggtcagtttgatcatttttgtcaacgcttaggcattgaaaatgcagaacaaatagtattacccagtccatttgattatgctaatcaatcactgctttgcgtgccacgttatctgcctgataccaataaatctcacacgttaaccacgttaggaaatatgttaatgcccgttattgaagccaataatggccgttgctttttgttgtgcacttcttattcaatgatgcgcggtatggctgattttttacgagaacatagccagcttagcgtattgttgcaaggtgaaacaagcaaagcgcgcttattagcacaatttattaccgaaaaaaatagtgtgttagtcgcaacgcaaagtttttgggaagggattgatgttcgtggtgatgcattatctttagttattattgataaattaccatttacctcaccagatgaaccgctattaaaagcgagaatggaagattgccgtttgcaaggtggtgatccatttaatgatattcaaattcctgaagccgtgattacgctaaaacaaggtgttgggcgtttgattcgtgatgtaaccgataaaggtgtagtgattatttgtgatgctcgtttagtgatgcgtcagtatggcaagacttttttagaaagtttgccaccatcaagccgcactcgtgatcttgctaaagtgattcaatttttgaaaa

SEQ ID NO: 93877 - DNA, 653 bp, Oryza sativa
acttattacttgccctgtcactttttctttcaaaagttgccaattagctggtttttgaagcgccaaatgatctttttcagtttcaacataaatcagcgctttgctcacaagccaatcatttcgctcaagtatgcaataacctcaggcactaaattattatggaatggcggatcaataaacacgagttcaaaaggttgttgcgtatttttttgtgcaaggtattgtaatgtatctgtattaatgacacttgcattagcaccggttaaatgagcaacattattacgcaacacgctcgcagcattcgcaaatttctcaagaaaaaccaccgtttttgcttgtcgagaaagcgcctcaatgcctaatgaaccactgccggataaacaatctaaacaataacatccggcaacataatgcattagccaattaaataacatctcttttacacgatcggaagtagggcgcaacccttcataattgaacacggacaacttttgttcacgccataattctgcaatgatacgaacttgaccacttttgcttattctgtctaggaagattacgagtttttttcatattatataaaggaaaaaattaccgattatttggtaaactaacttagtttagtccattttaaaaggaaaagtgagaaaaat

SEQ ID NO: 93878 - DNA, 528 bp, Oryza sativa
cgctatgttgtaaccgtgatgggcgtactattagttttagcgggcgtatttccatggttaggtgctataattgtttctattcctagcccagtattaggtggcgcgggattgatgatgtttgctatgattattgcagcaggcattcaaatgttagacaaagtggaacgttcaaaacgtaatggtttaattattgctatttctatcggctgtggtttagctgtgacgactcgaccagaattattggataaactacctaatttctttaaagaagtatttggttcaggaattaccgttggatcagtcttagcattattattaaatttaattttgccagaggataaacattaaaataattaatgtaattgggcaaagtagcttgaaattagcgaatagaagatttattttaagtagtgtgtaaacattttattatttttaaggaaacatatatgacacatcaagtaactgatgcaacatttgaacaagaagttttaaaatcggatttacctgttttattggatttttgggcac

SEQ ID NO: 93879 - DNA, 737 bp, Oryza sativa
gctgattttgctattttatagccatgcctaatgagtttttcagcgtccggcattaaagtcggtggattacactaaatataaataattcgctctggtgttaatgccattaaatgatctaaacaaaacaaggcaccttgacgagcgggatcgagtaatactttattaaaaggttgtgtagcccaatgttgatcaacaaaagattctgctaaattagtttggtaaaatgctatattgtttaacccgctagtttgctgatttattttggcttgcttgaccatttcctctacaccttctaccccaactacgaaacccgcttgttgtgcaatcggtagactgaaattgcctatgccacagaataaatcaagaatgcgatcttctgctgtaattgctagccattctaacgctttattaaccattttttgatttaacggctgattaacttgaataaaatcacgaatgcaaaaatgtaatgttagcccgttaatttggtaataaggtgcttcaccgcaaagatgttcaatgtgattctcatcacacattaaataaagcgaaagctgttctgcttttgcaaaattgagcaacatgtgctgatcttgagcatttatttttcctatatggagaaccaacatcgctcgcgtattatcagcgttaactagttcaatatggcctaatgcttttttcattttccagccagcaaataagtgttgtagtttgggcagtaatgtagaaaggggtac

SEQ ID NO: 93880 - DNA, 993 bp, Oryza sativa
cgtccttttcccgtgattcctgacgagaagaatctaactgaatatccatatcatcaattttaacgtgaatgttatccaacgatagtttttttaattcaatctctaacggaatattcaattcagtaaatggcttactttctacttttttcgagggcggaagtttagtgctatcaattgtaacgtgagcatctttcagtgcaatattttccacacaggctctacgatagattaaacattcaaaacctatatgtaaggtcgcttgcccaacattaacatttactccctccataacaaattgagtatctgataaagttaacccttgttggatactgccttctactttgccaatagttaatggttctagccatctatctactaatcgaaaagccgtttgttgccctttagctgtaaataaaaatagtaaaagaagaagcaataaggctaataataagcaacaggtacggcgaagccatcgccatttattttttgaagtcgattttgctggcgcagaagagtcagcaaaatgctctgtctgatgtgtatttggttgtttatgcataataagattgagtaattataattctgaacctaagccaatataaaattgtacaccacgtttgttattaagtgatttaacaggtgttgcaatatcaaatttaatcgcaccaattggtgaaatccaacgcacgccaacgcaagcaccagaatgtaatgcccgatgatcaaattatctgatattaaaccggtatcataaaaaatgccagccccccattctgggtaaatcgaatattaatatcccccggtattggtcattaagtgtgaccgccttattactttcccccttttaggttctttaggtgaaatgttttaataaccaaaccttttaaggttcatatcccgccagcaaaatagggtaatgttggcgggatttaatgaaaatctttagtatgaacttgccctacctctccacccaaccataacctgtgacgatct

SEQ ID NO: 93881 - DNA, 926 bp, Oryza sativa
cttctgcttgtaatgaaaacgaaaaaagcggtatcaaaaaacataaaatttgctaaaataattggataatcgactgcttactttttaataaattctgcattttatttcacccaccccatcggattttttggattgcctttacggcgaatttcaaaataaagcgctgaccgattttgaccaccggtattgccaaccaaagcaattttttgtcctagtgcaacaacatcgcctttacgtaccattaaagactgattataaccatataacgacatatcatctttaccatgatcaatgaccacgacttgtccatacccttgtaaccaatctgctaacaccacacgccctcctgcaattgcgtgtactggcgagccttggttagcctcaatcactgtgcctcgccaagttaactctcccatttgagtggtaccaaatctattgatactttaccaacgacaggcatattaaattgtttatttggcatacctaaaccttgtaccgttttaatcaatttctcaggtattttaggttgctctactacttttgctgttgattgtttttctgtttcttgctgttgttctttttgttttcgtgcttgttgtaatttatcttctcgtttagcgtcttccatcgctttggctaactgagctcgtaacgcaatttcattatttttcaatgcatctaaacggttttgctcctgtgctaatgttttatccagcgaatgcaaggtagtttcccgttccatttgtactttttttagtgttttttcttgtgttttttgtatagttaattgcgcttgttgttctttttgttgctgttttaattcagttcgccgtgttttaagcgtttcttgtgtatgacgtaattgatgaataatatcaatccgcacttgattaagatacccataataagccatcattctctctact

SEQ ID NO: 93882 - DNA, 785 bp, Oryza sativa
aaaatgctttattgccacgtttattagacactctaattggcacagcattagcttggatcggagtacatatatttacccagattggaaatatttgaatttacaccggaatttaacgcatactttacaagcaagcagtcaatatcttcgccatattatagtgcaattgcaatttggctataacgatcggttggcctatagagtagtacggcgtgatgtgcataatcatttatcagaattaagcgcggtgatcaacaatatgcacagcgagccacaaaaatatcgttccgcattacaatttgctccacaattgttaaacactacaaacacactactcagctatatttctgcgttgggtaattatcgttctgaaagcgaggaacttagccataatatacatttttcagcggttttcttctctaaaggcaaacaagtgattgatattttagatgccattattcactcagatgatcggcaagttgatcaagcacaattaacacagcgtttaaccacaattaaacacgcccttaaacagtttgaaaatgaacagcaacatagccaagacaaactggcattattactcattcagcagttattaatgattgtgcaattattacctcatttactcacgttggttaaagaagaacaactttattcacagcaactcagctaatgcacccaaataagcggtgttttttgctaaaaattggcaaaaaataaccgcttgacgctttattaaacagaaatcatcattaaaaaatacagatataattctgcatttagtacgg

SEQ ID NO: 93883 - DNA, 885 bp, Oryza sativa
  unsure (1)..(885): unsure at all n locations
tgaaggggaattcttttttttggaaatctttattttcagattcattccagcttgaggtttttattttcttttaagggtaaccgtggagcttcttttttaatgcggctattttttttttaagtgaagttttacattagcttgttcacttttgtattttttaggctcgcttttcagtttattttttccagtcgttaaggctttgtttcttccggctagttttttatcttctcgggcatatttgttttgcccatttttgataattttgtcgaattttttgtacttcatccagtgcaaccgggtgattttgccttaaaaagtttggatcgccaaacgcaatattatcatttgcttgagctaagccaactgttgctaatgcactgcttattgttgcaattttaaacatttttttcatttatatatcctttaagttgataagttttagtatatataagcggttaattttttgtttatttagaaccataaacagaaattttaaccgcttggtaagtgaaattagaatgtgctgccaactgtaaattggaattgttctatttcatctcctgcatattttttaattggttttgcataagaaaatgataatgggccaataggtgattgccattgtaatgcaatacctgcagaggctcgcacgcgtttgtaatcaccaaagtcaggtaagattggataatctgctttactttgtttccatttagtattccacactgttgcagcgtcaacaaaagggtaccgagctcgngttcggccatatgattgtcaatcacnccccttnnggggggggnantcaggaatagcgcatattccgagtttaccgaggtagccgggagtagtgggtgtttgccccaatataccacgtacacccgttct

SEQ ID NO: 93884 - DNA, 690 bp, Oryza sativa
caatatgatcaaatgccccttacgattggcaaagcagtcacgcaattatctaacacatggcttgagttcattggtaatactgataaaacccttggtgcttctacccttgtttcggctgcgatttctacgctggcaaataatctcgaagggttagcaggcattgccattttagtcggtacggcatataccgcccgctatctttcggcaatgtacaccagtattggggtaaaaagtaaagcggcgattgctgaaagtgcgcacatgactgcaattaacgcgagcgcaacggcttcagtgcgccaagcacaagcgacagtggttttaatgcagccagttaatggcgagacggtatcagtcgggcgtgcaacgcaagcatatggtgcgcttgctgttgccaaagcacgtgccgctgcagtcaatgttggcgcaggcttgttctctcttatcggcggttcttttgggtttgcggttacggcactcgcaggtttagccgctgcctatttttatttaaaaaagtcagaagaagaagctgaacgccaatttgcccaatctctcactacgcttgatgccaatattgagaaaactaaagccttagttgaagcacgcactcaattaggtgaaatgggtggttttagtgaccgcatggaacagttaaaagtcaatacggcgtcattagacggagcgaaacaa

SEQ ID NO: 93885 - DNA, 605 bp, Oryza sativa
  unsure (1)..(605): unsure at all n locations
cgaaccacaagctctaccacaggccaactctatgtccgtaataaccttatccatttcaattacatcttgtgcggtttcagtttttggcatacgcaccacatctacgccggctctcaccactgcatttaaatctgctataccaaattcagaatgcaacgggtttacacgcacaacacactcaatattttgataaagcggatgttgtaatgcatgcgcaactaagatccgtgctgaatctttttctttcagtgccacggcatcttctaaatcaaacataattgcatcaggtttataaataaatgtattacttatcattgcggcattagaacctggcacaaaaagcatacttcttcttaattttatcggctggctcataatattttctcccaagcaagcgcttcatctgttgcacgcaacaaagcggcttttaaacgagcacgtaatacacaatctaatgcacctttatcttctataataatttgtgctgagctgacctcaaattgtgctaatacagcagttactgaatttaaaatatnnnnnnnnnnnnnnnnnnnnnntgagctattgatttcaatatcaatcgtagttgatggtgcaatacgtat

SEQ ID NO: 93886 - DNA, 1050 bp, Oryza sativa
gtgctctaaacgacgttgtaattctgctatttattgcatatcggcaaaggcaattgaagacaatgaagaaaagagcacggtcaagattgttttttggatacgttttttcatttatttcctctttatcaaagtatagtttttcatttgacagcatttttagtaaaagtttctatcatcactgcatacgactaatgcgcttcatcccaattagcacctacgcccacttcagcaatcagtggcaccttcatcgcaatagctttttccatttccgttttgattaagccagtgtagtactctatacattcttgtttaacttcaaatattaattcatcgtgcacttgcataatcatttttatattctggtcagcacgaatttgcttatcgatacttatcatcgcgattttaatgatatcagcggcggtgccttgcattggtgcgttgatcgctagccgttcagcagctttacggcgtatagcattatttgatttaatctccggcaaatacaatcgacggccaaacaatgtttcgacataaccttttacacttgcagattcacgaatatcgcgcataaattgctgaacatttggataacgttggaaataacgcgccatatattctttcgcttcatcgcgtgagatagctagctgatttgctagcccaaaatctgacataccataaattagtccaaaatttattgctttcgcactgcgccgctgttcactcgttacctcagctaagcttaaaccaaaaatttctgctgctgttgcttgatgaatatcttggccattagcaaaagcggtaatcattccttcatcatttgctaaatgtgccataatccgcaattcaatttgggaataatcagccgccacgattttataaccatcacgtgcgataaatgcttgacgaatacgccgtcccgcttctgtacgaatgggaatattttgtaaattaggatcacttgaagaaagtcgacctgtggtggtaactgcctgatgataagaagtgtgcactcgacatgtaggctgattaatcatcttcggtattttatca

SEQ ID NO: 93887 - DNA, 564 bp, Oryza sativa
ttttaatgattaaaccaatgctagtaccggtcgtttttcccgcaaatactcccgataaaatgtgtacttgatcggcttctcggcgagcagtggtataacgtgatgtgccgggtttacgccgatctaaatctggttgaatatccgcctcagataacgccatattgggcgggagtccgtcaattatacatcctaaagcaagtccatgtgattcgccaaaagtggtcactttaaataactgtccaatgctattgcctgccattatgcttcctatttattcattgttgcttcatcattaaattgaaatgttttactggctgcttttagctcttcttgtgtatctttatttttaataaatacgtccatttggttaaaggcaatttcaatattattttgattaaataattcataaatacgtcgatttaagaaatctagtgttggatttcgatcgcctaattgttcaacataaacccgtaattcatgatttaaggtgctttccccaaaagttaaaaaatatgcgcgtggtgtaggatcttttaacactttatcgtcttctaatgcggcttg

SEQ ID NO: 93888 - DNA, 671 bp, Oryza sativa
aataactttgccacgattattaatttcaacttcttcaaaaccagtttgaccatgcaattggtcttcataatatttctcaatacctaatttaccaatatcatgcgaaccggcgtaattgccaaatttcccctctttttcaagcctttccttatctttttcattaattttagctacataacctaaaatatgcgtcagcgtttcagcatatggataattacgtttatagtatgccagtacatttaaactcgggaaatggtattgattaaccgcaaagcgtgctatctgttcttcgcttaagttaccttttaataaaataggggaataacgtgaagtgcgttttttctctttatagaacacttctatatcttcatcggttagcccgacaacctcttttaactcaagtaaagtctgtttaagatcggtagttttctcaggaataatatacaaaccaaaataagtgatattttcagctaatactttgccattacgatcataaatcaagccacgcgtaggcggtacaggcaataatttaattcgattaccgtctgaacgtgtttgataatcttcataatgaataacctgcaagtggtaaaggttggtgattaatacaccggttaatcctaaaacaaagaaaaaagcaatcaatgctcgacgtgcaaacaaattacttt

SEQ ID NO: 93889 - DNA, 609 bp, Oryza sativa
ttagccagattttagcgcttattcaagcaataaaaccttgttcattatcaattatccatcattaaatgaataaaaataagcgttggtttgaatatcggttaagaaagaaatcgcttcttgttcagccacctcttggcggactgcatcgctattttctaattgatccataattgacccgtaaatcaagcctttttcaatttcgcgtaaggcgatcacggtaggtttatcattttcttcagggacaagcggctcacgaacgtgaagttgtaattgtcttgcacggcgtgcggctgttaaaattaggtcgaaacggttaccgattttatcggcagcttcttggacggttacacgagccattgagttactccaaagttttatgttttcatttataaaaaagatcggagattatataggtattctgtgttaatgacaattgaaaatcagcctatggtattgattagtgatccgttagcgattaagcattgcagtaatcggctttttgattcagccagcgtgcgatcaaggcttcagcaagcgctggatgttcactaataatttgtttggcagagtgttgcactaaaggaatcagtttacgatcgggtaccgagc

SEQ ID NO: 93890 - DNA, 636 bp, Oryza sativa
ccacctgaagcagctaagccccccattgaggttacaacaggtttgccggcttgttgaatagactgtaattcttgcaagattatttcagaagcaaccacgctacctcccgggctgttaactcgtaatatcacaccatcaacattattgtcttcgcgtgcttggcgtaataattcagaaatagtttcactacccgctgatctttctttgcttttgccagaaataatttcaccttctacattaatcacggcaattttgtgttctgcattgacagcaaaacgatccgttagattcaaagcataatcggcataattaatgtgttgatagatgcctttctcatttttaccgaattgttcgattaatgcttgttcaatttctgctttactgccgatatcggtcactaatttttggtttaaagcatattgagcgtcattagcgttaacggctttgtatttttcaatcaagcttttgggttcaggtaaaacttgatcgacagcaatcatacgattttcagcaatatctgtacggaattgatgccaaattgaatttaataatgtttgcgcattttggtttgcttcatcagacatatcattgcgcaagaatggttcaaccgctgatttataagtgcctactcggaaa

SEQ ID NO: 93891 - DNA, 612 bp, Oryza sativa
aatacatgaaaagcacggtataaataagaagaaccatccacgagaaccagtgggttttgtgcaatttgagccatttgaaatccttgctaatagatgccatagcatacagttaagatagaaacgggttgcgcatgcaaccctatacaaacatcattataaccaaaacaagcggtttaatcttgccttaatgtagcaaccttccacgtaaaagacagtatagacggatattattcacttttctcgctcacgactacaggctcaaattctgcccgcttcaaaaagtttttctctctaaaattaatcggaaaatggcaggcaaattcatgctgtttatatttacgtaatggtggtttttgtacacattttttctgtgcaaatgggcaacgtggtcctaaacggcaaccaatgggtatatgttgaaacattggaatactgccttttaacgtatttaagctacttttaaagactaacggctgcgaaaaatcaggaataccatttaataacactgccgtatatgcatgaaaaggctcttccataatcacctctttactacctgcttcagctgtttgtccacaataaagcacattgaaagaatccaccctttatgggtac

SEQ ID NO: 93892 - DNA, 785 bp, Oryza sativa
  unsure (1)..(785): unsure at all n locations
gatcatggaatcaagcagggtaatgtattgcgtaaatatgttccaacaaattttataaggcgaccaacaacgcgttcttgnccactttaatgtaatttggcttcataacatattctgcgcgttggcgtgtaaagcgaatgacctcaagcgtagcaggcaaagctaaaatcaaagtaggtaatgctaaatggtgtaatacactctgcatcattttcaatttatacggcgaatctgctaagaaaatatctaacagccgaaaacctgtcactaatgaaatttcatagattgggtgcaattctccaaccgcagcaatctgccaatcattactcgctgcataatataacgccataatcgctaaccaaaatacgggaatagctaaactgaacgcgctaacaatagcgagtaatttgcctacaacattataccgaaagctcgcagcaacaaatccgagcggaatcccgataatcacagatacaaataatgcggcaaagcatagggaaattgtagcaggaaatacattcaggatttgattagcaataggatcaccattactatagctaataccaaaatcaccgtgtaatagccccataacataactaaaataagcttgaataccatataaatccataaaatgatttaatggatcacgcaataaaatgttataaacaattaatgttaaaataatcaaggtaatcagcgaaagaaataaccgacgaataaaaggggtaccgagctcgaattgcgcctatttgaaatcggtnactcaagcaaatcaaatggccatg

SEQ ID NO: 93893 - DNA, 641 bp, Oryza sativa
atcgcctttagcaagagtctcagcgactttatctgctaatagaaaagcacctattggtaaaccaccggctaacccctttgctaaagtcactatatcaggttttaactcaaattgttgataagcaaacattgtgcccgtgcgacctataccggtttgcacttcatcaataattagtaaaatatcttgtacttggcataaaccttgcactgcttgtaaataggcttgatcaagtgaacaaaccccgccctctccttgcactacttctaagataattgcacaaatatcattttgtgctatccgtgttttaaatgcattaagatcgttcgcgattaagtgttcaaaacctgccgtaaatgggaaaaaatgttgatgaaataatttttgaccggttgcggctaacgttgaaatggtccgtccatggaaagaattaactaagctaataatagtagaacgtgtatcaccatatttgtcgtggctatatttacgcgcaactttaatcgcaccctcattcgcttctgcaccagaattagcaaaaaaaacccgttttagcccgcttacttgaactaaatgcttcgctagtcgggctgatggttcagtataaaataggtttgaggtatgtcataacttatgtaattgtgcaa

SEQ ID NO: 93894 - DNA, 714 bp, Oryza sativa
caattcaatttgcagcgcattaatttcgtttgcaagttgataaccgttcgaatcatctacataccaagccccctcacgcccatcttgcggttcgaaccaaccaaaagggaaaagctgaatgagcccgttcgcctcgcggttaagctgaaaactgcaagcaattggattaagtttgaatttttgtttaaacacaaaacacctcaacacaaatcattgaggttagaggatagcgaaaaggcaaatgccaaaaacgaggaggcatttccacattggcagattttttgagggatttttgtaaaatgcagttgaaagtgagaagaagaaatgaaatgcgttttaaaaccgttttaaatcattttaaaagcatttaaaaaaagactttcggtaaatcttatcataaaaaagataaaccgctcaatttgcgattttgagcggtttaagttaatttattgtaatagtcgctgccagtagtctgtgatctcttccagaatatccgatttatcttgctcggtcagggttaaaaatggacgagcctcaatcttcactttgcacccacgcccagccatccctccgaattgatgaatagccgcatattcctcatttgtccccacaaatgcggtatcattatcataggcgctggtaatgctatccattaaattttccgaatcaaccaacggcacccccttacggtgtttaatacctagccattttggg

SEQ ID NO: 93895 - DNA, 640 bp, Oryza sativa
gaattcgagctcggtacccatcttgttctttggcatcgtcaaacccttttttgataatttcacccaatatttttgcatcaccacttaatggcaataatagcgctacgttatttaatagcgtttgttgaaaattgaacactcgttgtaattctgttggcataacggctagtgcgctatgatttggatagagtcgtttccaatagttaatattttgtggcatctgagccggtgtcgaaacactttgattataaatttcaatcaatgctaaccaacccgccaattccatctcaccggcaccggcttgggcagaggataacatcccacgattagcattacgtaataatgaccaaattttgtcattattttcttggcgtaatttattatcgaccaattgagtcgcaattaatgatcgaattctgaccgcttcaatcgtatttttgctattttcagcaattttggcttgagtttgataaaaacgtaatagttgtgaatggcttaaattagcggccgaaatatgttgtaatgtgacctctgcttggtggttgttgccttttaaaagccgctaattgtgccgtgacaagttgatattcaagttgttgtaatggattttgttccattatattcaaccccgtggttaaat

SEQ ID NO: 93896 - DNA, 965 bp, Oryza sativa
  unsure (1)..(965): unsure at all n locations
cgtgcaaatgtggttaatggggataatggcccctgtgagattgattaggcacataaatgttgaatgaaaggggcttctgtacagtaattgacggcatcgcatttttcgcctagcagtttttcaacgatttgcaccacttgagatgatggtgggcattcgtagccgggaatcgcgtcgtgtagatggcggatttcaattaaatcgccatattgttctaacagtggttgtaggttttgattgaccattgcatagagatctgcaatcactaaattaggcagcggtcgtagatcaaattgtaattcgcaacaagcacagatgcgattaatggcatctccaccgtggatgttgccaaagttcatggttggataagggacttggaataaatcattatgatatcgatcgcgtaattgattacgcatatttattaaataacccgttgcttggtgcattaagtcaattgcattaatgcctttagcgggatcgctagaatgtccacttttgccggtaattctgaccgcttgtccaaggtgtnnnnnnnnnnnnnnnnnnnnnnnnnnnnnnnnnnnnnnnnnnnnnnnnnnnnnnnnnnnnnnaatatgtgtatgcttggcaaaagttcttgcacctaacatggttgtctcttcatcggcagtggctaaaattcgcagaggtttgtttaattttttgagatcgaggctagccaatacctctacannnnnnnnnnnnnnnnnnnnnnnnnnnnnnnnnnnnnnnnnnnnnnatttacccgctttttctgtcaaaacaaaaggatcagattgccactttccttggtcaaaagggaccgtatccgtgtgcccggctagtaataaaccgccttgcccttcaccaagtgtggcaagtaaattatatttattacggctacctgctacttcaataatatcaatattaaagccaaaatcagctaaccaactagccagcgtatc

SEQ ID NO: 93897 - DNA, 560 bp, Oryza sativa
ataaagcaccaatgtaattaaaatccccaacaatgttgctagccccacatcgcttttacgtttagcataagctgaaagtacggaagccccttcaacgccaacaaatacccaaggggtaattagcatcgtatttttgacttgggataatgtattagttgctagtttttgaccgctaaaatcagctaaaaattgtgtaggtgaaaagacccaaatagctaatgcaataaataataacagtggcaatgttttgacgatcgtagcaattaagtttacgtaacccgcttcacgaatacctcgtgcgattaaatgatgcactagccaaacaataattgacgcacctaatatgcaacaacagtattcccttgtgcaaaaataaccaactgttcgctgtcaacaaaggttcccaaaccttcaaaggcaaccactaggtaaccgacactgccgatagcggtacaaagccaatagccccaagcggataaaccaccgactaaatcgccaaagccttcacgagcataagtatatacacccccttctaattctggttttaatcgcgagagaaa

SEQ ID NO: 93898 - DNA, 620 bp, Oryza sativa
cattggctctgccgcagtttttgtaactatgctgttatttgcaataacttggttattgctaattttttaaaaagtaaaataggcaatggattacacaatccactgcctatttttttatatcatcaattaagaggttattatgaaattcaataaaacactccttaccatagcactttgtgcttctagttcaataatggcttatcagcaagataaagattattcatttactgtattgcatactaacgatattcacggccatttctggaataatgaaaaaggggaatttggccttgccgcacaaaaaacactaatcgatcagattaaaaaagaagttgaagcaaaaggtggctcgactatcattttaaacgctggtgatattaatacgggagtcccagaatcagatttacaaaatgctcgtccagattatgaaggattaaatgcgattggctatgaagcaatggtactaggcaaccacgaatttgatttccctttaccaatattaactatgcaagaaaaatgggctaaatttccgttgatttctgctatgtatttaacaaagcgacaaaaaaagaattagttgatccttatattatgttagataaacaaggcttaaaaatagc

SEQ ID NO: 93899 - DNA, 1640 bp, Oryza sativa
tcccctgcttcatttatttgataataaataaaacgatgaaaaatcaacatactaggatacttgcttaattgttgatataacttaaaatgcgctgcaatcaaaccatctttttgttcaattaactccgctaatgctatgtccacactgctattatgtttaacttgaattgatctaattagaaataattcgtaatttataaaatcatgtaatgccgcatgacacgttttaatgttatgcaacacttcactaatataatcaggatcttaactaaaatatgctcaaaatgtgttaatgcttgcgaaaattgtccttgcgccaaataataatcacccaataacatagaggctcgcgtacacaatggtgaatattctaatgctttacctaaaagcctcaaatataaatcctcatcttccgattttatagcttgtgcatactcacaataataatgcgataaaggaatacgatcagttttaggatcaatttttaaaagcttttccgcaacattaatcgctttcttccactcatttgttttctgataaagaaccattaattgtgtaagtgaatttaccgcaaattctggctcatctaacaacaaaatataatagttttctgcgcgatcataaaaacctgccgccataaaatccttggcaagttgctgtttagctaatagtttttgttcaatagaataatttagacttgaatctagcgcttgatgaatacgtaatgcgcgatcaacttcaccgcgagaacgaaaaagattacctaaagtaagttccgcttcaaattgtgattccgtggcaatctgattttcagattcctgtttttgaagcattgatagaaaaagatcaaccgctttttcttgctgattagacaaaagaaaatttaaacccgtaacataatcacgagaaaatttattattgatagattcttgctcctttttaacactaagacgtccaatataccagccataaagcgctgcaataggtaataaaaggaacaataattcgaacattagttagtcttccgcgtattcgttaattctgtaatttgttgagcttgacgctttacacgacgattcaatgcgatagtttttactttcaatttcaaataaaaaataccggtaagtaaccaacctaaaattaaaccaaaaccgaatagaatagcaacaaggctagataagcgtaattcactttgtgctacaacataattaaatgtaatcagttgatcattatttgctccaatagtaaccgcaacaataacaactgccagggtaattaaaacgcctaaaatatatttcattgtttatcctcttagtatactaatagaaaagacaaaattgcccttagaaaaccctatactaaatcaacgcgttcttttaaatccttacccgctttaaaatgtggcacatattttgcatctaacttaacacttgcccccgttttaggattgcgaccaatacgtggctgacgataatgtaaagaaaaactgccaaaacctcttatttccactctcttagcctgctccaaagtgagcataatattttccaaaatatctttaacgccgtcttcaactgccttttctggtaaactcggatttaacgctattaatttttcaataagctctgatttagtcataaaatt

SEQ ID NO: 93900 - DNA, 645 bp, Oryza sativa
  unsure (1)..(645): unsure at all n locations
tccgcttgtgaataatgtctttactgaagtcatcaattggcaacctatgctatctgaaatgcgattatttaaatcgccggcagaattagccttattccaccaagcgtgccatatttcctcattggcgcatattagagcaatgcgacaaacgcgcccgaatcgctatgaaatggaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaaaataatcaagtgttaaaagatggcgaactattgttgattgatgcgggagcagagtttgcttattatgctagtgatattacccgcacattcccaattaatggtaaattttcgctagcccaacgtgagatttatcagttagttttagatgcaatgaaagcagcaacgcaatatcttgtgccaaatggttcttttaaagcagctaatcaggccgctatgcaagttatgacagaaggcttagtacgcttaggcattttacaaggagatattacagaattattagcacaacaagcagtgcgccaatattatctgcatggtttagggcattggttaggactagatgtgcatgatgtaggtgactatgg

SEQ ID NO: 93901 - DNA, 798 bp, Oryza sativa
  unsure (1)..(798): unsure at all n locations
atggaatcaaaattattaacgaaagtgattgcttctgctcaagctaaagtggaagcgcataattttgaaggtcgtaaaaacttgcttcaatatgatgatgtagcaaatgaacaacgtaaagcgatttatgaacagcgtaattatttattagaaaccaatgatatttcagcaatgattgaaacgattcgtgatgatgtatttaatcatgtgattagtcgttatnnnnnnnnnnnnnnnnnnnnnnnnnnnnnnnnnnnngctggtttagaagaagtattacatcatcagtttggtatggaactgcctatccaacaatggctagaaaaagaaaaggacttacacgaagaaacgttacgtgagcgtattattaaccttgctaaacaagaataccagtcgaaagaagaaaaagtgggcgcagaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaatcttttgaaatgttcactaatatgcttgaactgctaaaatcaaatgtgattagtattttaagccgtattcaagtccgtagccagcaagaaattgaagaagctcagcgtcaacagcatgaacaagctgaagcagaatcagccaactatcaagcgaccacagaagaagcattagcaaaagaaaagcgtgatgcattaccagcagagctgactaatttacagattgggcgaaat

SEQ ID NO: 93902 - DNA, 516 bp, Oryza sativa
acccgcttgcattacagtgtcataacgcgttttccacgccgatttaatcgcttcaatctcagcttccgttggattgtctaatttggcgagttccgctttccagttgccccccaacacaatatccgtaccacgtcccgccatattcgtggcgatagtgactgccgatggagcaccgcttcagcaacaatttcagcttcttgagcgtggaattttgcattgagtacgttatgtttaatgcctgcttttgttagtgcattggataagagttctgacttttctacggatgctgttccaactaacaccggctgttggcgagacatacattcctcaatacctttgattattgccgcaaatttttcttgttcgcttttaaacattaaatctgtacgatcatcgcgaataaccggtttattggttggaataacaacggtatctaatccataaatttgttggaattcaaaagcttctgtatctgctgtgccagtcataccggctagcttttcatataaacggaaa

SEQ ID NO: 93903 - DNA, 559 bp, Oryza sativa
ccgtaaatatggtgatatagtcaaccaccgtttaatcaaacaagtattactaaatcagccaattaagcacatagagagtacaattttagcccgcttacaagaagcacgccgccaaaatcgtttagtcgaacgcgatatcgcagattggttatatgcacgctatttgctcccaatcgcaacacaaggggtagaatttgactgcgaaattaccgatatttcacgtggtggtattcgtgctaaagtactagaaaatggcgcacaaattttcattccttgttcaacattacacgaaaataaagatgaaattgattttatccctgaagaaattgcactttacactaaaggggaaaaaatttatcaaatagggcaagctacccgtgtaaaactaaccgatgtgcggttagaaacacgttcggtgttaggtaatattattaaatagcaaatcactcaattctccacctatttatcaaaaattaaccgcttattttaggagtaacaatggcgacttatattatgggtgacttgcatggttgttttactgagtttcagcaactgcttg

SEQ ID NO: 93904 - DNA, 729 bp, Oryza sativa
ctatcaattgccgactgaattgagcattccaaccacatctagcccgttaaaaaatttagtggtagatattgattataatgaagtgttgatcgtagtaaaaactagcccgggtgctgcgcaactaatggcgaggttattagattcgatgggcaagagtgaaggaattctaagcaccattgccggcgatgatgcaatttttatcacgccaacacactccacgccgatggaaacattaatcaaaaatatcactacccttttcgagtcttcattttaatgaatattgtactcaccggtggcacaggcttcataggaaaagcattaacaaaagcacttctccaaacgaggcatcaattgacaattctcactcaccaaacgcaattaacctcaaattcaccaacagagactttttgtcaaaaaatgacagattggcatcacttaaatcacgttgatgccgtcattaatctaacaagtgaacctaattttgataagggttggacgaacaaacaaaaacaacaattattaaccaggcgcgtcgatttgactcatcaaatagttatttgatcaatgcggaggaaaatccaccgcatacttttatttcaggatcagcctgtggctattacggcaatttagcgaattccaaccatttctatgatgaatcaacccctgcaggcacgcactttagtgcaaagatttgtcttgaatgggaaaaagctgcattaaatgcgcaaa

SEQ ID NO: 93905 - DNA, 1069 bp, Oryza sativa
ttcaacgcattggttctggttaagccaatcacagcagtggcaattattgatcggattcgctgggttacttgttatgctttatggcattttttacgctaaatcaaaatggttttggtggcaaagtgcggggttaatcttagtgagtgtattgtttcatttattcatttttagtagtaaaaaaattgaatggattactttcgatgttgggcaaggcctatcacaagcttttgtttattaacaaaatggacagaacaaggctattttttatgataccggggtaagctggggcgcaagtggtaattcaatggcaagtcttgagatcttgccttatttaaggcgacataatattgaggtagaagcaatttttttaagccacgatgatcgagatcatgcgggcggaatttctgatttgctagcagtgtatccaaatgtgcgcttgatttcaagcagtgctatgccttatgcaaataaaatgccagaagcttgtattgtgggaaagcagtggcaatttaatcaattgatttttcgaacaatttatccgcctaaattgacaccaagatctaaaaatgctgattcttgcattataattgtggaaatagaccgctttcgtatattgttgacaggcgatgcaactgcccaacaagaaagcatcatagccccatcattaccacggattgattttttacaagtgccacatcatggtagtaagacgagtagtagccaagcactattggctaaaattaaaccgtatttggcaattgcttcggtggggcgttggaatccttggcgaatgcctcatcctagagttgtagaacgttttgaacaatacaacattcctttagtcactaccgcaacagatggcatgataaaggttatttttgagcataatacctgggaggtaatcactaacagaaataagttttctgcgtggtatcgacagttatatgcaacatcggctaaacagtaaggatcaggcgtaattaatatttattacgccctatcattttgttggaggcaattacggcaaatcatttaatgcattaggatttttattgataagcattgcgtc

SEQ ID NO: 93906 - DNA, 572 bp, Oryza sativa
ttgtattaataaaaatagtggagtacacgatattatacaagcaaatggtaaggtttgtattaatgtgttaaaccatcagcaagaagaaatggcaaaacattttgccagtatgttgccgagtactatggaagagcgtttcagttgggatatttgggatgaaggaattgatggtttacccattttacgcgatgcgatttctgctctgcaaggtgatattattgatactcattctgttggcacgcatactatttttatggtgcaactgaagcatattgaggttaagccaagtaatagtttggtttattttggtcgtcaatttaaagtgattacgatctaatcgcacttgtcatttatagttttttaatgggaatgtagccttgcttttaaacaaggctacatttttattaggcaattcctttatggcgtaataaagcatctaaacgtggtttacggccacggaaacgttcaaataaaaccataggttcttcagagcctccgcgggttagaatatgatctaagtaagcttgacctgtttggcggttaaaaataccctcttcttcaaattttgcaaa

SEQ ID NO: 93907 - DNA, 752 bp, Oryza sativa
ctagcaatcaccgactagcataaaatagtacaaacaaataatgttagcttaccaataacgtaagcgaggtgattaagcatagaagtgcaaaggagtgacaatgaatcctaccaaatttgtattagcgaccagtaataaaggcaaagtaaaagaaatggcggatgtattgtccgctttcggatttgaagtaattgcacaaagtgaatttggcttagtttcaccgccagaaacaggcttaacttttgttgaaaatgccttattaaaagcacgttatgcctcaaaaatgaccggtttacccgccattgcagatgattctggattggcagttgatgcattagcaggggctccaggcctttattcagcacgttatgccggaattgaggacgatgatacagccaatcgacggaagttattagctgaaatgcaaaacgtaccagatggacaacgtgcggcaaaatttgtcagttgtattgttatgctcaagcatgaacggatccaacgcctaagattgcatttggcgaatgttttggtgaaattctacgtgaagaacgtggccaaaatggttttggctatgacgcattattcttttatccagctaaacagtgcacctttgcggaattagattcaacggagaaaaaacaaatttcacatcgtgcattagctttagtcgctttgcaaaagcaactttaaacggtattaacgctaaaagtaaatagcatgcaaaaatttaggaaggacaaatgattattacg

SEQ ID NO: 93908 - DNA, 630 bp, Oryza sativa
aatgcaagccgtaaatatcgcaatgttttagcattaatttttacgttaggatattcagtgagataataaaacagatctagaatagtactaggctgttgtgtaaaacaacgacgattttggcagttgagttgatggccttgtagataaaaataattatcaagcgcttgttttcagctaaatgatgcggattacgatccgataattgaaaattatctagtaataattggcttaattgagaaatcgattgtgtcgcttgaaaataatgacgcatcattgtttcaaccggctgattaccttctccttgataacctaattgtttgcttaaacagagctggcgatcaaaatataagcggttgtcataacgtttaagctgtaagtgtaaggcaaaacgcattttaaacagtaccgcttgtgccgcgcttaattcgcggtattcttcagcaaataaaatccctttattgagtagcgtatccagtgaaaaggtgccaaattgtcgcattgagatccaataaattaaatgtagatcacgtaaaccaccggggctatgttttatatccggttctaaattatagccagtattatgatagcggctataacgttcagcacgctcttccatttttgctttaaaaa

SEQ ID NO: 93909 - DNA, 680 bp, Oryza sativa
aaatattgctcagctaaactagccacaccgacatcgcgttttggtgcagtttgatagacttccataaacaataatccagtgtaagctaataatccccacaaactaatcaacaaaaacaaggtcgcgccaaagcccattcctgctgaagttaatggcattgcaagcattcccgcaccaatcgttgtgccggcaatcattaatgcactgcctaatattttatttttcatattatcctatttttactccactttattataaagcactttattctagcaaactaaaattaaaaagcggttagattctgcaaaatttttgcatatgctaaccgcttaaattgatttatatcatctaaacgcaattaaaaccacctaatatataaagaaaaagccgagataactctcggctattatcatgcgctttcagttaagcatctacccgattatccgcaacatctgcatctgtattcggcttagcctcttcaatcgtattgctcgctgatgtagcatctgaagaatcattcgaagaatttttttctttatcatcattccacccttccggttcgccaacaggacgacgatgcattaaatcatcaatttgttttcgatctaatgtttcatatttcaatagtgcatctttcattgcatgcaaaatatcaatgttttcttctagagtctgcttag

SEQ ID NO: 93910 - DNA, 839 bp, Oryza sativa
acatcattttagatatcggtagcccagaagaaatggacgaaaaacctttagttttagcacaggctcaagtgattgaattgcctttctataagttatccacgcaatttgcgcatttagatcaaagcaaaaattaccttttatattgtgagcggggcgtaatgagtaaattacaagcactttatttaaaagaaaagggctatcagaatgtgaaggtgtttaacttaccaaaatagcgagttaataagcgcttaaatttgtgaaaaaaagcgtgaaattgatcgctttcactgaataagaaagggattatgcataaaaaactttatcttgcttcaaatagtccacgtcgttgggcattattacaaaatctaggtttagctttattaccacttgcaagtgaaatagatgaaactgcacatgcaaatgaaatggctcaagattattgttcacgtattgctagggaaaagaatcaagcggctcaagcagttagaattcgccagaatcttgctgaatatccgattctaactgccgatatcatggtttcgattgacggagagattttaggcaagccaagtcatcagcagcaagcagttgagatgctcaaaaaattatctggccgaactcatcaagtctatacggcagtctgtgtaagtgctaatcaacaactatttgagtgtattcatagcagtgaagtcacctttaaaagattatctgaggctgaaatttatgcttatattgcaactggcgagcctatggataaagcgggcgcttatggtattcaagcactaggtggtatatttattcagcatttagcaggcagttttaccggtgtaatgggctta

SEQ ID NO: 93911 - DNA, 863 bp, Oryza sativa
tagtgcagtatcaaccaaaactgattttttgattgccggtgaaaaagcgggcactaagttgactaaagcagaacaacttggcattcgtatcttagacgaacacgcatttgcagatttaattaagcaacttgaatacgagtagataaaaacgcatagaatacaagcggttgatttcgctaacatctgcctaaaagaggaacacatatggctattttagtaacaggcggggcaggctatattggcacccataccgtagtagaattattaaatgcaaataaggagattgttatattagataatctgtctaattccaatcaaattgccgttgaacgcatacacaccatcactggcaaacacgccaaatttaacttaggcaatatcttcgatcgagttatttaacgcaagatttttgccgaaaatcaaattaatgcggtcattcattttgcgggttcgaaagccgttggcgaaagcgtgtttgagccattacgctattaccaaaataatgtaaccggttcgattgttttacttgaagaaatgttaactgcgggtattaataccattgtatttagttcttctgcaaccgtttatggcgatccaaaaacaatccctattgtcgaatcttgccccgtggggcaaaccactaatccttacggcacatcaaaatatatggtggaacgtattttagaagataccgtaaacgcaaatccacaattcagtgcggttgtgttacgctattttaacccgataggcgcacatccaagcggtttgattggtgaagatccaaatggcattccaaacaatttattgccttatattagtcaagttgccattggcaaactaccgcaattatccatatttggcaa

SEQ ID NO: 93912 - DNA, 762 bp, Oryza sativa
  unsure (1)..(762): unsure at all n locations
caggcatatgatgcatcgcacggtcganngagcttgtcccggatacctgcgtggaaactatggcattactagcataattttatctaactttgttttttttaattgactaatactaacacgtaacctgattgtgaaacactcccaaggtgatatatgcaattaatgattaaaaatggcacacttggtcaacaaagacaacttgcgtctccgcattttaatgcgcgtccgcaaatagatgatatttcattactcgttattcattatattagtttaccgcctgatcaatttggtcagccttttattgatcaattttttcaaggtaagttagattcatcgcttcacccttcttttgcacaaattaaagatttacgcgtatcggcacattgtttaatcaatcgtaaaggtgaaattacccaatatgtgaattttaacgatgtcccttggcatgcgggcgtttctagtttcgaggggcgcgaaaaatgtaatgattattcaatcggtattgagttagaaggtaataataatcacgcttttactgaagcacaataccaatcttttgcacaattaactcaagccattatagcttgatacccttaaataacgatcgatcggattgttgggcatagtcacattgcttcccggtgaaaaattgatcctggccatattttaaattggggtattccaatcgttactcaccacttaccatataaaaaaagctgggttctccctaaccaagattgatggataaattttaggcattgg

SEQ ID NO: 93913 - DNA, 659 bp, Oryza sativa
ttatttactttatttgtattgccggttatttacaccttcttaggtgaaaatcataaaccgctacaagagtttgaagaaaataagcattatccagtgattgctgagactgagcattcataacaaaaacataaaagcctcgcatcggcgaggcttttgttttcattattttgacgatgtcagataaccatttttctattacaatacaatccttatcttaaggttatatattattaaggaatgaaaatgaccccatttagcgtagtgattttaaccgccggtaaaggcacacgaatgtactcagatttacctaaagtactgcatcctattgcaggtaaatcaatggtcaaacacgtgattgataccgtcaaacaaatggacgccaaacaaattcatttagtgtatgggcacggcggttacttattaaaaacacatttaaaaacagagccactcaattgggttttacaggcaaagcaattaggtaccggttacgccaagcaacaaaggggtactttttttgcagattaataaaaaattttaattgtaaaaggcgaaacgccatttaatacaagcacaacctttaacccgctttatcgcagcaaacccggcaaatggcattgcattattaccagtagaattagcagatccgactggttatggca

SEQ ID NO: 93914 - DNA, 672 bp, Oryza sativa
atcccccatcattcgataaacattttgtccgtgattggctcgcaaatagtggttggaataaacaggcaccattctcctaaaattcctattgatgtaattcagaaagcggtggctaataatcaaaaagcgttggatctattgactaagtaatcaaatatgatcttataatgaataagcggatattaatttctattaatatccgccttattattgatgggacgttatgagtaatatttaccgtttattattcagcattattcagcgctactggcagattgtataaaacgttctattttagcgccaatgcgacgtacctttttttccatatgttaatatcggcgatctatatggtagatccgatccaccatggtttcactttatgcaatacagccggctaatactaaactgattgatgcacgtaagtcagttgccattacttcagccggctttaattgctcaacgccctgacaaatggcagtgttgccctctatttccgcttttgctcccatacgattcaattctggaatgtgcataaaacggttttcaaaaatggtttcagtgattcggcttgtgccttctgctaccgcattcaacaaagtaaattgtgcttgcatatcagtaggaaaaccggggtgtggcatagtgcggatattgaccgctttaggtcgttga

SEQ ID NO: 93915 - DNA, 790 bp, Oryza sativa
  unsure (1)..(790): unsure at all n locations
cgatggccatttgagtgcagtagcctctcgtcgaanncgagctcggtacccttgttgatgaaatgttagccgtcacagatttagtgatcttagatctcaaacaactcaatgatgaaattcatcaagacttaatcggtgtttcaaacaaacgaacgcttgatttcgcccgctatttacataaaatccataaacaaacatggattcgttatgtggtcgtaccaggttatactgacgacgactctgcccataagctcggacaatttattcagaatatggataacattgaaaaagttgaattattgccttatcaccgcttaggcgcacataaatggaaaacgttaggctataaatacgaattagaagacgtattacccccctctaaagaagatttagaacgtttgaaagcaattattgaaagttacggacatactgtcaaatactaacctagcggtctatttagcccaaaagattgccaaatagacccgcttattntactcaacaacttgatatttttcacaagactccccaaatataacgatactttttaacaaaaaggaattaaatacataatgtcaaacccacttttaccatacacaggtttaccttgcttctcaaaaattaaagctgaacatattccaccttgccgtgaaaccggtatccaacaatgtcgtgacgtgatcgaaacagtcgctcaaattcgacaacccacttgggaaaaatttatataccacaagcagaaagtcgcggataattttcacgggttgggcaccggtgggcactaaaatgcgtg

SEQ ID NO: 93916 - DNA, 799 bp, Oryza sativa
  unsure (1)..(799): unsure at all n locations
gatggcatttgatgacttcacttcgggcgaacncgagctcggtacccgttttagaagatattgttaaaaaaattccagcaccagaaggcgatccagaagcacctttactttctttgtttattgattcttggtttgataattatttaagtgttgtctctttagtccgcgttaaaaatggatcaattaaaaaaggcgacaaaatcaaagtaatgactactggccaatcgtataatgttgaccgtttaggtattttcacaccaaaacaagtagatacgacagaatttaaaacaggtgaagtgggttgggttgtttgtgcaattaaagatattttaagtgcaccggtaggccatactttaacacatcaacaccattctgctacagaagttttacccgtatttaagaaagttgtaccccaagtttatgcaggttattccggatcgtttacatgatattgaacttttctggattgcttagggcaaattagccctaatgacgcttttttattttatgcaccaagaaatttcaccccgttaggcttttggtttccgtggggattcttacgtttattacatatggagatcatttcaagaacggttagaacgtgaatattgatctgatttaaattacccctggcccctacacgtaggtattgaggtattaccaacacaattggcgaaccgattaacgtattatggcccggcaaaattaaccgcccattatgtcattttgatgaaatttcgcgaacccaattgctgaatgttatattcttgctcccacaaggattattatggtattatat

SEQ ID NO: 93917 - DNA, 610 bp, Oryza sativa
tataggccgaattcgagctcggtaccctatttgagcctgaaattccacaaaatagtgggaatattattcgattatgtgcaaattgttgttttcgattgcatatgattgaaccctttggttttacttgggatgataaaaaattaaaacgttctggtttggattatcatgaatttgtcgatattcaaaaatatactcattttgatgattttcttgctcgtgcaaagcctaaacgtttatttgcattaacgactaaaggtgaagcaaatcatagccaagtacaatacgaacaaggcaattttttgatgtttggaccagaaaggcgtggaattccaaccgctattttagagactttgccaatgtcacaaaaaatgcgagtacctatgtgtaaagatagtcgaagtatgaacttatcaaataccgtggcagtagtcgtgtatgaagcttggcgacaatttggttatcaaggtgctgtagcaagacaagccatttaaataaataagcggtctttttgtgattatttttgcaaaaaagaccgcttctgaaaacaaataaaaatcctaacgattaattatttgaaatatttataaaattacagttttgctgaaagcat

SEQ ID NO: 93918 - DNA, 554 bp, Oryza sativa
gaattctagctcggtacccactttaactgattatttttgattgtatagatcgcactgttgttttacggacaccatttcttttgctttggattgacaaactcagtgcctttatccttaaatttaaccccttctaacgtcagtaaataacgtttagtcgctagccctcctccaaagccggtcaaactattatttttacccaatacacgatgacaaggcaccaaaattgagatcggattacgtcccacggcaccgccaaccgcccgcattgcttttggttttcccaaacgtactgcaattttaccatagcttgttgtttttccatatggaatatggcgtaatgcttgccaaacggcctgttgaaaagccgtgccttgcggtgctaagaaatcaagttgcgaaaaagagaccgcttcaccggcaaaatagcggtctaaaagatcacatgttttactgaaaacgggatacataggatcattactactgataggttgccattctactgtttggcgagtgaattgctcttgttcaaattcaacaaccattaaaccttgttg

SEQ ID NO: 93919 - DNA, 1028 bp, Oryza sativa
  unsure (1)..(1028): unsure at all n locations
cgagttctgattcagtatcaagtgcagatgttgcttcatctaacactagaaccggtgcattacgtaataatgcacgagcaatggctaaacgttgacgctgaccaccggataaacttgcgccattttcaccaattacagtatctaaaccctgttctaatttttcgataaactccattgcgtgagccgcttgtgctgctgcaataatttgcgctcggctatatttatcttttgctgcataagcaatattatttgcaatggtatcattaaataagtgaacttgttgtgaaacaacagaacattgctcacgcaagttttctaaggtatattcttcaatattaacaccgtcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggaatagtaaatgaaacttggttcaatgcctgctcttctttaccttcataactaaaaataacattatcaaatgtaatacaaccttgtgctcgttcaacctgcttagtgccattattcttttcggtttttaaatctaaaaactcaaataatgtttgacatgctgccatgccacgttgaaattgagagttgacactggttaacgattttaaaggacgtaacatagccatcattgatgaaaagacaaccgtaaaagagccggcagttaaattttcactcataacctcagggaaagtagcaacataaagcactgctgatagcgctaaagaagcaattaattgcactaaaccatcagatataccatcggcagagactatcttcatgcctttccgacgcatatcattactgactcgatcaaaacgtgctttttcaactttttgcccaccaaatgaaagaacaactttatgcccttttaacatttgctccgttgtgactgtcaattctcccatagaattttgaatattacggctcaaaatacgaaaacgctttgaaacaatactaattaaaaatgcgataatg

SEQ ID NO: 93920 - DNA, 787 bp, Oryza sativa
  unsure (1)..(787): unsure at all n locations
catggcattgagtgacttgcgattcactatgggcgaattcgagctcggtaccccaacgggcagagcatacagtgcttttcctagcgcattaatgccattgattaaccaacatggatttgagctttttgtgactattaatgggcaatataatttctatcaaactcagctaatcagtcagtatggattaagccaacaacaaattgaacgctgtatccattttttaaaacaacttaatattgcttatggtttcgttaccaccgatcaaatcgctgtatcagaaaataacctaatggtgcatgaggcactctcgcccatcaaagccgattatattgttgatgctgaacattaccgacaacataacgtcatgcaactattagcattttatccacaagaacgtgatcacgaaatctttaatacaggaatctttcaacaggatttaaaagtgcctcgttggcatcaaaatgcggtcgatattctctgtaaacaacattcaaaagcccaagggattaaagatgtgattaaacattttaatctcaacctagccaatacattagcctttggtgatggttttaatgatttagaaatgttagaaacggtcggggtaggcgttgcgatgggtaatgcagaagaaagctgtaaacaattagccgatttttgaacccaaccaatcaacgaagatggtatcttatatgcattagaacatctaaacaatatntaaataacccactcgtaaacaaagggttcttacgaagatgcattcatcagccttatttatcaagcggtcgat

SEQ ID NO: 93921 - DNA, 831 bp, Oryza sativa
ccattgttctttaaggaaaatacccaaatgttatttggtgatgctaaagaacgggtagatgatattttacgagcattaaattagcattattagtgagtcaagcggtctgattattgaaatatgatgtaaataaagtagataattagatcgcttatgaatgaaaaaagccttaatttaaggctttttatgttgattaacggaaagatttatttatcttcattgatacgacttgaaatcgcactttgttgatttttatattttgcatcttcacgggcgttataaggcttagccgctgctccactcaatacttcaaagcttaatgcaccaatcgccatattaagacgcaaggctaatggtagtttaccagcattaaagaattctaatacaattttgccgtgccaaccttggatcaatgcgatgagcggtaacatgtaccattaatcctaagcgagccaatgaagaacgttcatctagccaaccaacaatattatccggtaatttcactgactctagggtagtggccaaggctaattcgcctggatgaaggaaaaaagcttcaccttctgctaaaataatttcatcactcatgattttttcaagttgtgcgctgacttgttcaccaggcccacttaaatcaatataaggtgtggcgtgctcacgaaaaacacggaatgaatttcctagtcgcacatcaacggtcgcaccagaaattttatcattagttgggcgagggctaatgttaatgagatcttgatctaaataatgctcaatatcggtatcacatagacgcataacctatcctatttttttgataataattgtttgatttgg

SEQ ID NO: 93922 - DNA, 809 bp, Oryza sativa
  unsure (1)..(809): unsure at all n locations
caacacgtgaataaaacagaatccgccgtgcgaattactcatatgccatcaagtattgcggggcaatgccaaaatgggcgttctcaacatcaaaataaagatcaatgtctgatacagctgagagctaaattataccaaatggaaatgatgaaaaataacgctgaaaaacaagcaatggaagaaaataaatctgatattggttggggtagccaaattcgatcatatgtattagatgactctcgtattaaagatttacgtaccggtgttgaaaaccgtaatacacaagccgtactagatggtgatttagataggtttattgaagccagtctaaaagctggtttataaaacaagcggtaacttttacagttcatttttacacaaaaataaaaatagcccattaatttgggctatttttgtttctgttatgtacgctcaatcacttaaactttttttctcaatactaactgacttaatactactagtgacaatgagaaaataatcataatcgtcgctaaagcattcacctctggcgttacgcctgttttaactaatgagaaaattttcagtggtaatacttcatagcttgggctagtcacaaaagatgaaacaacaacatcatctaatgaaatggtaaagcttaataaccaacccgaaataattgaaggcaacgccaacggtaaaactattttgcgtaaagtcgtcacctcactagcgcccaaatctttggcagcttctaacattttaccatcaaaatcactcanccgtgatgaaatagtaataaaaacatatggcaaacagaacgtaatatg

SEQ ID NO: 93923 - DNA, 766 bp, Oryza sativa
acatcattacgacaaataacattccgccaacaaattgcttaccacggaatttataacgatataaagcaattgaagtcaatgaacctaaaatcgtagacaatgtagccgcaaaaaaagcaattgtaatcgaatttgtagtggcattaatcaacgtatcgttagcaaataaacgttcataccaattccaactaaagcctttccattttagaccgtaacgatcagcattaaatgaattaatcactaaaatgatgataggtatatacaagtaaacaaagactaaacaaacaaaaaggtttctaaatatctttttcattattcaagctccacctttttatttaaaaatttgttagcacgataatatacatacaacatcaatgccatgagcaaggttaatgcaatactgactgccgatcctaatggtaactggttagtattcaagaatagactcttgataatattaccaattaatggcgttttaccaccgcctaatagatctgcaacatagaacattcccatcgcaggcaataatactaataagcaaccggccacaatacccggcatcgttaatggaatagtgatacgaataaagcgttgcaatgcatttgcacctaaatcttttgccgcttctaataaacgattatcaattttctcaattgaagaatacagcggtaaaatcataaagggcaatagaatataaaccaaaccaataataatggccaattctgaattgagtaaccgtaaaggttgatcaatcaaacctactgcg

SEQ ID NO: 93924 - DNA, 785 bp, Oryza sativa
tgtgggcatttgagtgacatatctgatcactataggcgaattcgagctcggtacccttttggatttaccattaacttgctgaccttacttggactaattttagcgattggattgttagtagatgatgcgattgtagtattagaaaatgttgaacggcatatcaaacaaaacggagaaacaccattcagagcagccattattggtacgcgcgaaattgcaacaccagttattgcaatgaccatcaccttgatggcagtttattcgcctatggcgttaatgagcggtattaccggatctttatttaaagaattttccttaacacttgctggagcggtgtttatttcaggcgtagctgccctaacactttctcctatgatgacaagtaaaattctcaaacaatcagaaaaaccaagctggttagaacaacgtatagaaaaaaccttacataaagtaacggatatctataccaaaatattattggttgttatggcaagccggtatgccatattagtgtttgctggattaaattttgcatctttgccgatgttatttaattcactttctagtgaagtaccccctggcgagacccggggattggatgggaatgggaaagtggcctgcccacgttatatggactattttgcagacgtgatgtttcctgttgttaaccaaattatcaactgccagaagtaatgccacacacattatgcccgggttttccttttattattggtcaattatgtaacggcgcttaaagattgaagtgacctccttgtcacaaaaag

SEQ ID NO: 93925 - DNA, 767 bp, Oryza sativa
atggcctttgttgagtgagcacccatgcaaataggccgaattcgagctcggtacccgggcttgaattatcgcatttaatgcaagcattagatcaattttcaacacgtaagattgtttatgccgatctctattttcaattgagtgtggacgaaagttggtcattagaagattcaattattaaagagggtggcttttatatcgatcgtggttttggtgtccgtgcggtttcaggcgagaaaacgggttttgcttatgccgatcaaattagttttaatcaattattacagtgtgcgcaggcagcacgttcaattgataatacgcatagccacttagccatacagtcgtttaaacaaacggttgctcctcagcgttatgctgcgatcaatccgttggatagtattagtcgtgagcagaaagttgaattattacatttagtcgatcgtaccgcacgagctgaagatagccgagtgatgcaagtgaatgcgggtatttcggcggtttatgaagaaatattgggggctgctactgatggaacctttacccgcagattttcgaccgcttgtgccgttggcggtttccgattagtagaagaagatggcaaacctgagcgtggttaaccggtgccggcgggtcgtatggcttaccgtgtttttgagcctcaatactaatggcaaatggagggctttcccggccgaatttttactaagaagcggttctcaggctttttaattaggggattactgttcggcgggccaaggcaattggtt

SEQ ID NO: 93926 - DNA, 707 bp, Oryza sativa
  unsure (1)..(707): unsure at all n locations
cccagtacttttgggggcgggttgttgaaaaaagggctcatctaataacattgctaatagtgtggtatttactttaccggttgatgcccattccccattgtggtcgtaatgtttgctgattgggcattaatacggaaatattaacaatgccacctatgtttaacaccacggttaaacggcggcgatcggcaaaaatgcctnnnnnnnnnnnnnnnnnnnnnnnnnnnnnnnnnnnnnnnnnnnnnnnnnnnnnnnnnnnnnnnnnnnnnnnnnnnnnnnngcctgttttggcggcaagtaaatgcatatcaccgagttgtagcgtaaaaggaaatgcgccacttggctaatgccaaacggtttgtccgtgacaaccaatggcttgaatatcatgagcatgcagttgattttgtcttagaaaatcatgtacacaatcggcataaagttgcccaagctggtgatctatctctcctaaattttgcaaactggtttcacctgttttcagtaattgtgtgagcaatgttcgcaagttttcgggcattggtgtaaagctagaagcggtcagttttggtggattttgtgcaaaatccattaaggcgagatcaacaccgtctaggctagtgccggacataatgccaaggtataggttattttgcataaggcttcattgattggaaaatttgttgaattatatcgaatattgtgct

SEQ ID NO: 93927 - DNA, 627 bp, Oryza sativa
  unsure (1)..(627): unsure at all n locations
attttagtggcaaaattttgggtaagcggtcgtttttattactttttagcaaaaagccctcaagcttatttgctgagggcttttttatggcgagattaaagtgccatattggcgcttaataagccaaggttattaaataatcatatttaataaactcggtagcatattggcgattagcaaaccaaagcagatcctaaataccatacttaataaaccaggtagcatanagctatggttgaaaatatatttgccaattttagtggtgccggtagtatcaaagtcaattgaggcaatgattgggccatagttaggaatgaagaagtaaccatttacggcaacaaagaccccaatcagaacgggtacaggaataccgatagcaattgccaatggaaaagtgtagcaacggttgccccttggctgtttactaagatagataaaataaagagcgcaaaagcaaatgcccaaggcgcagtttcaacgaggcctgataccatacttttcacttcagttatatggctttgcattaatgtatcccctaaccaggcaataccaaaaatggcgataactgcacgcatacctgcatggaatacagaacctttggtaatttcgttaccatttggtttacag

SEQ ID NO: 93928 - DNA, 741 bp, Oryza sativa
ggcctattcgagctcggtaccctgttgtgcatggttatggtttagccgcgtcacaactacaacgattgcgcgatcaccatattccattaacagtagctgtcgataaagtcgcggcaagcggtggttatatgatggcatgtgttgcaaataaaattgtcgccgcgccttttgctattctaggttctgttggtgtagttgctcaagtgcccaatatccatcgcttcctcaaaaaacacgagattgatgtagatgtgatgaccgcaggcgaatataaacggacagtaaccttagccggtgaaaatactgaaaaaggtaaacaaaaattccaacaagagttagaagaaacacatcaattatttaaacaatttgtggcaaataaccgtcctcagcttgaaattgaaaaagtagccacaggcgaacattggtttggccaacaagcattaacgttaaatctgatcgatgaaattgcaaccagtgatgatttaatattaaatgccgtcaaagacaaagaagtcattaaactagcctttaaacaaaaaaaaaagttagcacaacgtttaggctcacaaatggaacaatcactcgaaaacctcattgctaagctattacataaaaaccgatcaaatatgctttaatatgcaaaaaacagaagcggtaattacaccgcctttttagggttaataccacccgtattttgcgcctatgttaccccaaatcaacttaattagctggctcttcttt

SEQ ID NO: 93929 - DNA, 1058 bp, Oryza sativa
caccttaaacggttttatgcacattccgttgaaataaaaattaaagcagataatacgcctgtaacggaagcggatctttttctcagtcaatttattatccagcaacttcaacaattaacgcccacgattcctgtgttatcggaagaaaattgtgccattccattaacagaacgggcaaattggcaagaatattggattattgacccacttgatggtacccaacaatttatcaatcgaaccgatcaattttccattgcgattagcttagtacaacacaatcagcctgtaatcggcattatttatgcgcccatattagccaaaacttattttgcaatgcgaacaagcggtgcttttttgcaagaaaatggcataattcgcccgcttactcctcacaaaattatggccaataatgagcgcttacgcatcgcaatgggagcaaccaataggacgacagtagcccaatgcctacaacaacctctacaagcagatatctttcaatatggctcgagtagcttaaaagccggtttagtcgcagaaggcaaagccgactgttacattagattaggcgatactggcgaatgggatactgccgccgctgaagtgctattaaatgaaatcggtggcaagatttttgatcttaattttcaaccgcttagctataatcagcgacaacattttattaacccgcattttgtaatggtggcagacaaacaggctgactggcaaaaaatctttcaattcaatgagtgacatctacatgcaaccgctattaaaatgttgcatattaggtaaaattttcattccaatcgagaatcaaaatgaatatagaaaatagttgtatcgtaatttttggtgcatcaggggacttaacattccgtaaacttatcccagcactatataatctttttaaagtaggtcggttaggcgaacatttttctgttttaggtgtttcacgatcagacctaactcacgattcttttagacaaaaaatgcgtgaagcattaatcaaatatgagcaagcaagcgggcagtttttagatgatttttgcaatcacttg

SEQ ID NO: 93930 - DNA, 654 bp, Oryza sativa
tactcgggtaactgaaatcgtaatccacttcaaaacgactccacatccagtctttagccaaaatgcgcctgaaaataaattaattatccgggtacaacctgatgaaggtatttctatgcggtttggtttgaaaaaacccggtgctggttttgaggcgaaagaagtctctatggattttcgctattctgatttaagctctgcttcaagtttattaaccgcttatgaacggttactattagatgcattaaaaggagatgcgaccctatttgcccgaaccgatgccgtacatgcctgttggcatttcgtacagccgattctagactataaggcagaacgtggccgagtgtatgaatatgaagcaagcagttgggggcctaaagaagctgataaactgattgcacgcaatggcaaagtatggcgtaaaccgtctggaatgatgaagaaaaaaatatagtcaacataagaaaatagctgcaataatcactattttctgtctaattaaggaatattatgcattaccttattttcccaacggcacaatgtgccgttgaaaaaatagcgcaagagtttattttatatagtcaattaaatcgccctgtacatatttcattatcgggcggtagcacaaaaaaattactcttcaaaaccttggct

SEQ ID NO: 93931 - DNA, 2235 bp, Oryza sativa
  unsure (1)..(2235): unsure at all n locations
actaatgaaagcaacagaacagctatcaagcctagaaatgatggcggtggatccattaagacgagtcatagcgcctcgcttttgggcaggggttatttcaatgccaattttagcagtcatttttaccgctattggtatttggggcggttcattagttggtgtggactggaaaggcgttgatagcggcagtttttggtcagtcatgcaacattctgtaaatggacaagacttgatcaatggttttattaaaagcatcatttttgctattgctgttgtttggatcgcattatttaatggctatgattcaactgctacctcagaaggtattagccaagccactacacgtacggtggtacatgcatcattaatcgtgttaggcttagattttattttaactgccatgatgtttggcggttaactcaagaaaggaaataaaaaatgcgtcaatcaatcaagtatgaattttgggtcggtttatttggtcttatttggcttagcttccttagtgtttttaggcttacgtgttgctaatgtacaaggctttaccactgaaaaaacatatacgctatatgcaacttttaataacattggcggactaaagaaccattcaccgattaaagttggtggagttgtaattggtcgagtttcaaacatcgatttagatcctcaaacctatactcctagagtcactttagcaataaaccaaacttttaataaaattcctgatacgagttcgctttcaattaaaacttcaggcttattaggtgagcaatatattgtattaaatgttggctttatgctagaaggcgaaacggaatatatgatagaaggaaatagctttgccgataccaattcagcgattgtcttagaagatttaattgggcaattcttatatggcgataaaaaatcagcaaccactgaataataagaagtagagtaaattaaaacacgacactatttaaacacaacgagatattcgttgatgattaaaagtgacagattcattttatcatttggagatttacatgttaaaacagcttaaaaaagttattattaccacggcgattgcattagctacactatgctcaacacaagcatttgctgaaactaacccatatctattaatgcaaaaaactgcggataaattattcactaatattaaaaacaatcaaactaaaatcaaagcgaatcctgaatatttacgtgatatcgtacgtgaagacttaatgtcatacgtacacatcagatatgctggccaattagtgttaggtaaatcactttcttctgtatcagagccacaacgcgaaaagttttttaatgcttttggtaaatttatcgaacaagcgtatgcgcaaatcttaacacagtatgaagatcaacaaatacaaattgaaaatgaaaaaccacttggcgataaatctattgtcagtatccgcgtaaatgttttatcttctggtagcacgccacccattaaattagattttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatatcttacgccaacaaggtattgatgcattaactaatcaagtagaaaaagcggctaaacaacctatcactttaaataaataatttatttatgatgccagaaaaaacattacaattcggtattcaagagcaaaatggaagcctttttgtaacattattaggtgaattaactcgagacacgttgctaccattatggaagcaacgtgcttcttttttatctaacccacataatgaaacaatttattgggatttaaaccatctgctacgaatcgattccgctggttttgcattactcatagaattgctaaaccactaccaaaaacaaagcacaaattatttaatcaatgtaccagatgttatcttaacattggcaggtttatttggcttacaagattggttagactcatttttaacaaaaagtaaaacagactaaggattaaaatggaacctacacaattagcagaaattttacgtaatgccctaccaaatgcggttgaaattcacgcacaaggtgaaaactcacattatggcgttattgttgtaagtgatgaacttgctcaattatcaaaagtaaaacagcaaccagcggtttatgctccactgagcgaatattttgctacaaatgcagtccacgcattaacgatcaaagtcttct

SEQ ID NO: 93932 - DNA, 1102 bp, Oryza sativa
taagcgggcaaatggatggcgttgatagtagtgtgttaatgatgaatggtattcagtatcttgcttggtcagcagttgagatgtggctgaaaattgaatacctttaattgcttgaatatctgttatttgtgctgagatggtgccaactattttggggttatgtacataatttgtgaatggcgtgtgtttttactggtcagtaaaatcaaacgcgccatgttgtgatcaaatgcataaaaacaactggctgtccagaaatcatcaatagtgtatgctgcaaaattgacgacgtggttatcttgaataaaacgactgatgaatgatggtattttttgcatatttgtgtagcgttatttctctccccaaccaggcattgcgatatcaatattaaatacatctaatgcgcgacttacgctatcagtcacaatatcatcaatggatgtggggttttctcaattacatcaataggagttttaaaatgaaagtgcctgtttattccaaccactatttgcgagccaatcacggacaaattgtttatcgaatgatggtggatttatcccttcttgataagtttcgaccgaccaaaaacggcttgaatctggcgttagcacttcatccatcaacgttaatacaccattctcatctaatccaaattcaaatttagtatcacaaataataattccttttgttaaggcatatttcacgttcacactcttcgtatgaaatattcacatcgtgatcacccacttcagctttactagacggcgtaaaaataggttgtggtaatttactcgcctcaactaacccggcaggtaatgctaaaccacaaatactaccggtttgttgataatcttttaagcctgaaccggtcaaataaccccgcacaatggattcaattttcacaggtgttaaacgtttacaaaccactgcgcgatgttgaatagcctcagcttcttctttagctaacacatcgaaaacagaatcacccgtaaaatgatttggcataatatgctcaagttttttaaaccaaaaattggagatttgcgtcaagatttcacctttagcaggaattggatccgctaaaataacatcaaaggctgac

SEQ ID NO: 93933 - DNA, 561 bp, Oryza sativa
atgtttatggtgcagatcatattaaaggcgctaagttttttcttgaaagacaccgattttttgtggtggaagatggaatgatgaattattccaaaaatatgtatgcgttctcactctttagaacaagaaatcccggtattttgccgggtggttttcatccaaacctaaagactatttttttgaccaaagataattcgatcccagatcaaattgctcataaaagagaaatcattaatatcaaaacattatggcaagctaagaccgctaccgaaaagactaaaatactttctttttttgaaatagatatgcaagaaatatccgtgattaaaaacagaagttttgttctctatacgcaaccactttcggaagataaacttctgacagaagcagaaaagattgatatatatcatactattttaactaaatataaccattcacaaacggtgattaaaccgcatccaagagataaaacagattataaacaactgtttcctgatgcttatgtgatgaagggcacttacccttcagaattattaactctattaggtgtcaattttaata

SEQ ID NO: 93934 - DNA, 629 bp, Oryza sativa
tttagcgattttatgtgtattgatcagcgcattggctaagttaccattgccacaatcaattgcagtaacgggctcgatcgaccaatttggtaatgtattaagtgttggtggagttaatcaaaaaattgagggcttttttaatctttgtaaagcgcgtcagttaacaggtaaacaaggcgttattattcctgccacttgcctttctcatttaagtttaacctcagacgtgatcaatgcaattaaagcaaaacaattccatatttggagcgtcaaaaatatctttgaggccgtatggattttattagaacatcatttttatgatgaagaccaaacaacagcaaacgataaaccaactattttcaatttgattcatcaacaacttgaacaagaacaagaaaattctgctagcgggtcattttttgcaaaaatttaccaattatttaccaaaaactgatcggatttgctcagctaacagttgttagctgatttaaaaggctgtactatttcaaatatcatcagcctagattctacgggctttttcgtaatatttaaaggattaaaaacatgaacaattgtacacctaatatcaagtcaagttatggttatgaagatttattagcttcaggacg

SEQ ID NO: 93935 - DNA, 567 bp, Oryza sativa
gagctcggtacccaatgcttttagttggctactttatttacggaaaagtggttgaacggatctttacgatcaatccccaaaaaatgacccctgctcatgcaatgagtgatggtgttgattatatgccaatgtcaaaaaccaaaatttggctgattcaattattaaatatcgcaggcaccggtcctattttcggaccaatcttaggtgcattatatggtcctgttgcaatgctttggattgttctaggttgtatcttcgcaggtgcagtacatgattatttctctggtatgttaagcgtccgtaacggcggtgcaacaatgcctgtattagccggcaaatacttaggccgtcctgtcaaagtcttcatcaatataatggcattacttttattattactcgttggtgttgtattcgttgctagccctgcgcaattaatggccactattacaatggatgtattaggtggtactagtggtgcattacagttaaatgatgctgaaacagttcaccaatcattacaaacaacaagtttaacggtttggggaatggataaagcgaccattattt

SEQ ID NO: 93936 - DNA, 559 bp, Oryza sativa
tttaggcttacatccactctatattgcacaacatcaatacaccgatttagatttactcgcgaaccactaagcaaagcaagacagacaatgctccgcgattgcagaaattggacttgataaaggcatagcaacaattgcgaccaccgcaatgtggtataaacaatgtgaattcttagaagcacagcttgcgctcgccaaacaagcaaacttagcggtaagtttacattcacgtaacacgcatgatcagctcgctgttttactcaaaaaaaatccattaactaaaacaggggtcattcatgcttttagcggtagctatcaacaagctaaacgctttattgaattaggctataaaataggggtcggtggcattatcacttatacgcgcgccaacaaaactcgcaacacgatcagtaaattaccattagacagtttagtcttagaaacagattcaccggatatgcccgtttttggctaccaagggcaagctaaccaacctgaacgaatcaaactgatttttgaggctctttgtcaaaaacgttaagaatccgctgaacaaatt

SEQ ID NO: 93937 - DNA, 707 bp, Oryza sativa
aataaatggtttataatataaacgcacgccccaagagttatcttccaatttttcacctaacgccgcatataaatctcgactaaagccccaatcaatcgcagcttcagtcattcccattttactgacattatagaaacgtttttccgcattcaaagttgcttcaaatttaccattatgatggacttcaatttcagcagtaccgccttgatagttagcaccgtcagtaatttttatccctttaaaggtaaaatcataatctttaatttgaacagtatcgccaaccttcatccgtacatttttttcaatactgaaattttgactaaacgtaatgccaaagactaacattgccacacctaaatgcgccaaaaccattccccaatgcgaacgagaaagcttaaatataccaacaagaaagctgtgtcgatgtgtagcacgttgatacaactcatacaggctcaacaacacgataataaccgccatcatgacaccaaggatcaaggtatcgttattcgatctataaaccaataaggcagtcaaacaccaagaatcaacatcagtacaaatgaaataatcaccggtagcctaatagctgaaacctgatctctacgccatttgactaaaggcccaatacctaaaaaaaatgcaaatggcaccattaaaatcaaaaacatctgatcaaaaaaacggcgcaccaattgaaatcgtgc

SEQ ID NO: 93938 - DNA, 852 bp, Oryza sativa
agcatatttgtagatcaagcggtcgatttaagcaattttttgcaaattcgaccgctttttattatgcgtttaaaaattatttttaagttatgcttgttttggttagaatggcaaatacgttacggaatagatgataagaggcgtacagatgaaacacgtttatatttttagtgccgggcctgcgatgatgcctaaagctgttttagcacaagcacaacaagaattattaaattggcaacagcaaggtacttccgtaatggaagtcagtcatcgaagtaatgcttttatggcgcttgccactcaaactgaacaagatcttcgacaattatatgctatacccgataattataaagttttgtttttacaaggtggtgctcacggacaatttgctgcaattccgatgaatttaattggcaagaaaggcaaagcgctttatttaattagtgggcattggtcaaaccgttctgcgcaagaagctcgtaatttttgtgaggtcgatcagcttaatatattaactcaagatgaagcgggtgttttttcggttaatcagacagattttagcgatattgctgagcaatatgattatgttcattattgtccaaatgaaacaatcagtggcgttgaaattccggatattccgattgtcggtaaagcggtattagtggctgatatgtcttctaatattctttcacgtaatattgatattagcaaatttggcttaatttatgcgggagctcaaaaaaatttaggtcctgcgggcatcactattgtgattattcggcaagatttaatcggtaatgcacagcgtgcaaccccgtctatttggaattatgccacgcaagtgaatgccga

SEQ ID NO: 93939 - DNA, 596 bp, Oryza sativa
cccgaatgccaacataatgcgcatttattttatttaaaattaacagattcagccgatcggaacgcgttattaacttggcttaaacaacacgatattttagcggtgtttcattatattccattgcattccagcccagcaggtaaacaatttgggcgctttgtcggtgaagatcaatttacaacacaagaaagtgagcgcttgctaaggttacccttgttttataatttgcatctaacagagcaacaacgtgtgattgaggttggacggattattttcagtaatgcagttgttaagtaaaatagcgatttggactacattagcgaccttattcaaattagtggttggcttgctcgtgctgaaacttttggggtggcagtttggtacagcaggcttaggacaagcagccaattttatgacgttgatcacagtcttgacggtctttgctggtggcggtatcgcgaatggtgtaactaaatatgtagcagagtttgaacatcatttaccaaaacagcaggctttgttggcaacggctaatttgattacggtattcttttcttgcctattagcggtctgttttattagtttttctcacaaaa

SEQ ID NO: 93940 - DNA, 599 bp, Oryza sativa
catcaacaattttcatttcattggttattcagtattatttatttcagtaccttttatctaggtttcccgtgctcaatgttattggcattgctgtttgatgtaacgctacctaactatgaaatgttattactcaccttattgactgcgttagtgagctacttactgtattacttcgtttataaacgagtaaatttgattcgacaagcggtacagaaaagacaggattttgctaaatcagaagctattttgaccgcttcactattgtgtatgattggactatttagcttaatcgcttttatctcaatgaatggcttgttaatttttaaattagaaaaatatagccaaatcttttctagtatcgtacaaggtatcccactaaaacgctttttttattttttcattgccggcttgttagtcttcttcttcctatatgaaaataaaaaaacttggttagcatttttattgattggcgcattttttggaggttttgcctatcttgcagtgggcggaacacgggctaaccttggtttagcgatcgtattattcttattattaggcctttataaaggctatttatcatataaatggttgctcttcat

SEQ ID NO: 93941 - DNA, 773 bp, Oryza sativa
gcgtcaaacattagtaccgccaattatcacgactcccctttatttcttgatttttggtcaattaattggcagtcgttttggcgaaatgaatggggtcagttatatacaattttttgcacctggcttagtgatgatgacagccattacagcgtcttatgtaaatacggcctcatccttttttctaagcaaatttacccataattttgaagaactattagtttcttctctttcaacccataacattatttggggttatgttgtcggcagtatcgtgcgtggtgggctttcaggtattttagtcacgctgatttcattgctattcgtttcttaccaaattcattcttggagcattattctgttaactttattaatgaccacaattgccttttcgttaggtggcttaattaatgcggtatatgctaaatcttttgatgatattggtagcattcctacatttgttttaacgccattaacgtatttaggcggtgtattttattcaattacattattaccagaattttggcaaacactctcaaaatttaatcctattgtttatatgattaatgcctttcgctatggttttttaggtattagtgatgtatccatcgcttatagtttctcggtattaatcatttttattctaatactatactattttgctttttcattaattgaaaagggcgtgggattacgcacctgattttcattgttataaattgtacgagagataatgctagaatcatatccatctctcgtataaaacattaaggaac

SEQ ID NO: 93942 - DNA, 664 bp, Oryza sativa
atccgcaacatccttatcatcaagtgtcaaaagcaacttatccctattttaatgcgatgaaaatgcccactttgttgaaagcggttgaaaaagtagatgactataccgtcaaatttaccttggctaaacaagacacgacttttatttcaattcttggtatggactttacctctatttattcagctgaatatgcagataaaatgttaaaagcaggcacgccggaaatgattgacacgacaccaatcggcacagggccctttgcgtttactagctatgtgttagatcaagcaagtcgctacgtggctcataaagattattggcaaggaaaagctgatttcgaccgcttgatctttgaagttgtaccggatgcgacaacacgctatgccaaattaaaagcaggacaatgtgatttaattgattatccgaacatcacagatattgaaaaaataaaaaccgatccagccgtgcaattactgtcgcaagcgggtttaaatattgcctatgttgcatttaatactgaaaaagcgccttttaaccatattaaagtacgccaagcgctcaatcttgctgtagataaaaaagcgatcattgatattgtttatcaagggggggggattgccgcgaaaaaacctttaccggctactatttggggctacaatgatag

SEQ ID NO: 93943 - DNA, 673 bp, Oryza sativa
cgaattattaagaatgttaatgtaaacgcaacgtcaccattatggttacaagaaaaattacgtcgttgtggtattctctccattgatccaattgtcgatattacaaatttaagtttacttgaattaggccagccaatgcatgcttttgatgccgagaaggtaaaggcccctattcaagtccgcctagcaaaagatcaagagcagttagttttattagatggtaccacggcgaagttacaaacgaatacattagtcattgctgatcaaaaaaatgtccttgcacttgctgggattatgggcggagaagcaagcaaagtaaatgctgaaacaaaagatatcattttagaagcggcattttttgcaccattagcgctcaccggccgtacacgtcaatatggcttacatacagacgcctcgcatcgttttgaacgtggtgtagacccaacgcttgctcgtcaagcaatggagcgcgcaactacattgatcatagagatttgtggcggtgaagtcgctgaagtatgtgaagcgataaatactgaatatttaccaaaacagccgatcattcgcttacgtcgtaccaaattagattcagtgataggccattatattgaagatcggctagtgacggatattttagttcgcttagggctaaatgtgacatgcgaaaatgatg

SEQ ID NO: 93944 - DNA, 917 bp, Oryza sativa
ctttagtttcacgtattaaatcaagtttcattcggatatttgtttttaagcttttgcgctctgcgagaataggcatattttctaccacttggtataagctatacattgcggaatagcgactaaatcctaaacccaatacttcacacaagggttttaaacgtaatactccttctgaaaaatcacattgtgccgataacatagctcgactaatcacgtcaatgctttccacaatgcttgctatccgtgcttgtttagcttgcatcgtttgttgcaataatcgttgcttagcggtttgttgttgacgtaatttaaccaataaatagaaagcgtaccctgccatagtaaatacgatcaggacagctaatatgataagcacaaactgaaacataaacgcttccgactaattatttaaatttattaatgtctatcgtttcaaattgacgtagtaaaagatcctcgttattttcttcatcatcttcaatacctaattcaattattagttcatgtacacgatctaaacattcatcaacaaactgttgatcttgggttgatagtactttacctgcttctaactgatccaataattgatttaaacattcattattttctaattgcgttaattcaacttccggtgaaaccgttgcttttgtggcgtgatttgatggttcaagcggtacgggtttaatcatttgtcctttttctggtttattgacaaattcgaccattaatggcacttttttgcggctgccaacacgtggatcctttttaacttttgctgacgctgtcttttgctctgttattacattacgagagccggttggtaatcctttatgcttacgctttttcttctcttcacgtgcttgtacatctaattcatagcgtgttggtttccgcttcttaccgttgcttattggcaa

SEQ ID NO: 93945 - DNA, 572 bp, Oryza sativa
cgactctagaggatccccatttgcaagcgggaatgtcgctcagcatttttttattcgataatttgatcgcacaagtggatttatcaagtaaagagggcaaatccaagttggcggcgcttgcagaaccgttaatcaatcgcattccaggcgaaatgttacgcgtttatttacgtaatatgttaggtcaaaaactaggcattttagatcctgcacaattagaagctattttgcctgctaaagtacccgcaaaccgtaaatcaatcgcacaagcgttgccgattaagcggacacccatgcgattattgatagcattattgttgcagaacccagaattagtccagtttgtacccgatatttcagcgctacagagcttacaagaacccggtttccaattgctagtggaattgatcgaagtgtgccgcgaaaaagtcggtatttcaatgggagtgttattagaacattggcgagataagccacattaccgtacattagaacggttggctaattgggatcacctagtgacgcctgaaaatgtggaaagtacttttattgaaacgcttgattttttgtac

SEQ ID NO: 93946 - DNA, 602 bp, Oryza sativa
attttttatttaattcagcttcaattgtttgaccatctgcagcaattttgtctaattgagcttgtaattcactaaatgccttttgtgcttcaggtgttggatttttagctaattcactattttgtttgatcattttagcaccaagtgtcattgcttgaagagatttatcttttaatgcttttacttgttcatctttaatctctaaagatttagcattttgttggattttctcaatttgatcaagaattgcattatttacagtgtcttgaacaatagtttcatctttagctttttcttcaccaagtttctcaagttcgttattaattgcttcaccaattaatttttcttggttttgttgccattcttggaattttttgtagtcttcagcgccggtatccattttagcttcaacttttttatccgcttcaggttgtgttgccgccgttgcagcaggttttgtttctacagggttgtttgcaggcttatcacaagcagttaaaaataatgcaaataatgcagctgcgctaattttagtaaatttagtcatttgaaagtcctatgtcagaaattgatagtatttactctaagtggttaactttatc

SEQ ID NO: 93947 - DNA, 534 bp, Oryza sativa
  unsure (1)..(534): unsure at all n locations
ttattttttgataatcagtataagcatcggttggtatatgctcaaacacgcctagttgttgtaacattttttcacctggcggtattaattgcactgacgcgattggcgtagtatttttgggtttttggtgcggatttttcaatgattttaatttggcaagggctatcttttaataagccagcaagcgccaaaccaaccattccaccaccaataataataagatcagcagatttcataagcgttatttttacatataaagcggtaagaaaatgtgtattagttaagtttttttatgatatttttcaaggctacggtggcggattttgacatttttgccacggctttgaaagtatttagctaattgttcagtgataaagacggagcaatgtttccacccgtacaccgatgcgatggttaagtagcttcggttatttttttctaacattggcagccaagtttctaaataattgcgtgttnnnnnnnnnnnnnnnnnnnnnnnnnnnnnnnnttcaagaaagtcaatgaccggttgtt

SEQ ID NO: 93948 - DNA, 659 bp, Oryza sativa
cccataactaaaatattaagcgggtaaggttcagctgtggcacgtgctttaaaacgttgggccggatctaataattcagataagtcttttctaacggggttaccaacggtttctgctttagcaaaagctgttgggaatgcttgtaagacacgttttgcaattttggctagccatacatttgttaagcccgcgattgcattctgttcgtgtaaaacgatgggcacattgcatagccttgctgcaattccacctggtccggaaacatagcctcccatacctaatacagcatcagggcggtatttttttataatgttaagtgcttgtaataccgcttttagaatagtaaaaggggctttgattaatgctagaacacctttgcccttgagccctgaaatttggataaattcaatggggatattgtattggggtacaagctctgcttccattcgatctttggtacctaaccaacagatttgccagccttgtttttgtagttcttgtgcaacggcgattgcagggaatacatggcctccagtaccgcctgccataattaaaagttttttgctcatttatgatctcatgttatggctaaggatcaaagagttctttttacaagatccatactttgattttcaatcgaaaatttgcttattctacag

SEQ ID NO: 93949 - DNA, 631 bp, Oryza sativa
caattcctttcttactgatgccttatctatcgcgtaaattaggcgtagaagggtatggtgagttatcctattaccaaacatatttagtgttattcttaattttggttagtcttagccaagatggtgcgttcgcgcgctatttttatttttacggtaagcggtcattaaatgtaattgtacatacaggctatttttatactttaatcgttggtggcattattttggctgtttgttggttgttacaagcggaaattattgcttatttggcggtttcagctatttttcaatcttttcttgcagtgcaattgagtgtccggcaatgtcagaaacaggcgttgcaatatatgattattcaatcattaactagctttacttctatttttttgaccgttgtgatgttggagttttatcaaacggatttggtcgaaaagcgtattttggctattttgtttggtaatttaatggttttctgtttggtttatttcttttatgtgggcaaagtaacgagtaataaacattattcattgcggcaatatcaattaagtttggtctatattttaacgtttggtttgccgttattattaaatcaagcaggcttttatttaaaaggacaattagaccgtatttttat

SEQ ID NO: 93950 - DNA, 634 bp, Oryza sativa
ggtatatggaaatatcattaatagaaggcaggaatatcctgccttttctatttgctaaattatcaatgtatttttaaatttatttaggccttatttatgcttacgataatttctccagctaaaacattagattttgctacaaccagtccctcttttgcttattctcaaccagtattgaccgcttacagcgaacaattgattaatttatgtaaacagcttactccggcagcgttaagttcattaatgtcgattagcgataaattagctagccttaatgttgcacgttttatagaatggcaattagtacacgatcaacaaaattcaaagcccgctttatttgcatttaaaggcgatgtttataccggtttagatgcacaaacattaacagaagcacaagttgaatatgctcaaaaccatttacgtattttatccggcctttatggattattgagaccattagacttaatgcaaccttatcggttagaaatgggcactaaattagctaatcataaaggtaaagatctttatgcattttgggataatatcattactacgaactacaaatggcaattgattgataggcaagcggataatattttgattaatcttgcatcggatgaatattttaaagcct

SEQ ID NO: 93951 - DNA, 687 bp, Oryza sativa
gcaattggcattgcactttatattagcattaatgccttcaaaatgttttgggaagccgtacaagtattactggataaagctttaccagaagaagatattaatcaaattttaaccattgttgctaaccagccacaaattatcggtattcatgatttattaacgcgtcaggctggtgctgtacgctttattcaactgcatcttgaattagaagatcacctttctttactagaggctcacacgattactgacaatttagaacaaaaaattcttgcagcttttccgctttctgaagtaattattcatcaagaaccgacatcaattgttcaacaggagcttgttttaggacaagtaaaaaactatgtaccaagttatcgctaatttttcatttcaaaattttgaacatgaccctgttatattgataaatcaaatcatcaatcaatggcgttataatgggcaaattattgggcgtgaattctcggtgacctaccatacacagcctagcgcacattttcaagttcgccttgccacaccagaacaaataagcttaatgccagaatggaataacgatcaagtgacggaagccttatcgcaagcggcagaaaaaggcgtagaatttgaatcttttgaaattattggtcgagattatcaagcagaacaaacatctgagaatagcaacgcacgttttta

SEQ ID NO: 93952 - DNA, 556 bp, Oryza sativa
tagccagcttagcattttttctttatttaagtagaatccgctatgcttgattttacaacctacctaccacgatccaagcggtttaatttacactttttttgttcattaaaccgcttgtcgtaaaacacgcccagtctgcgccttaaagcaattgatccgcaacaatccgtccctgttcaatatgaataacacgatcgaataatgcctcactttctgaaaattgatgggtcaccattaatagcgttaattgacgctgacggcaaatctctaacaccaactgttgcaattcattacgccgaataggatccaacgcagaaaaaggttcatctaataacagaattagcttatcttgtaacaaagtacgggccaacgcaacccgttgtttttgccctcccgataattgatccgctcgccgtaataacaattcagcaatccccatttgaccagcaatcttttttaccgcctgttgcttgtgtggcgttaaatgcaagcgaggcaccaacgctaaaccaatattttgctcaacagtcaaatgaggaaaaacattattttcttg

SEQ ID NO: 93953 - DNA, 562 bp, Oryza sativa
tacaattagctaaagcattggctattttaattaataatggctttgtaaatacaccgcatttaatgctagaaattattgatagcgataaaacagaagcctataaagatcctgtgctttatgatgatattagaggcgtaccaaaacacttttggcaagttgcaaaactaggtatgtataatgtgattaattcaccaaatggtacaggtaaaaaagcgggcggttctttttatcaagccgcgggtaaaagtggtacagctcaagtatttaaccttaatggtgcaaaatataataaagatacattgaaaaaagagttacatgaccatgcttggtttattagttatgctccttatgaagatcctaaagtagcggtcgcgattatcttagaaaatgcaggtggcggtggtgctaatgcggcaccggttgctcgaaaaataatggattttgccttaacgcatacttttaaacaacattcagacaatgtagaacaacccgttcaaaccatagaaaaaaacacaaccgcttgagcgaaaaaaggataaagtgagtaatgaatagagctgta

SEQ ID NO: 93954 - DNA, 555 bp, Oryza sativa
aaattaatccagaagttgcggcagcagacgcgattaaaccatcattgcctgatactcaagaggttgcaacgagcaatgacgaattgcgtattgaaattacaggcaaagaaagttggatcgccgttaaggttccgaacagtaaaaaaagcctagtagagaaactgtatgcaaatggtgaagtattaacgttcaatggcaacgaacaatatcgcctcactatcggcgcgccagcaaatgtaaaaatttattataaaggcgagcccgtactccttaaaattgatgggcgagtcgcgcgaattaaattacctctagtacaacagtaacgagaaaatgttaaaagaagttcctattaaacgtcgtcaatcgacaaaaatttatgttggtaatgtgcctgtgggaggcgatgcaccaattgcagtccaatctatgacgaatactcgtactacagatattgaagcgaccattgctcaaattaaagcgcttgagcgagtgggcgccgatattgtacgggtatctgtaccaacaatggatgcagcagaagcgtttaaagtgatc

SEQ ID NO: 93955 - DNA, 541 bp, Oryza sativa
caccacaattaaatgcgcaaacttatgtgttaatggactataactctggtgcggtattagcaagtttaaatcctcaacaacgtcaacatcctgcatcattaactaaaatgatgacgagttatgttgtcggtgatgcgattaaacaaggtaaagtaaaaaacagtgatatggtcacagtaagtgaaaatgcttgggctcgaaaatttccgggttcatcattaatgtttttagacttaaatacccaagtgtctgtagccgatttaatgcgaggcttaattattgtttcaggtaatgacgctgcggttgcattagcggaacatacttcaggttcgcaacaagcgtttattgatcaaatgaataaatttggtcaacagtttggtttgaaaaatacgcattttacaacggtacatggtctagatgaagagagtcaatattcatccgctttagatatggctattattggtgctcatgttattcgtgatcagccagaagaatataaaatctactctgaaaaagaatttaaatataatattaaaaaacc

SEQ ID NO: 93956 - DNA, 684 bp, Oryza sativa
cgttattattagcagtaataataatcccccaaacccgaatacaaggtaatagagaagtatcattgagcatgctccctaaaaatattttgtaattcaccggtgaggttaaatacttgcgcattttgatacaccgctgaacgcgttaataaaccgtgattaacaaatttaccgataattttattattttcatcacgatgttggcttgcttcaaatgagaagatgtcttgtaaaacaatctgtccattttccatacccattacttcagtaatattcattactttacgtgaaccgtcatttaaacgagatgcttggataatgatatttaccgcagaagcaatattacgacgaatcgcttctaatggtagagaagcgtttgacatcatcaccatactttctaaacgtgcggttgcatcgcgtggtgtattggcgtgcagggtagacattgaaccatcgtgaccggtgttcattgcttgtaacatttggaatgcttatgcaccacgacactcaccgacgatgatacgttcgggacgcatacgcaaggcattgattactaagtcttgcatggtgatttcacctgtacgttctacaccggctaaacgcgtttctaagcgtacaacaagcggttgttctaagcgtaactcagcggtatcttctaaagttaacacacgctcagttggtgagata

SEQ ID NO: 93957 - DNA, 949 bp, Oryza sativa
  unsure (1)..(949): unsure at all n locations
tggctaaggtgatctttcgttaactttttattattttaaacaggaaatcattatgaataatcttgatccattagcattgccattaaatggtaccttannnnnnnnnnnnnnnnnnnnnnnnnnnnnnnngttcacaatggcaaatttatatttacgtttattggtgggccttggttgtcagccgttaacggtagaaaaaaatttagtgggtacttttaccaaagcggcaaccgaagaattgcgtgatcgtattcgtcgtaatattaaagcctgtcgaagaattttttgggattatgaacctaaccaaattgatcaaaataaatataatttctatagtcaactttatgaaagggttgataatttagatgaagcaaaattacggttacgtattgcagaacgagaaattgatttagccagtattttcactattcatagtttctgccaaaaaatattatcgcagtttgcgtttgattctggcattcgatttgataatgattggcagacagatgaaagccatttattacagcagttaagtgaagagatatggcgagagcaattttacccgctgagtttgcaagaatgcgagatcatttataacgaattagaagaaccattaaaagcacttaaaatggttcaatcatttattgggattgaattgccggcgttatctgccgaacaaaaaagaatatttacgccagagctatctactcgttatctaattgaatataagaattttttacagcaaatcaaacagtattggcaaataaatggtaacgaaattgttactattattaatgcggaattaaaaaaaatatataaaacaggggagaaaaaagccttaaatcgtacctcttatcaaccccgttatcttgcaacatatcaatcagagcttgataattgggctaattcaatggatcttactttaccaaaaaatttcgagcgcttttgt

SEQ ID NO: 93958 - DNA, 576 bp, Oryza sativa
aaagcctagtggatctcgatctaaatcataaacaaaattaagcgatctactttgttgcacagtgccttaacaaaaagtttgctggccaataataattgcacgattataatcttgcattgccgccgcaaaaatttcagatgctgaggcgctatggcggtttatcattaccatcaattttccgtcatataatggcttatttgttgttactactgacttatctacttgtatttgaggctcatcttcgtacactttgatacgattaaaagcatctcttacctgtacaacaggactgcttttaataaataacctagttaattcaaccacttcagttaaagaaccaccaccgttatcacgtaaatcgacaattaatccttctattttcttagtcttaatttttgctaataatttgtgcatatcattagctaaaccgatataaaaagcaggaattttaatcactgcaatatttttacccgctactttatcaattgttaatttagcggcactgtcttctaaccgaacggtatcgcgtgttaacgtaatgattttagttttatgcgcttttgctggctcaatctc

SEQ ID NO: 93959 - DNA, 618 bp, Oryza sativa
tattgattttaattttatcaccagcaatgagtatggtcttattgtgaaattaggtgagcaattaaatgatttattagctgattcagcttatgttgtgcgaggtgagcgtcgtcaagcggtatcaacttttgcagaagcattagattggttagtgaaagaatctcggaaaggtttaaccattcaacgttataaaggattaggtgaaatgaatccagaacagttatgggaaacaactatggatcccgttgcccgtaaaatgttgcaagtaaatattagtgatgcgattgcagcggataaattgtttagtacgctaatgggcgatgaagttgaaccacgccgtgatttcattgaaagcaatgcattatatgctaatttagatatttagtttttgctactaacaaaaagccctaaataaagggctttttttgttggtaagaatggttaatttttcaataaattaaaccgcttattgtgcttgtttcgccttacgggctttataccatttaatgcacacataaatggcaagtaatcctaaaccagcaaaaataatgtgttgtccatttttaacttgttcatgtaaccaattgatattttgtgcaccataatcgcctaaatata

SEQ ID NO: 93960 - DNA, 534 bp, Oryza sativa
cttttaagcccgctaattgttcagccgatttaaactcaacctgcccttgcccgtgtgatacggctattggcatatgtgagcctgccatgccattaaaccaagccgagtgagtgtcattgattttgactaatcctacacgggcttcaaagcgttcagatttattacggacgaaacgtggccaattttctgtgcccgggataatttcagctagattagacaccatctggcatccattacatacccctaaggcaagagtatttggattagcgaagaattggctaaattgttctcgtaacattggattgaataaaatagattttgcctaaccaccaccagcgcctagtacatcaccatatgagaatccaccgcatgccactaaagcattgaaattggctagatgatggcgtcctggcattaaatctgacatatgtacgtcaatcgcattaaagccggctcgatcaaacgcagcgggcattttataatgactatttacgccctgttcgcgtaaaatcgcgaatgttggtttgaccccgg

SEQ ID NO: 93961 - DNA, 553 bp, Oryza sativa
  unsure (1)..(553): unsure at all n locations
ttcaaccatgggtcgagaattatcgactccaataatgcgaaaattttttgttggcgcatttcgcctaatagctaaaatgctagcgcctcttgaacagcctaaatcatagacattcgatccttcagtcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaaaatcacctaacttttcgatgggggttgaaaaaatcgtatctctattcattatagtctttgatccttgtttaaaaatttagtaatagctcgtactacagcatcaggtttttctacatgcacccaatgatttgcatttgctacaataaatgatatagcctgaggaaattgggctaggattgttgctgtatctttagcttgaatataatgtgaatcagcacctttaataaataaggttggtttatcaaagaaaaccgcttgccaatccattaaatatggatattgtgcttttaacgcgcttaaattaaaacgaaaacgtt

SEQ ID NO: 93962 - DNA, 750 bp, Oryza sativa
aattcacggccgaactcccacgtgaggtggtattaaatacgttcgctaatttactgactaatattgacttaccgctactttccccgccgacaatagcaattgttttaacaaagaatggccgaacttccttggggataaagcgccaatatttaaatggattattgcgaatttgcgttgctgagatattaaaagatgtacgctcaggatccatcaaacagacttctagattcaaatattgctcataagatgttttatcttgtttttcactggtaaacactattttgggctgaatatttttctcagcaaataattctttaacgcgctcactccaatcaatccaaccatttggatagctaggaataccgtcttcttttaaatgatgaataacaatttgcttttgttgatatttaaaaatttgttgtaaccaacggaggcgatcttcgttagtcggcatacgtttcattttactatttttaaagagttcaagatcacgttcagtatccgtgcacacgaccacatgtaatatatccactttactaaacgcttcataaatcatattaatatgaccggtatgtaccgggtaaaacttgccaaagataaccccaacccgctggttcatatcttcaacgagatttaatacctgatgtaatgcatttaatttattagcgcttggatttttaatttttccactaaccaattgattaaaataggctctagtcaagcccgcttgtccacaaatatcattaactt

SEQ ID NO: 93963 - DNA, 669 bp, Oryza sativa
ttctttgatttgttatcaaaatgccgaacaagtgttaggtaaaaaagcggcaattttaggggcgatggctacggctgattattatgctaagcatcaacagttatccgataaagcaaaacaatggatcgatcaagcgttagctttagatgctaaagaaaataatagtttactgttattagctacaaatgctaatgctaataaacaatatcagcaagcaataaattattggcgacaagttttagacagccaaaacccggcagttgatcggcgagcagttattcaaaatattcaaatggcattacaacaattgtgatcaacaaaaagtaagttgatctttacaatttacattttaaagattgctaaaaataaggattgaaatataataaaatgataccattttgctaaatttgatcgagttttacatagaatgttaagtaaggagaacttatgagcgtaacgaatcgccaagaagtgttacaaaaccgtttagggccagaaattcaagagttaaagcaagatattcaaacacttgtgctttcgactgtcgatagcgaaggtaatcctaatgttagctatgcgcctttcgtaattaatagtggcgaataccaagtattaatttcaacgattgcacgtcatgcacgtaatttaattgaagtgccaaaagtatcg

SEQ ID NO: 93964 - DNA, 981 bp, Oryza sativa
acccgccagatattgttcgtacaggtaaggtttaaaatcgcctcgatgtgcacgttggatcatactcatcaaataaccctgcggttttttcacttctcccttgccaatacgctgttccacttcaaatagcaaggctttgcatatccccaagtccagacctttcatcgtttgagccacagcttgttgttccaagacggagagatttaatgtggttggccattcaatttccatacggttacccgtacagtacttatttatacaaatactcgtacttgtactgtactgagtcgctgagttccgtatgggaacgctgtgattttttactgagttccatttgggaactctgtatatttttactaagttcccgctctttttgactgagttccgtatgggaacttagtatgttttgaggaagttgacgcagttgatgttgttgttctaaaggtatctcatcttcttgttgtatgcgttgttgatacgcattaaagcgtgcttgtatccaatcaatatgggaaacataatgccattgggtcgggtcggcatgtaaattatcaataatatgattggcaacattgcgtacggtgatgtcacggtgattcgccgcattttcaagcagcttgaggtaattgttatttaattggatcgtatcaacaataggcatcggttcgtcatgtaataaataaacattccccatcacttgtccttgttcgttgcgtacggtttcacaaagcgtcagccagcgggttaactgtaataataagagtgtttggctcacaagcttacgagagagtttaccctcggcatacgttttatccgaaagtaactgtcccagtatgtcataagacgggaaaagtacggttttaaattctcgggctttatacttgataagctgccaagctaatttggcccgtgatgttaaatacggatcgaacaacaatcgagtcggtaccgtctcgtgctgattgcaaagaaaagcaaacc

SEQ ID NO: 93965 - DNA, 2090 bp, Oryza sativa
  unsure (1)..(2090): unsure at all n locations
ttctctatctcttgcaattcctgtttggaaaaaccgatactaccgcaaaaattgatgtttccttcttggagattggatgaggatttcattaaggacaacttgatttaagctactaaacattgtatgaatggcttcttggcaatataacgaactaaaccaaataaggggaacagcttgactagggtcacatcgtcaatcttctccgcatctaataagaaactaaaggttatcgaaaccgacggatagcttgtctatctaccgtttgtaacagcatgagcaagtcatagcacattttcaccatttcgttttccactgcattttctaaaggcagcatacgataggcataatccacccggtgtgtttaccacatgctcaacataacgttccaatccgacggattccgcaatatctaatgccaaagaataagcttccagtttatgtttgcgggcggggtaaatttgccagatatcatctaccggttgacgaccgacccaagcaaaagtcaacccgtagcctctgcacgctgttggcgttgctgttggatattgacgcccggtgcgataccctactgggtttccacactctgtgaaaagtcatgtaaggcgtctgtgggcatattgtaagattctgtcgactcgtcctcagtcggggtgctcgccggtgccacgggcgggtagcatattaatcaatgtcgaatagtcttcctcatcggaggggtaaatccggcgtatatgttgtcggactcaccgtagaggaaacggcacctttagcatggttatctgtaggcgtctttatactctcggtgtgcatgattggtttatgttgggggttatcatgctcactacactatgtaacggatggtgaaagtcggcaatatcttgcaaactttgatctaccgaggcgttaatctcttgttgtttttgcgctagctttttgaagcgttgttcgtctaaatcgatttcatgataaagtaactcataggaggtgttgtcacccaatacatcaaccatctcattaatgaggttgtcctgaaaatctttaatattaaacggattatcttcgttacaacgtgaaagactatgttgccagatgtcgtcaaactgaatttcagtgtcaaatcgatagttgtgccaaacggtcagcgcattgatacaaatggctagtagcttatcaataggggcatgccctaatccgttaataaaacgttttgaatatagggataaagaaatgaaatacatttctccattttatcaactaatgtatgagatataatatagcccatctttttcaagctcggaagacagttctccacaggaaagcgctttgtttaactttttctcgtaatatgctttcgcttgctgaatccccaatgctttctcgataaaggagaggtcggcgcgggtatcgttctcaataagatgaccgatcaataaatccaactcggcttgtacgctgtccgccgattctcctttccaaggtttgaattgacattcaatcgaccaaaaacgttgatcttgggtttcgggttttccgtgggttgtgctcataagggcgtaatttatctaatgtcaccgtaatatattgagattctgtcggatagtgagtcatacctgcggcaatatatgacggtgtcgtattggtgattggttgcacatttaagcctttggcgattgcctccaatctggcttgattctttttatctttggctgaaaaagtagcattactcataacggctatccttattatccatgttctcaaataatgagtattgacctaaaaactttgcggtaaccgtcgctaacggannnnnnnnnnnnnnnnnnnnnnnnnnnnnaacacaaccgcgttgttcggactgtgggttataaacttcatcgcggtagaggtgataaatcacatcggcgtcttgttctaacgaaccggaatctcgtaaatcggaattgaccggacgtttattggcacgttgctcgaggctacgattaagttgtgataaggcataaaccggacaaccggtttctttcgccaactttttcaactcagaggagatttctgccagttctaaattacggttttcaaacttgccggtgctg

SEQ ID NO: 93966 - DNA, 560 bp, Oryza sativa
atggttaaaatggctgaacaacgtatgaatacagaatctctgccagcaataccatttcctaacgcattaattattgaaaaagtattagcgcacacactgcaacaagcgcaagatatattaattgtcgttccaagccacgctttcgccgatatcctacaccaaataaaaccgctcttaacgacacaacatcggattatgtgggcaacgaaaggactagaacataatacaggccgactattacaaactgttgcaacagaaataataggagagcaacatccatttgcagtcttatctggccctacatttgccaaagaattagccttaggcttaccgactgccattacattagcctcacacgatgcaaaattcgcagatgaaatgcaacaacgaatccattgctcaaaagcatttagagtttacctaaatactgatatgattggcgtccaactaggtggcgcgatcaaaaatgttatcgcgattggtgcaggcatttcagatggaatggggtttggcgccaatgcacgaacagcacttattactagagggctcgccgaaatcag

SEQ ID NO: 93967 - DNA, 652 bp, Oryza sativa
ttacaacgttaggtgctcactttgttaaacagcttcacgacagaaaatttgatgtttttcttgatttaaaatatcacgatattccaaatactgtggcaagggctgtgcgttcagccgctgatttaggggtatggatggttgatttacatgcgtcaggtggattaacaatgatggaggaagcaaaaaaaattcttgagccttatggtaaggatgcgcctttattaattgcggtgacggtattaacaagtatggaagatttagatttgttacaaattggtattaatgcttctccgatggaacaggtgattcggttatcccaccttgcaaaacgtgcgggactagatggtgtagtctgttctccacaagaggtagaagtgttaagaacgcattgtggtgatgattttaaacttgtgacaccgggtattcgtccagccggttcagattttggtgatcaacgtcgtgtaatgacacccaaacaggctattcaaacgggggctgattttttagttattggtcgtcctattactcaagcacaagaacctttatccattttaaaagccattaatgcttcaattgcataattatgtatcataatgagggtgagctttgctcaccttttttattgtaagcggtcaatttttgagatttttat

SEQ ID NO: 93968 - DNA, 548 bp, Oryza sativa
tgttgctaaaagcattacctgaattacatttacgcttagatgctaatcgtagttggagcctagaaaaggcattaaaatttgcggaaaaaattgcagatcaacataaagcacagattcagtttattgaagaaccttgccagactccagaattatcacggcaatttgcacaacagagtggtattgcaattgcttgggacgaaaccgttcgtgaggcagattttgtggtaaagaaagagccaaatttagccgctattgtaattaaaccaactttagttggttcgttacaaaaatgtattgggttaattgaacaagcgcatcaacaaggtttgatcgcggttataagttcaagtctagaatcaagcttgggtttaacgcaattagctcgttttgcgcagcaatatacaccttgcactatgccaggtttggataccttgaatttaatgaagacgcaaatattgcgtcaatggcccaattcaaatttacctattgcggatttaaatagcccgtttattattgagcttgtgtcataatttggtgatgttaagcgg

SEQ ID NO: 93969 - DNA, 764 bp, Oryza sativa
tttgcattccaattgccacctcttcttgtaaatacggcatttctggagaatcggaattaaagactaatacatttggcactagtttttgtaaacgttgataagcctgcttaatttctgcttcttctgtattcggtgatttaccatcaagcaataaagcaatatgaaacacttctcgtgcatcattcattaataataatttgcctttatattcatcacgccataaatcttcccagcttgaaactgtgtgaggatctatttctttggcattgacgccaatcccagtcaattcatagacataaggcaatgaataagtattgtcaggatcaaatggtttacccattaattcaggggtaatattttttaaattgcttaattttgttttatcaatggcggttagcataccttcttttgccattttattaacataatagctggaagggaaaacaatatcgtaaccggttgaatttgataatttcaatttagagtacatttcttcattgctttcaaaagtagaataaatgacctcaatacctgtttctttggtaaattgctctagcaaagaagaggggacatattccgtccaattatagacatatagtttttcagcagcttgtgccgcaatactaaagtaagcgagagcgattgccgttaattttgcaaaaaatgtatagcctaatttgatcaattttatgaaatccttattgaatgcgtgatggttaatgattcaactgaatcaggtaacaaaagtccggcattatatagat

SEQ ID NO: 93970 - DNA, 704 bp, Oryza sativa
cgtgataatcgtaaaattcaccatcaggaatgatttgcaccgcaggtaaaacttcgccatctaaaacagggactgaatattcagcaccggtcaaaaattcctctactaatacgatagtatcaaattccagtgctgcggtaatcgcgggcagtaattcttcttttgttttgactttgaaaacgccgacacttgaaccttcacttgatggtttgacaaaaacaggtaaacttaattttgcaataatttgattaatatcgattgcttgtcctcgttgcactactaccatatctgctgtgggtaaaccgacagcattccataataatttggtacggaatttatctaatgtgatagctgaagccattacaccacaaccagtgtatggaatccccatttgttctaaagcaccttgcaatacaccattttcacctattccgccatgtagaatgttgaagactcgctgaatgcctttttcttttaatttctcaatagcgatatcttttgtatcaataccttctacattgtaacctaggctttttaatgcttctgtgactgctgcacctgagtgtagagacacttcacgttcttgtgaagtaccgccatataacaccgcaattttttcggtcttaatattcatgtatgatgagttcctttgattatgcttgccaatcttcagccaatttgcgggtaagtttactgatgttacc

SEQ ID NO: 93971 - DNA, 561 bp, Oryza sativa
tggctattttttcatcttctagtggataagtattataaataaccgcttccatttcaattttatgttgctgacaaactattaaacttaataaagtatgattaatcgagcccaacttagcggaagtcactaaaatcaacggtaattgttgttcaacgatataatctaatgttgtttgctgtgaattataaggaaccgccaaaccacctgccccttctaataatacatagtcatatttttgcgctaataacgcactggcttgtgcaatttttgatggaagtattggattattttccatttcagccgccaaatgtggcgaacaagggtaacggaataaatatggacaagttatgccatttaaatcttctgccgttagttcaatcccttgtagctgacggtgtttaataatatctgccgagatgtgttgacaaccggtttgaatcattttttgcgtaataacggaaaagccttgttgcatcaatcttttggcataaaaacctgtcgcaatagtcttaccaatatcagtatcaatacctgaaacaaaaattattttacccatttttc

SEQ ID NO: 93972 - DNA, 625 bp, Oryza sativa
cgattttttgttcactgagcatagtcaattttttaatttgtgtttgtgccattttagcaattttatttgccatctgtttattcactggcttcaactgtttttctaaactggtaaaagccacttgtgacgccatatcattgcctttgctatcaagcaataccctaaccggggtgggcggtaaaaaacgagtcagatttaaactttttggtgcttgtgcttctactacataaattgcttcaagcaatacggtgccggctggtaaatttttattaattaataatgaaatagcgcacttgccaatatcacctgaagtaattaaatcaataccatggcgaatcattggatgatcccaggttaacagttctatctcttctcgcattaatgctagttggcgatcaaatgtaatcgttgttccttcttcagataagcctggaaaatcagacactagcatatgccctgttggattcaatgcgatcaatttttcgcctaaatttcttgttctaaaccgatgatatcaaacaaatttaaagcaaaatttaccaagtgtggattattatcctcttgagcaatagcttcagccaatgcttgtgctgttcaccaccatttgaattcaattctaataagc

SEQ ID NO: 93973 - DNA, 870 bp, Oryza sativa
gatcatattcaaattccaccaaccaatattcatagtattcgaggtgagcaacctcctgaaactgaactggcaagatttactcaagaattaaatgaatgcctgcctaatttaacttttgattggatcatcttaggtatgggaaatgatggccataccgcttcgctattcccctatcaaacagattttgctgatcagcatcttgcaattatcgcaaaacaccccgtaaccggacaattacgtatttcaaaaacagccaagctaattgaacaagcagcgcgtattacttatttagttactggtcaatccaaagccactatattgaaagagatccacgacttaccggcaacacaattagcttatcctgcggcgcatatccgcgcaaaaaacgggataaccgagtggtacttagatcaacaagcggctgaattattccgttaatttgcatttaaataaacctagtatgaaagatgaaaaattgcgcaaaaacttaaggcataccattgatattagcccaatgagcaaatatcaatgggcaattgtactaatggccactattatgaatttcttagatggttttgatgtattggcaattgctttcactgccagtgcgatttcacaagattttgcattaaccaaaactgagtttggggtgcttgtcagtgttgggctgatgggaatgacaatgggttcattagtgttaacccctttggcagacaaaataggttgtcgcttgatgctattaattgctgtaacattttcagcgatcggaatggcgatttctgccatttcacagagttatgaaatgcttggtttttcacgagttattactggcttaggtgtgggggggattttagtcggcactaatgtgat

SEQ ID NO: 93974 - DNA, 607 bp, Oryza sativa
atttagtgtactatctgctattgctattattcttttcacatattatgcaaatcatttatcaatcgcaatgatcatcggtatcattgttggcgtattcgtcaatggctgtgttagtggtttatatgctatcacgcccatgacttatgctgctaatattcgtagcacaggagtaggctgcgcaataagcgctggacgtattggctccattttagcaccaactattgccggtattttattagatggcggtttagcaaaacaagatttatatctttgcgttgcggcgattatgttagttgccacttttattctagtatttaaaaaaccacatatcgatgcagtggcttaattgatcggaaccaccgcattctgcataatatgcgaatgccaaataagcgatgaaatttgcgcaaaataatacaaattaaaccgcttaaagctattaaccaacaggagaaaacaatgtcaatcaaaggtgatatcggcgttattggcttagccgtaatgggacaaaacttaattttaaatatgaatgacaacggcttcaaagttgtcgcatataatcgtacctgcatcaaaagtagatgaatttttagcgggcgaagcaaaa

SEQ ID NO: 93975 - DNA, 1237 bp, Oryza sativa
aagccccgaaagacgaatgaagtggaaaatatcgctactcaacttgcaatgttccaagatattgttgaacccactgccacagtggaaaatatggcgtatgaactcgctttgcgtttaggttttcaattaacgaatagcattgagtttgccgatcaagtggtttggctgaatgataaaacaggcaaaagaaaaactgcacttttattagcacagtatcacaatgaaatgcttaattgcattattggcgcacaaccacaaaaagtgtttgctttagataaagtatttaatggcaatgatgacttaaaagctaatctcgccctgcaattaaaagacgcaggtattgcctttgaaacattttagggggcgttatgcaattaaaatttgaagaactcacccaccaacagcaagccattgaagcggtgattgccttatttaaaggcgaattaaataaaaccacggaattttcccttaataacctaggcagtcagccgattatggcaaatcagctggcgttaccccttgaagaagtcgagaaaaatttaaatgcggtgcaggagaaatttcatcaaaaaacgaccgctctttccgatcacggtttgcatttttccgttgaaatggaaacgggtacgggcaaaacttatgtctatttacacaccatttttgagttaaataaacaatacggctggcagaaatttgtgattgtcgtgccaagtgtcgccattcgtgaaggcgtacaacaaaccgtacgaaccaccgccgaacattttactaatttgtttgataaaccgaccgttaataccacggtatatcgtagcgacaggctaaatgcgctacgcagttttgccactaataaccagattgaaatcttgattatgaacattgacagctttaaaaaagatgacaatgtgattaaccgtataaacgagagtggcgaagccccgattttgcaaattagccaaactcagccaattgttatcattgatgaaccgcaaaatatggaaacagatttagccaaacaggcgatagaagccctgaatccgctatttgtattgcgttattctgccacgcataaaaatccataccataaaatttatagcttaaatccgttagacgcttataaccaaaaattggtaaaacaaatcgaagtcgaacctgtgctggcagaaaacgatgtgaacggggcttatgtggtgctaaaagagcctgtggttggcaaaggtaaactcaaagccaaaat

SEQ ID NO: 93976 - DNA, 674 bp, Oryza sativa
gaattacaaactgcgggcaggttattaaccgcggggcctaatcctagtgaagaaggggataatataaccggttcgacagtgattgcggaatttgattcattagcggccgcacaagcttgggctgaacaagatccttatgtcagcgcgggtgtttatcaaaatattatcatcaaaccatttaataacgtgttttaatcttcaatataaaagtacaaatgaaaatttggcttttctcttcaataatcatcctattttatgttttctcaacttgattttaccggcttaccacttgctaatacgggagaaaatagaccgcttgcaatcgcagtggctatgtcaaatttcgtgaaaaaaacgctacaaaagcaagctgatttacgtgatgattggcaacgaaaattgccgacattggcggattgtggcaattatgctgaacggttaacaatatatttgtcaacgattaacgatgaagtgcaactaagccattgtttgcgtaactttaggcaccgtgaaatggcacgtttaagttttattcagtcaaataaattagcaacggttgagtttgtttttgagcaattatctgatttagcagaggccataattcttgccgcgcgagattggttatttacccgttgatgtgcagaatatggcacgcctgtgaatggtttaggtga

SEQ ID NO: 93977 - DNA, 601 bp, Oryza sativa
actaatttgacatagtaagcggttggattttttaccaaaaatgtatttccttgtttttgtaaaatcagtttttcttcccagggggaccccattttttcgggaagaattgctttcgggcgataaaataattttacatgcgtttgcaaggcaatttgtaatgtattggctttattacttttaggtgggatttcacgtaaattagaataaaaaatgattccctatcttgcggtaaactgttaattgctggtaatgcttctattttcacttggcttgatttctcaggctctactcgttgaataggcggcaacacaacaaacggagaggtaatttttttgccattaacatcttcaatccacgtttgggcaaggtatggtaactgtttgttgttattagaaatacctaatgacatcgcttttttgtcaccttcaaaaacaacccgagtcctatctaatccattcacagcttgagttgcattgtaacaaatactccaactatgattcctgtaatgctgacatatatttatttattttcataccgctatttcctttattaaatgtttaatcaaaattatatattgttgttttttaatgcttcaccatag

SEQ ID NO: 93978 - DNA, 1333 bp, Oryza sativa
gaaatcttccgtagaaagttcgccggttgggaagttggaaaaaaaatattctcctagccgtattgttacattacaacgcattgcaatttgaatgctattcatcaacgcttgtggtaagtcggcaaataaggcgcacatttcttcttctgaacgaaaatattgttgcggagagtatttttgagggcgtttgggatcgtcgagtgtataactatcgtgaatggcaacccgaatttcgtgtgcatcaaaatcatcttctttcaagaagactacgtcattgactgcgactaaaggtaattgatattttttggcaaattgaaccgcttgctgaaggtaacgttcctcatctgagcgccctgttcgacaaagagaaagataatagtgatccgcgaaatattgttgataaaaagccactaatgtggcggcttcttgttcattttctttaagtaaagctttgcccacatcacctgaacgtccgcctgaaagtacaatgattccctcatttaattcagctagccacgctttttcgacaataggaaactcaacatacccttgctgataagcacgagaaagtagaacagtgatattgtgaaagccttgattattttttgctaatagtgtcagttcaaaaatatcttcactagttggatcagaacgaacataaatatcagcaccaataattggctttaagccggcagttaatgattcaccataaaatttcactaagccacaaaagttactaaaatcagtcaacgccattgcagccatctgtttggcagcggcagttttgactaaggcttttactttagcaagcccattaatcatagaaaaatcactgtgtactttaagatgaacaaagcgtggttgagtcatatgcgaattgtttagatgaggaaaatagaaagcaatgttaacataaataagcggttaagtttttgcaaatttttgcagaaatttaaccgcttttagccgggggaaggtatattaatcgcgttttttagtaagtaaccaccaaacgatcgctaaacagataaggcttggaattaaagctccaatggcgatgggtagccagctaaagactaaagtcatattgccaaagacgatatttgatacgtagaaaatgaagccagcgataatgccgataaataattttatacccattacactcctacgcaatggtccaaaaataaaagaaatggctaatagcatcataactgccattgagataggctggtaaactttacgccaaaaagcaatttggaagcgttttgaatcttgccctgtttcagttaaaaaactgacgtaatcagttaagcctgcaatagacaaggattca

SEQ ID NO: 93979 - DNA, 615 bp, Oryza sativa
aaccattcttcatctaaagttaaatcttcattcaaattgacactaatacctttagccaatacatcacgtgcaatttgatgagcatcttctagagaatgttctgagaatgtaccacattgataaatattcagctcaggaatttgtgtaacatcagatactttggttaatatatcatgcatagcatttttccatgcatttgcgaccgcttgtgcgcttggctcaccaataagcgacatataaaaccctgttcggcaacccatcggtgaaatatcaataatttccaccttatcgctatttaaatgatcacgcataaaccccgcataaaggtgttctaacgtatgaatacctttagacgacataatctccatattagggcgacaaaaacgtaaatcaaacacagtaattaaatcacctttcggcgtagtgatggttttagcaactcttactgttggtgcattcatacgagtgtgatcaactttaaaactatctaataaaggcatattttactccaaattatatgcataatcaagactattctgcgattgcttgatcccaacttaacgctttggctgggatcttacgttgtaaataaaaaccgcgggttggtttagcttg

SEQ ID NO: 93980 - DNA, 1448 bp, Oryza sativa
ggaaatcataatggttgggagccttttgcaccaaaaacgtgatcttttaccggggccaactgaagcagaaattactaaatatggcttagacttggcgtggaaacgtaaacttgtcgcacgagaacagcaagatagaagctattcattacaataccaattcttacctgaaaataacccttggattaatactgtcgcgcagctcagccactcgagcacttatcaacatgatacacgttcagaacaagcatcaaaaacatatttggcttcattaggtaatgaaagctggacgcgttataccgatttaacattcgatgtcaacaatactagtttgtttaatgtggcaaaaacatctcatacacttttagtcggtttacaatgggtaaaacataaacgacaaacgcttatttttgatccgagtaaactccaaaaagcagaatataaccatggatatttccaaccatcttacatgccatcagggcatcaatacacacacgcattttacgcacaggataagataaaaattcacaacctaacggttagcataggtgctcgttatgattatgtgaaaaatataggcaaacctaatatagctactatttataatgaccccactgcagggcatgattacagcagtaaacattatcctggctggtcttcttacttaggtttgaattataaactgaccccttacttaaatttattcagcaatataagtaacacctggcgtgcacccgttatcgatgaacaatatgaaacacagtacgcaaaagcaactttaagcccaacagcgagctcgttagacctcaaaaaagaacgtatcacacagctacgcgtaggaaagcagatacatttcgatcacattttatcaaataacgatcaattaagttttaactcaacttttttttactataaaggaaaagatgagatttttaaaactcgaggggtccgttgctttgaaagtgcacaaaacaacaataatgaagtttgtagcaaaaaaatcggcaattaccgcaatttacccggctatcaaattaaaggatttgagttagaggcgaattatgattcaacttattggttcaccaatcttagctattcacacacaataggaaaacgattagcatcaccaagaaacccttggctagccagtacaagctggattgcagaaattccacctcgcaaagccgttgttactttaggtagccatattcctgatacaaatttaacgttaggatggaaaagtgagtttgttcgacgtcaagatcgttctcctacagatcaagataaagatgcaggccattgggcattacctaaatcaagcggttatgctttacacggcatcttcgcgacttggcaaccgaaacaaatcaaacatttacgcattcaattcactgtcgataacctattaaatcgatcatatcgtccttatcttagtgagttagcggcgggta

SEQ ID NO: 93981 - DNA, 1091 bp, Oryza sativa
ggtccaaaaccccataagttcaccaaaggccctacagtcacattaaatgcgccctctgtaattttattcaagcggatagcttctgccaccaccgtagcaaagtctggtgaaatctcaaacggcgtattaacttcacgtaatttattaaagcgactgatttgtgaatcaagttggtaagtagacatctcatcattaacgactttaagcacatcatctaactgtttttttacttgttcagcggtaggtaaattagcgatcttaccatcatcaatatatttgactgtataagtggtgcccattgttttaccttgtaaagtaatttgttctgcagatttattacaagcggtcagaataaacgataaactcgcgacacataccaacattagagatttaagtttcacctggtttcctcatataaaattaattgataatcaattagcaaaaataacgagattaaatcaattatctattagccattaaatgcgttaagcggtacgatatgcaaaaaagtttacaaatcgtaccgctttatcatagtgtattaaagcaaattaaccaccgaaatcatctaataagatatttttgtcttcaacacctaaactcttcagcatacctatcactgcggcattcatcactggtggaccacacatatagtattcacaatcttccggtgcttcgtgatttttcaagtagttctcattaagcacattatgaataaagcccgtgtaaccatcccaattatcctcagggagtggatctgaaagtgctacatgccatttgaaattgtcattttcagcttgtagttgatcaaaatcctctacatagaacatttcacgtttagaacgtgcgccataccagaatgacattttacgtttagattttaaacgttttaactggtcaaaaatatgcgatcgcattggtgccatacctgcaccgccaccaataaataccatttcattgtcggtttctttagcaaagaactcaccaaatgggcctgaaatagttactttatcacccgcttttaatgaccaaatatatgaagacatttgacctggaggtgcatctggttggcgtggtggcggagttgcaat

SEQ ID NO: 93982 - DNA, 692 bp, Oryza sativa
caaaaataacggcgtggcgccatacccgctgtgcgttttccgtcacgatcttcaaaatgagagtcagggatacgtgttgcaccagtcgttgaagccacttcaggtgaatgacagcctaaacattgattagtatttttagttacttgtaaaccacgaatactatgcggtactaaaggtggctgaaatgggaaggtcgtcgggatattacccgtgtctttttctggattagtatacgcaggcactacattttctggcaactgctcaatggaatcactaatattgctaacatggcctgtagcagctgccaaaccggcaaataatgttaaaactaaagtgagatattttctcatttcgggttcactccgttaatttatcaaattaaattgaccgcatcatcaacttctcaagttgatcaacactcggcttaaatattttttactggtaattgcttttcaaaacgtaagccaaaagcaaatacattttcagcacatacatcaatacaacgcccacaacttatacaatctttggataataccattgggcttgcttctggtttaacaatggaaaggtaaccccaatactggtgattcaggacaaacgttatagcaatccatacagcgatcacaacgggtacgatcaacgacctttacgcggactagtgattgagcaccaattaagccgtaaatagcacc

SEQ ID NO: 93983 - DNA, 1617 bp, Oryza sativa
  unsure (1)..(1617): unsure at all n locations
ctgcattaaccattcacggtcgcactcgagaatgcctttttaatggacaggcagagtatgaaagtattaaagcggtgaaacaagccatttttatgccgattattgctaatggggatattacttccccacaaaaagcaaaagatgtcttgaatatacaggggcagatgcagtgatgattggtagagggagtttcggacgcccttggttgtttcaagaactgaaacagtttttagagacgggtgacataatgatttatcaatcgatgaaaaatgtcaattgatgttgaagcatatcgaaaatctttatcatttttatggtgaacannnnnnnnnnnnnnnnnnnnnnnnnnnnnnnggttggtatttagatcaattaacgcccaggctcaaattttaaacgtactttcaatgcattaagttcaacaacagaacaattgatagcattgaaagaattggtcaaatccattcgttagaatcctttgttaagttggatagaggacaatgttagaacaacaacctgcacaaaacccattaacggtatcaatgctgaatgcacaagcacagcaagtaaatagccacttcgtgataatgtgaaagcggcattaaaaaactatttatctcaattaaacggtgaagatccaacagaattatacgaattagtattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctaaatgcttaacaagggtaatcaataaaaaaacttatcggcaagaatcaagattttttgtgtgtgatatttataaataagcgcacttatttgctatttttttgcaaataagtgcgctttattatttaggattattgaatttttaattttttgccgacaacaatatgattgttttggattttatttaatttactcaatttatctggtgtggtgttatataaacgggcacacgaataaagcgtttcatttttttgcacaatgtgatagccattgttcaatttaccattttctttgttggccgttgctgttgattgggttgttgaagttgatttttgggcgctatcttttttaggcgacggtttaacttcttttttgttattttctttcaccttgtttatattagggtgatatgcccaataagtatttaagcctttataaatagcttgtgcgattttgcgtcgataaatagagctggcgagttgtttttcttcaattgcattagataaaaaccccgtttcgactaaaattgaggtgatatctggcgaacgtaagacgcttaaacttgcgtgttgaggcgtttttttagcaagtggagtaactttttaaaggtagataatacggttgaacctaattcataacccgaacgttgtgaatgagaaaactgtaaatccaatacggtttgattaagataatgttcatttttattagataataatgagcctgcactggcgagtaattctgattgcttttggtgatcttataaccatttacccatttcattgctagcgcgtctatttgataatatccatattgaagcaccttttg

SEQ ID NO: 93984 - DNA, 682 bp, Oryza sativa
ccagtagtaatacactgttttttgccacaccagctttaacgatatctgctaagcaagtggcataaaaatttacgttcataacagaactcccacatttaaataaaaataagaaataattgcatttagtatgttataaatgacaaaaggaagtaaaattacttccttttgtatgcttgaataaaatgataaaaatattcaaatttaaattttattgtaccgctttatgttataacgtatagaaaaatggaataatcgccatagagactaccgcagcaatcacaccataaataaacattggtacaaccggtttcttgaagattgggccttcttgtttttaatattcaagaaagagctgaagggtacaatggtattgatacaaaccatattacccattgcgccatctactgattggaatgctaatactaaaggagtggaaatgccagtaatttctggagttgataatcgtacactaacaaaagttaagttagatactgtattccaaccggaagaagtatgcgccaacagccctctaaatatggtgcaaataatgtcgaatattcgcctgttgtatcattcatcatagctttaaatggcagctgttggaaacgtgtagtaattaaaaataagattaatgcactatacccaaaccaagtaggagtatccccagcacccaaaataacgg

SEQ ID NO: 93985 - DNA, 724 bp, Oryza sativa
gagctcggtaccctaccgaatctcagcgaaatattaagttggaagatggcgctagcaattagcattggcatatttgttgcttggttaggcggacgaggcatcaatttaatggccactcaaccattaatcattacaggcttattgatcggcacaattatcggcattgccttttttgggggaataccagttgggccattgatcgccgcaggcattatgtcgttactagttggcaaattgtaaccgccaacgtcaaatgaacattttatattataaactcacttaattctttgaatagctatgtattacccacatcgaatgaaacgtcacctgcaaaaaaatcgcgtaaatcaaccgcttgatgctatgcaaaaagcattgtggcacaattaaccgatatctctaatttagattattaccgtttacgtagccgtattcatagcctgtctaatataaaaaaactgagctcaaacaagccgctacacacgaaatagcacaacaactacaaacggcaaaaaaccatttttcagtacgacaagcacaacatcaacaatagattaccccgatttaccggtttctgcccggcgtgcagaaattttaaaagtgattgccgaacatcaagtggttatcatcgccggtgaaacaggttcaggtaaaacgacccaattacccaaaatgtgtttagcgcttggacgtggtgtaaaagggatgataggccatacacaac

SEQ ID NO: 93986 - DNA, 579 bp, Oryza sativa
cccattaccctgaataaaaaaaacgtgcgtaatcattttatttttctcaattctttaccttatacgcctgaaaccaacaaaagcttggccttattaattttcggggcgatattgtggttaactgaacccgtacacatcgccatcaccgcgtattaagccctattttagctattttcctagatttggttaaatcaaaagcagctctcgtgacctttgctgatccccccttttttctcttttttggcgggtttgctttagcaactgccttacatattcagcaaacgggtataatcaaagcgggctttttactcaatattttgtgtgtgttgctaattgcaactgtaggtcattgccttttgcaataaatgtaccccaaataactgaatagcaattgcataaatgctcaaaaatctaataatttatgcgctttacgcactcttatttatatttaataatactttgttagttcattgtaatatatgtaataaatagctatttttgggttatttagatcatattactttgcataaaaattatcttttaaagtaaattaccaacactttttaaaaataatgcatg

SEQ ID NO: 93987 - DNA, 575 bp, Oryza sativa
tatataaaaggatatttaaatatttccgtggccgttatctaaatgggcacggataaaccattgtaatttttctaaactacgggtttgtgcgactaataaatcttcactaattggatctagatgaccattatgttctaacaccacacgatgtgcttcgatattgtgagagtaatataaatcaatcaattttaaatgatcttgtgcggttgcacgaccgagtggatattcagggctctggcgagtttcaactaaatttccggataaaccatttggagctacccctagcgttgccatacgttcagcaatttcatcaataaaatcgcgaacttcatcaacttgactgtctagcatttcatgtactgcaataaattgtgggccaaccacattccagtgggcgtgttttaaaatcaaagctaattcatttaagccttgtaaacgcatttgtaatgcctcagcaattaaatggccagtcgcaacggttaaacctggcactgtgtggtcagcatttttgtgcatatcattagtcagcgcttgcgattgtccagttaattttaaaacaggaaaagtaattgttt

SEQ ID NO: 93988 - DNA, 681 bp, Oryza sativa
gtacccgtaataagcgctgcccgttactgcgattaaacccagctgagcctctagattgggtgataaatattggaataaaaatcccccaaatacacctaatactgtcccgattacccgttcaactacccgcttttgggttgcggaataattgggttggcaaacaaaaatagcggtcaataaaatccaataccctttactgtctaactctgctaactgcacaattaaactaccgataaatactacaattgatagccgaacggcgtggcggaagagttgtgatgacagcgttaattgctcacgtactgcggctaacatattcttgaagcctgatacattcttatcggttaagcgggcagatttttctttttctttgctgatatccgctacattagccagttgccaaattcgactaaattgatactcaatatggagtaaattttcagcaattaataaccaacggtgtgcatttgctagtcctcgttcttgatggtagtgcaatgaatttaataaaccttgtaaggctttttcgctccgtccacaatgttgatagccggagttttgccgtaaggcaatcgccacccgttgacaagcaatcgcctgtaattccattacgcgttgaaagcggaacattagatcactatttcgtaactgttgaaaaagttcgtgatattgataatagct

SEQ ID NO: 93989 - DNA, 651 bp, Oryza sativa
agcgtatcagcgcatcaagattacctcactaaagcgctctttttagccgatttattaggggtaagcaatgccgaaagaacttgttttgctattgggcttgagcctactcaagcgattgagtatctcaagcagaaaaaaatgctggcagaaaaagtcttaaaaaaagagttgcacgaatcggctttagcccgtgccacaacgattgcccgcttgacctcgcttgagatgactaaagatatttatgcgtccatggaacagctcgtcgagaaggcaagagttttaatacgtggaaaaaagggctggttgacgaaatggagcgtaaaggttgggtggcaggacgtgataaaaaactcggtcgtggattagacggtacactacttgccgaccctaaaacaggcgaatattttggcacgcctcgcagattgaatacgatttatcgggtcaatatgcaagcagcatactcaggagcacgttatcaacgaatgatggataatgtcgataatcgcccctactggaaatactctgcggtaagcgatagtcgcacccgccttgcgcatttggcattaaacggtcgagtgtatcgttatgacgccccattttgggcgacgttttatccaccaaatgggtttaactgtcgctgcacggtgattg

SEQ ID NO: 93990 - DNA, 1121 bp, Oryza sativa
ttctgcgtgttgtataaagctacatcacttttactttgcattaatttaatggcacgttttaatatatcaatattggtatcaagtaaagcaagatgatgtaatacttgtttacgctcaaattctaattctttgagtttcttatctaaggtataagccattacttcccctactgccaaatcacttcttgatgaacgattttccgttgccaataaccgcaccattcgttattttcattagttgttgttaagcatttaccgagaatatcctgagattgccaaccattggcttttctacgattatcttcacggtaagcgatttcatttgcatagttgagtaaataaagattactcattttgtgaacgtgtccgtagtacattcgtttaaagcgagagaaaaaggattcggcttgattgttggttatgcctaaatcgctacgatattcttctttatgattcactgtgcgtaaatcatagtcgagtaataaactttcgtaagctgtactttcgtctgtattaatgcgactttcacgaacaataaagcgatttgagaagtcttttacaacaggttgtgattcagaataagtcacaaaaacgtgtgaacgttttgccccgcgattaaattggttttctgctttttcttctgcggaaaaatgttcacgagctaccataacacagcgtttattaggacttttattttctttcaagcgatagtccaagcggtcgattttcttgttttctttacggaggtgcagggtgaacataagtgccgtccatatcaacttcgcctgaaagggggtgcatatctcgattttctaacaaggctttacgcaatttatgacaaagcacaaaagctgtacgataattaattttagcgtcacgagagatttctagtgcagatacgcccttaaccgcattcacaaaacgagctaatacatacaagtaggtttgaatggaagccttacggttggcaaagattgtgcctgatgtcactgaaaaggtatgatgacaatgtttgcaacgccattgtttatgactagcaataaaataggcttgatgttgtacaccgcatttaagacacgttacgtgctgtttacttccccaacgcatatcacaaagcaagtc

SEQ ID NO: 93991 - DNA, 541 bp, Oryza sativa
aaaggggttgatttaccgtatttccgtaaattattacgtggtacagcattatatgttgaagcaatagatcatgatattaggcttatttagatcgaatggaaaatgatgttgatccaattgagcggacgattttacgtttagcgacctatgaattaaaatatgaattagatgtgccttataaagtcgttattaatgaaggtattgaagttgcaaaagtatttggatcggatgatagtcataaatatattaatggtattttagataaattagcacccgcattaggtcgtaaatagtgatataaggtaagcgaaagcttgcctttttgttttgaagtttacaaaggaaaattatgggtgaatttgatctaattaaacgttattttaaccgtcaactaccgaaattcggtgttgaactttcaataggtgatgattgtgctattgttgctcatcaagcagatacaagaattgcgattagtactgatacacttgtggcaggtagccattttttagcgaatatatcggcggcagatcttgcgtataaa

SEQ ID NO: 93992 - DNA, 1727 bp, Oryza sativa
ttacattggtctatatctgttacttgaagatgattatgatagtgctctagatgcatttaatgctgttttagaacttgatcctcattacaattatacgtttttaaaccgtggcttagcattttattatagcgggcgttattctgaagctgaacgtgatttattacgcttttaccaagaagataaagcagatccctatcgtgtcttatggttatacttcaatgagctagaatttaaacctaatgaagcaaaagcaaatctaattacacgatcaaaagcattatctgctcactattggggcacaaatattattcattattttttaggggagttaactctcgcgcaacttcgtgatataatggataaagaagctcaaccaaatacagcttcatatgcagaaattttaactgaaacatatttctatttagcaaaacaacaactcaaattaaataaaacggatgaggcaattagtgctttccggctctctcttgcaaatcaagtgtttaactttgttgagtatcgttttgccctgtttgaattatcacagctaagagctatggaaaatcaaacttatcctgttgttgggataaattaggacgcaaacaagcggttaaaaatggcaaaattactgtttttttaccgcttgtactcatttagacaaattgtaaaagcattgaattcgcttcgttatttcattttttctttcctaaaaactcaacaatttttatcaattagtaataagataatcttgaatataaatcagcatatttaagctaggtttaatgttttcatttgcttattactcattatttatggttttttatgacaaataatactttaactttctctgacttaggtcttcctcaatcaattctcgatgctgtcaatgatatgagttttgtaactccatctcctattcaacaagaatgtattccccatttattagctggtagcgatgtactcggtatggcgcaaactggtagcggtaaaacagcggcattttcattgcctttactcgcacaaatcgatccgaatcaacgccatccacaaatgttggtgatggcaccgactcgtgaatagcgattcaagttgcggatgcttgtgagcaatttaccaaaaatatgaaaggtattcgtgtagttaccgtttatggtggtcaacgttacgatattcagttacgtgcattaaaacaaggttctcaagtggttgtgggtacacccggtcgtattcttgatcatattcgccgtggtacgttaaatttatctaccctcaaatcaatcgtgttagatgaagccgatgaaatgttacgtatgggctttattgatgatgttgaaacagtaatggcagaattaccagaaaaacaccaaacagccttgttttcagccaccatgccagagcctatacgccgtattacacgccgatttatgtctgatcctaaagaagttaaaattcaagcaacacaacgttctgcaccagatattacacaaagctactggttggtaaatggtttccgcaaaaatgaagccttactgcgctttttagaagttgaagaatttgatgcggctattattttcactcggactaaaacaggcacgattgatatcaccgaattatgtgagcgtaatggctatcgcaccgcagcgctcaacggtgatatgactcaacaagctcgtgagcaaactttagataaattaaaatcaggtcgtttagatattcttgtggcaacagat

SEQ ID NO: 93993 - DNA, 548 bp, Oryza sativa
tgccgcgcctaatgcggcggctttatcgtgataaaaaacgcctaattcgcgcaatggctgataaaattcaggcgccaacattaaacaaaaaaaaccaataaataagctaatttctagctgataaccgccaaaatgaagttctcctaaataactaaagccaaaataaaccgccatcagcgcgattgaaatcgccgtaaaaaactctaacaccgcagaagacaaaaaagccatttttagcacatccatcgtactaagtctgaatgcttccgtactttgatgaatctgttccacttgctgttctgtttggccaaataagcgaatagtttccagacctttcaatttatctaaaaattgaccgctcaagcgagaaagaatgccaatattacgttgattcgcttctaccgctttcaaaccgactaacgccataaataaaggcaataaaggcaaggtgatcaataaaatacaacctgccgcccaattaatgggaaaaaccaccgctaaaatcactagcggtacaataagcgataaaaattgttgtggcaaatatc

SEQ ID NO: 93994 - DNA, 547 bp, Oryza sativa
gttaatgatgagaaataaaaactatacaataagttcgcttttcaaatattgaagaatctcatgataatttttagccggtttatttatctgtttttctttttgcgccatacgaatgaggttacgtaaatgttggcgatcaagttgaggatattcactaagtagctgattaagtgatgcatcacccatatttattaattgatcacgaattaattctagcttgtgtaataatgcttgttgttgattgcgtctattttttactttatctaatgcatcttgaataggtgcagaatctcggttacgcaatagtttgccaataaattgaatttggcgacgacgagcttctagtttgaagctttgagcttggcgaatagcatatttaagatcttcatctaaggggattttttctagattttgtggtgttaattcaatcagttcggcgcctaacttttttaggtgttcagaatcacgtttgatttcgcttttacttacccaaatgatttctttatcatcatctgtccagtcaatttctggtttgccgcgtttttta

SEQ ID NO: 93995 - DNA, 668 bp, Oryza sativa
attcgagctcttggcccattaataccttaaccgatgacggtaattccaggctaaacaaagtttatgctgattatgtccgtgtagtgggtaaagatattgagcttgctaagaatgggcaaattcatgcggatcaacaacttatcttaaacgccacagggcatgtaaaactaaacgatggttcaagtgttatatctaataataatttggggattagtgcgttaaatctaacattagaaaacgcgactgtatcagcaaataacttaagttttagggaacgaatgataccaagctaaataacttatctaaagtttcagcaagagcggcagatcttcaaagcggtaaccttaacttagataaagcttcagtattagcgcataaactcactttaaatattagcaatgatgtttctttaaataaccagtctaaactttcagccaataatctaaaaatcaagaaagtacgcgatcttaacttaaacaattccgagcttagcgcaaataacttaacattaaacacttctaacaatatcaccttaaagaacaaatccaaatttacagcgggcaacatgaccttaaacgtgactaataatgttacgttaaataatgattcagagcttgcagccaataatttaaccttaaacgtgactaagaatgtaactttaaatgatg

SEQ ID NO: 93996 - DNA, 1188 bp, Oryza sativa
caccctgagctacttcttccacaactaaatacgtatctgagatcactgtttcatctgctgctttagcactatgcgcggcttctttaatcgttaattgatgatgatgtttctgattgaccgcttttacacctaaattacagaaaaagccaataaataataagcccgccataatatacatcgttacactataagcctgtgccgcaggcacaccactatcaatttgcatatgacgaatataattaactaataccggtcaattacggctgcagttgaccaagctaataatactcgcccatgaatcgcaccaacttgatatgagccaaacaaatcacgtaaataagctggaattgcggcaaaaccgccaccgtacattgaaataattacacagaagcctataacaaataggactttattaccactttcaccgatcgatggaatgataaaataaagcacggcacctaacaaaaagaaaatggaatacagatttttacggccaattttatctgaaatacttgaccagaaaaaacgccctgccatattaaataaactaagtaagccaacgaaacccgctgcggctaaagtaccaatcgcagcttgttttccaaccgaaacttcagagaaaagctctggaatcattactgatgcttgccccaatactccaattcctgccgttacattcaaacaaagaatcgaaaacagtagccaaaattgtggcgttttcatagcttgattcacaccaacattgtatgcactgactagcttatctgcttttttatgttcaacaaatccttttggtttccaagttggatgaggcaaacgaatagtgaaaacaccaaacatcataaaaatgaaatagaaaacacttaatactaaaaaggtttctgctataccaaccgatgtctcactgctaaagaaattcatcaaaccaacggaaataggcgaagctaacattgccccaccaccgaagcccataatggctaaacctgtggccattcccggcttatctgggaaccatttcatcaaagtagataccggcccaatataacctaaccctaaaccaataccacctaaaacccccgttacccaaatagagtaaccataaattgtgttgatacacaccgattgctgcaacaacaaacccaaggctaaaacaaatcgtcgccacaaacattgctttacgtgggccaa

SEQ ID NO: 93997 - DNA, 713 bp, Oryza sativa
ccattggagtcactccataaattgctttgaaagcttgcttaatgtaattctgattggctttggcattaactaagaaagtgtactttcttggttctgacatcatgatgccataagttttttcagtaagtattggtttaataagtacgtcagtaatttgcatgattagttcaacctttcaactcagttattaattgcacttttttgcgctaagacacagttagcatcaattaagtcttttactgatacttggtttcatagtttgtatgaaacgttaggtaagttagcactagatttttctaggttttcgtttttttcaaaagctacgattaatacttttttattaaccttaagttcttttagtaatttagcaattgcttttgtacttggtttatcttgtttaatcgaatcaactaatcctaagaattcgttgttattaactttagaagtaattgctgatttgaaagctaatgaacttacttttttatttaccttaattttgtaattacgatttggtttaggaccaaaagcgataccaccacctacgtaatgagggttacgaatcgaaccttgtcttgcacgacctgtgtgtttttgttggtaaggtttcttaccaccaccgctcacttcaccttttttaagggttgagtgagtcccttgaatttgtgataggttttcagcaagaattgcatcgaagattgcttgtttatgtactt

SEQ ID NO: 93998 - DNA, 739 bp, Oryza sativa
agctacgtgtaactgtgccaacgatgtacggcgtaaagtttccgccatcacatcggctgtaaattgtgttcagttaaaagaagtgacggttaaacagacaccattcacggctatgctatcgcctaaatgtacatctttgagtaccttgcaagcattaatgggcagtaccgcaaaatcacctggatgcttgatattcgcaactttacccacttcttcaataatacctgtaaacataaattctcctgctgtcagttgctaatttttgcgatgatgaaacgtcataatctaacaagatatcgtcgcctatgtattgtgtggatttaagcgttaaattaaccgcttccgctagttgcaaaatacctgcaccaccgataggacttttggcagtgcttccgcctaataatttaggtgcaatataacaatgaattctgttaacaacgccagctttcaatgcactaaaattcagtgttgatcccccttcaagcaagacactgtcaatttgcattgcacctaatttggctaataaatcaactaaatcaacttgtttgttggctaccttacattggataatttgcacgccaaaggctttcaattgcgctatttttgtactatcagttgaagcggttgcaataatggttggatattggcgcgctgtttgaactaattgacacgctagaggcgttcgtaagtggctatcgcacacaacgcgtattggttgtttagcattcggcattcgact

SEQ ID NO: 93999 - DNA, 631 bp, Oryza sativa
ctgctcggtcgccattcaatagcaatcctcctaatttttcaaactgatcacgtaatgttcgatactggcgaataccaattaatgaagggggtaaagtgggtaattcaaataaagccaacgccgttgcttgttttaaactatcaaaaaacctttgatcatctaaaccaaaacaagccagtaaaaataccgcttgtgcattccccgccgcctgttttatttcttgtactaaatcttcaaacgctagtttatgctcaagtaattgagcaatattaacactccgaaattctcgcgcattttgacgtaaatagtctaattctggaatattcaaatatcctattgagaaatcacaatgcgaaaatgctgcgttctgctttaaattatcgactaatatttgtggctggaaatcgtgataaccttcgatacctaaaatagcaatctgacgataagggaaatgttcattttctgctataacaggcacacttttaggcgataaccaagtatggcgtaaaccacctaagggcgtaacacgtaaatggttttgtttatggctgccaaccaaacctaattcttgcataaattgctcaaattgttgcactttagctacaacttgatgttgacctaataaacaata

SEQ ID NO: 94000 - DNA, 1062 bp, Oryza sativa
  unsure (1)..(1062): unsure at all n locations
agcgtgttgtatgaagtattacaaatcattttggataatgaacatttacgtgcgattgaaattcaggtctatggtgcagattattggaatgtcacgattgataatgcacccgcacaaacatgggattttactgaaatagcggttgaaaatgaaaaagtcgcgcgattaggttggaagccgtcattattatgcccagatgaacgataattaaaaatgtttctgaaatgatcggccgtagtctatacgttttacaagtcaaaaacaacaannnnnnnnnnnnnnnnnnnnnnnnnnnnnnnnnnnnnnnnnnnnnnnnnnnnnnnnnnnnnnnnnntcgctcactttttttaaaattcaaattagcttattgaaatataatagcgaaacggtgaaaaattggcataaacagaaaacgattttagcggattttgaaaaagcgttaaacgaggcatatagtcagttaagagagctattatcgacttttcgcttaactattgaagaacctaattttaacctgtgcattagaacgtgttttggattcgttacgctcacgaacttcagcaaaaataagtttaaattgtaaattgccttcgcaaacgtttagtgctcagcaacaagtccatgcattacagattgtgcgagaagcggtcattaatgctataaaacattcaaatgcaacccaaattgaagtgattgctgaaactaatcaagatggcgaacaatgtttaattgtacgcgataatggtaatggaatcgtgaatggcattgaaccagatgatcattatgggctgacgattatgaaagaaagagcggcacaattaaaaggcgaatttactattatcaatcgtggtgaggcggtgtacaagtaatggtaacattacccaataccttactttaagcatcattcactttttattattcagtaaagcaattagcaacgtatttgaaattatgttggttatttataatcaaccccatccaagctagcaatcaccgactagcataaaatagtacaaacaaataatgttagcttaccaataacgtaagcgagttgattaagca

SEQ ID NO: 94001 - DNA, 685 bp, Oryza sativa
ttcagcagagtttgccgctaaaggttatcgggtaagcatttttaatgatttcattgactatgcgaatcatacggattatccgcttgactcttttccaaattttaaatacagcgtttcgccacaatggctgaacgcagtaatacaaggtgaacagccagaaacttatcagaataatcaatttatggtgtttgaagtttcatggggcagtttggaaaacgcaaagaattatacacaacacattgtcggcgcttatcactttaatacggattggatcgaaaatgcacccgtttggaatttgtctgatgctaacgtgattgaacagcatctattgcaaaatggcattactaaagataaaacgataattctttattctgataatcaattggcagcctatcgagtgttttgggcattgaaatgggctggtgtagaagatgtacgcgtattgaatggcaatttagcgagttggattgatgcaaattttgctaccgaaacaaaagttaatttaccacaacctgccacaagttttggcgcaacgattccggtgaatccgcagattgatattattacgcctcaacaagtgatggagcgacagcaacaaggtttgaaattaattagcaatcgtgcttggaatgaatatataggcaaagtgagtggttatgattatattcacggcaagggagagcct

SEQ ID NO: 94002 - DNA, 905 bp, Oryza sativa
ccagcgattgttttaatggaaccgaggcattcaataacatagctaactgattaattaattgagtgatttgttcgctttttggtttcctaactaaaataaaattaccttggaatatggatttttgaatagcctttacctaatagcccgtggttctaattcatcgtgacttttggccagagatttacctttttgccgttgattaaaacgattaaaagcccgccaatgaaattcatatattttcagcatcgcctaatactctgttaatttctgctaaggacgtaatatcagcctctaacttatgcttcgcactatgatgtaaactagcaaaatcaaggtaagcggtctctttttcaaagatttttcccgtacggcttaataattgataaatgccaatgcgtcctctatagccctgatagcaagcctgacagcctttaccaaaacattgcgtgcatagcttgcggacaagccgttgtgcaatgactaataataaggcgtttttaagctcatattctttaatacctaattgtaatagccgttcaattgcagagggcgcatcattagtatgtaatgtagaaagcacaagatgccctgtttgtgcagcgcgtaatgcaatttcggcactctccggatcacgaatctcacctaacataataatatcaggatcttggcgcaaaaatgttcgtaatagatggctaaaatctagctgaatcgctcgattaacttgtgtttgaatgattccttcgatctcaatttctattggatcttctgccgttaaaatatgcttatccggttgattcagatgacttaatgcactatacaatgtgatacttttgcaaaagtcggtggggccagtaactaaaattagactttgtggttgatgcaataagtgtaataacgtagttttt

SEQ ID NO: 94003 - DNA, 798 bp, Oryza sativa
aacgctaagtgatacgttacgggaacgcgctattcgaagcacttatcttgaaggtgatatggcgcaaacacaacgtaatcaggcaattacacgcctaaaagagggcggagtgaatgtattagttgcgacggatgtagccgcacgtggcattgatattgatgaagtggattatgtcattaattttgatttgccatatagtgaggatacttatttgcaccgaattgggcggactgctcgtgcgggcaaaaaaggttcagcgatttcattagtggaagcgcacgattataagttactgggtaaaattaagcgttatacacaagaggcattaaaacctagaatagtagaaggtttagaaccacgtacaaaagcgcctaaagatggcgaattaaatagcacttcgaaaaaagcaaaagcacgacttaaaaagcgtaaagaagccaaaaagattgaggctaaaaccaaactaaaagttcggcataaagagagcaaaaacataggtaaacggcgtaaagtggcaacaacaaatgcataaacgcgtttttagcaaaatgttgcgattatttgatcgcttatcttagccaatcgaataggaaaccgtatggatttacacaatattcgcgcagactacactaagcaacaactttcaaaaaaagagtgtgatgcaaatccaatgaagcaatttgagcggtggttaaatgaagcgataatggcaaaggtgaatgaaccgacagctatgaatatggcaaccgttatagatggcaaaccaaccagtcgtatcgtattgctaaaagaagtcga

SEQ ID NO: 94004 - DNA, 1171 bp, Oryza sativa
  unsure (1)..(1171): unsure at all n locations
aatactcattatatccgcgccggtcgttttttaacggatcaaacgattcctttattattcatttcttgttgttggtggctaatcgcatttggcttagtgatcagttatccaaaatcagctagcctttggtctaaatctattacagcaaaatttatttttggcttctgcacgttaatcccattttttattgcaatacttgcattacgattcaacaactacgccttcaatcaatttcaaggcgcgtatttattactttatgtatgcctattagtatggtgtgctgattctggtgcttatttcttcggcagagcatttggaaagcgaaaattagccgctaaagtatcacccagtaagtcttgggagggcgcattgggaggcttaatcacttcttgcgtgatggctttattattcataaaactaacgccaaataatatttttggtcgcgaatttgaaacactcccctttattatagtctcggttgctacagtcgccgtttcaagtttaggtgatttagcagaaagtatgttcaaacggcaagctaacataaaagacantaataatttaattcccagcccatgccgtattttagatcacatttatagtttaactgccaccattccattttttgctaccttattcttttttgtattataggatattatgaccgctattcttgcattcttaattttaatttgtgtacctgtttttgtacacgaatatggtcatttttgggcagcacgtcgttgtggtgtaaaagtccttcgcttctcgattggctttggtaaagttctatttcaaaaggtagataaacaagggactgagtttgttttttccttaattccacttggtggctatgtacaaatgtgggaaggtaatgaatccattaacacggataaaacacaatccctaatgcaaaaatcccgtttacaaagagcatttattatcatagccgggcctatggctaacctattatttgctgttttggcttattttgtagtgtttagttatggtatgccgacactcaaacccgtcatagctgaagtcacgccaaatagtattgccgccgccgctaaattaccgacagaatttgaaataaaacaagttgatgataaacaagttcaagattgggatgaagtcacgcttaccttagttagcttaattggctccaaag

SEQ ID NO: 94005 - DNA, 1005 bp, Oryza sativa
tttatggcgctgatcagtgtcaatttaggtataatgaatttatttccaattctaccgctagatggtggccaattagtcttgattgctacagaagccataaaaggtaaacctatatcaacaaattttcaattacgttttcaacaattaggtgctgtatttgtattggctttaatgatctttaccttacttaatgacgttattcatttttaattatagcggttaatttcgctcattatttacaatcataggatagtttaaatgaaaaaattattactctcttctcttttagttgccaatggcgttattgcggcaccatttgtagtaaaagatattcgcattgatggtgttcaaacagaaactggcaatgcaattattgcatctctaccggttaaagttggtcaaactgcaacagatggagatgttactaatattgtaaaacaactttttagtcaaaaccgttttgagaatgtaagtgctgcacgtgaaggccaaacattagtcattaaagttgctgaacgtcctttgattaacaatttaactattaaaggaaacaatgcaatccctaaaaatgcattagaacaaaacttaaaggcaaatctaattgtggcaggtgaagtatatgataaagcaaaattagaagcgtttaagcaagctttagtagatcattatcacactatgggccgttatcaagcagatattcaaaccattaccactcccaacaataacggcagtataaatgtagaattaaatatcactgaaggcgagattgcctatgtcaaaaaaattaattttgaaggcaataatgcattcagttatgatgaattaattaaagaactagagattaaacctaatgcgccttggtggaatatttttgaaagtagcaaattccaacaacaagaatataacaaagatatagaaatcttacgcgatttctatatggatcacggttatgctaaatttaccttaaaagacaccgatgtgaaatttaatgagaataaaactgaa

SEQ ID NO: 94006 - DNA, 630 bp, Oryza sativa
taattatggaaggaatcatattatttttttattgctatttatgattaggcttggttagaacggtagttaaattttttaagatagtcgaaagcatttttatgaaaaaagcggtctaatttacataattatttgcaaattagaccgcttatattatctaaatactgagcgatattgtggcttagcgcgtttaaattgactcataaagacaattaagaaaaatagcataaataaactaaaggcgacaattaaccattctggcatcccccagcctaacatttgccattgcttttcactacaattgaccgtaccagcagcaaaaatattgggaaaccattcatcaagcggtattgtttgtgggaattgtggtttaaactcacattgattccaaggcgatggattggcttgataatcataatgtttaatagaaagtgataaacctttaaatgcactgaaaccccataatactagcgctagccagcggaatagaaagaaattaggtgcaattaaggcaattaagccagcaattaaaaaaccagtaagtgcaacgcgttcatatatacacataacacgcggaattaggcctaatttatgttggaaataaagaccagttacttcaagggtacaggctaa

SEQ ID NO: 94007 - DNA, 584 bp, Oryza sativa
ctgttattgaacagaaaggattgtcatttattagccaagcattaggcacaaaagcaactgcagcagacggcgtaatattgcaagactatcagaaaatagaaagtattgaagcattacaaaaagaattctcagttaaattttactaatgtatagcaaccagcggtcgtaaatgaaatcaattttacgaccgcaagtaacgatcactaaataaaaaagcctcattctatgaatgaggcttttttattatttaccgagatgagtgaaaaagtttttaacactgtctaaaaaaccggcttgttgcgggcgatgatttgctttaccgtccaaacttatttcaagttggcgtagtaactctttttgttcttcattcaattgaactggagtttccactacaactttacaaattaaatcgccagcatatccaccacgcgggctcacgacgccttttcctcgtacacggaataatttacccgtttgtgtttctgtaggaactctgagtttgagcttaccatctaaagttggcacttcaatttcaccacctaatgcggccatgctaaaactaatcggtacttcacagtagaggt

SEQ ID NO: 94008 - DNA, 767 bp, Oryza sativa
  unsure (1)..(767): unsure at all n locations
attacccaggtgaatggttattagatttaccgttgttatcacaatcattcaaagaatggtcgcaagctcaacaagctgtagatcaaggggagcgcgttaccttagccaaaacgtggttagaagcggtcaataaaattgatttattcgctaaagcggacgaaaatcagttagctgatttaagcgaaatatacaccgcctatttaattaagtgcaaagcagcaggaatgcaatatactcagccggggcgttttgtgctaccggcagaaaatgctaaaggtgcgcctgtttttcaattttttccattattacatttatcagaagcagaatggcaacggctagaaactgctagcgacaatagcacttacaaaatattaaaaaaacgttatcgctattatcaacaaaagattattcaaccattttatgctgactatttttcacaatttgatcggcaagtgattttggcggattgcctaacaccactgaatcacggttatcctgcatttatcgaaatgaaaattaggttacaacagctatttaagcattttcattacggcaatcgttcactttttcaccgcttattctncgccaaaattgataagttattnatttttagccacctaagagcgatcatatttagtagccgatcaagatcgcccaatttagaaaagtttaaatgcgacaatttagtccaagaagggcggtcgttatgctgaatttgacgggattgaaattggctatcaagctatttcggctatccgtgccactga

SEQ ID NO: 94009 - DNA, 558 bp, Oryza sativa
tagtaatcaaggaataatcaatatgtcagtaattttaggatcagatttagtaaaacgtggtatggcacagatgcaaaaaggcggtgttattatggacgttgttaacgcagagcaagcacgcattgcagaggctgcgggggcagtggcagtaatggcattggaacgcgttccttctgatattcgcgcagcgggtggcgtggcacgtatggcaaacccgcgtattgtgaaagaagtcatggaggctgtttcaattccggtaatgcaaaagcaagaattggccatatcactgaagcacgtgtactcgaagcaatgggcgtagattatattgatgaaagtgaagtattgacgcctgcggatgaggaattccatttattgaaaagcgaatatacggtgccttttgtttgtggctgccgtgatttaggcgaagccttacgccgtattggagaaggtgcatcaatgttacgtaccaaaggagacccaggtactggaaatattgttgaagcagttcgccatatgcgcaaagtaaactcacaagtgcgtaaagtggtcaatatgagt

SEQ ID NO: 94010 - DNA, 642 bp, Oryza sativa
tctatagtattaaccaacccgccgctgcgcgtggttatcaaagcgtcttttggaatatttccttatatgataaatattattttgaagctatgtttagccagtttgttttccctgattttgaacgaccaaactggcaaacaaccgcgaaattacaacttttctttatgaaatggtttaaccaagaacggactaaagccattttgacttttcctgttatcacggcagctatgctcacagagcacggccaatgcaaagataatcaatttgctgatcaaatggcagaagaactttcgcaaggtaattcattctttatctaccaatcagataatcctgactctttagcgtcttgctgtcgtttacgcaatgaaatcgcggatcatacattttcctattcgcttggtgcgggcggtgttgctaccggttcaattaacgtaattaccatcaatatgaaccgcttggtgcaagataaacgcgatctggcaaaagaagtggaaaaaattcataaatatcaatacgcttaccgtaaaataatggaagactatttagccgcaggtatgttgccggcgtatgatgcgggttttattacgttagataaacaattcttaacgatcggcataaatggtatggcggaagcggcagaat

SEQ ID NO: 94011 - DNA, 628 bp, Oryza sativa
tgatactctgtacgaagcgctaattctggtgtaattgcatattcaacacctgtgcctaattataaagaaggtttaagtgtgtgtaacttagtttcgtctttaacgtgctgatctttactttgaagatctaaaataaatttataatcattacgcactaatcccataccaactttaccatatacgtctaagttaggcagaatttcatagctcggttttaagcttaaatttgcgccatgtgcagtatgtttaaattgacgatttaagtcgcctttaggcttaggtttatgaatagggggtcttggtcctctaggagtaggaacatctaacgctactttattttggctactgcctttcatttgaccatagtagtcataacctaattcaagcgctaaacccattttattttgattaaaaatttggtaaccaccaaaacaccataggtcaccgaattacggtgaatgccccaggtagtgaactccggattataacgtttatcattttgatatttactatcaaattgattaatatctttatgtgtgcttgcccaacctgcttttgcccctaaataaaaggtattggcatctggtgcagccaatgctgcgcttgtagcagataatacggataatgt

SEQ ID NO: 94012 - DNA, 569 bp, Oryza sativa
cggggagccgttacgtgaatttggctgggtagtacatacgcataaatcacgctcaacacaagcagcgcgaaataactattccgaacgcttgcttggctgtatatgtttaagcattactctgtgcatgattttgcggagtttttagagcttaacggtatgccaattcgcattggtaaatatggtgcaggtgcgacaaaagatgaaaaaaatacattaaaacgtgcactcgcgaaattgggcataacgctgcagggattatgcccgaatctatgagtattgagttgcataatgcagcaaatggggtggccgcgggaaataacccatttttacagatgatagattggtgtgagaagtcaattgctcgcttgattctagggcaaactttaacctcgggtgcagatggcaaaacctcaaccaatgcgttaggcaatgtgcataatgaagtccgccgtgatttgttagtctcagatgttaaacaacttgggcaaacatttacgcaacagattattttgccgtatttgttgattaatttcccaagcatcgatccgacacgtattccaacctttgag

SEQ ID NO: 94013 - DNA, 20822 bp, Oryza sativa
atttcatgcgagttttgctccgtttttgatggatttcatgcgagtttgctcccttttttgatgggattcgatcggttcggcgacggagccggaggtggtggggtggggagttttggggtacgagtgtttttcaaactcgctgaatttcgtcgaattcggatctagtgcatacatgttaattaaggtgttgttcagattggtatcatttcaaaacatactattttttaagcaagattgtcaaagatatatacatttagttatttaccaaacttttataaatacataaggaatcttaccaaaacttcgcaatattaatgtcaacttatcaaaatttagatattactaatatttggtaataaggtttattatttcggctataatctaaacactacttagtaacagtgatatggataagattatggcgtactgtagcagaatactgtagaagaaaatcagtcattagatcacaaaaacgcatggctgtggttgtgcagaagttgttgtatattgtgaacataatagcagcgacgaagttcgttctcaatagcatctggccgactggatctcaattcggttttggggtggttgtttggtatcttactgtagcatgatgtttcgtatatggtgtttggaaaatgatacacgtacacaattttgttatccatcgacatcttcaaaaactgatgtgccacactgtgcattgaattttgattttgttttcataactgtccactagttatgtccaacagttgagatctttgttactaagctcacggtttagtaaagatttttctaatactataaaagcggagtagttctttctttccacccctctctcaccagtgcacgcgggttggctaatcaccagatctaatgtttgtcgattactcttctagcccatatatgatacaccctagttatatgggcatgtcatgttacaacatatgtgcatgcttctacttaacctttgatggcattttcaaccatatcattttcagcaaagttgccaaaaaaaatgtctacgtttaatttgttgccaaatttggtaaatgcataagaaattctgctaattttttggtaatattaccaaatttggtaaggtttattttgactacaatctgaataggccataagtaatccagttatcacacggttaccagctatttctttgccaatattgtaagtagcaattttgaggtatccatgatatataataacacaaatgttcgttcaatagttttgaaacaaccggtttacaaagtcggctatcaaatttaaaccttaggcaagaatattttgctttcatcggaatgagttgtgctccctagcttgtttgtaaaacactagagagcctactactactactacctgttggtgataataagcactgtagttgatgtgctccctcttgcttgggtcacgttagatttccatatgtttccggtttcttttttggctaggaattgattttggggaaaaaaatcctgaaagctacttgttatatttgtaggttttatagatacatgaaagaaaatgttttggcttatctagaaattggaaatactactgtcggggctcctttttaaatgtagaaatttcgcaagaaattgtccattttcaacttctgtgctaaaagaactcttggtagtagtcatgagtgtaacctataattatccccttcatatgtttttaactgaaaaatcatcatatagatcaaattttatgtatttcaaacaggtttgttcacaggtcaaacttttcactggcaccatgaactaagcggaggtagaagcacacaattattgtgaaaactactgtcaattattaacatgtcgctgtcctactatatatgtcaagtaacaactgtttgttccctaccttaaatatttctacatatagtatactccttctaaattaatactccaacataaacatacccaaaagtagtgcctaattgtggcgcagatatgtgcatgcatacgatggtcttgttttatccatctgatgattggtcacctagatttctctcccgtgaacatgtacacactgtggctgtgtgcgtgccggtagttttggggtcacatttagttctttgggttccttgggagtaaagttttttaagtatacgaacacacatttaaagtattaaacgtagactaataataaaataaattacagatttcacctgtaaactgcgagatgaatttattaagtctaattaatctgttattagcaaatatttattgtaatatcatattgtcaaattatgatgtaattaggctcaaaagattagtctggcgatttaaatgcaaactgtgcaattggttttttttcattcatatttaatacaccatgcatatctccaaacatttgatgtgacagaaaagttgaaagcttgaagaaaaaaattttgaatcaaaaacacggccagttgattttggacgacaaacacacaagcgctagctttcatctatcgatcgtcagggggcgcagcaaaaccccacagccagagtgtttcttcgcttgtgcactccgggagttgggttcagtgtgagcgacactgttgctgctttgactgcaggacgacgagagctaagctagctagggccggggagcacgggtgagatgaatgaaatgaagaggaggagagcgagcttggattgggcgggccaatggcgctcggggcaagttgcgcttacggcggccaggcgtacaggagatttgctgtgctgctacagggcacttctgcggggattgttctccatcggtagctggcaacgtacactgcccaattaacaatagccaactgcccaattaaaatactttggtaataaagtaagtgaaaataataataattctaaatttttttaataaaacgagtgatcaaacagtgcaaccaaaatgttaaaatcccttatattatgggacggagggagtagtatcttaattcactaagataatacacattccgttacacaatttaaactgcattcatgggttttttatccaatattattgttcgtcttatttaaatatttttttatgattagtattattatttttattagatgataaaacataagataaataatgcttgacttaaataagatgcacagttaaatattagaaaaaaaccaacaaatacacgtaaaataaaatggatggagtactacataaggtatatgaggctagctccattttgaaacacgggaaaaccacataaagtttgaaggatttaaatactactactctcctataagacaattttcactgagaccctttggataaaggattacagtaggtacctataatttctttgaaatttctatggatagatatttcattgcaattttagaggatttgtagcataaactccaaacctccttcaaaattttcctttcttcctagctacctctcaaattcttcaaatgacgtgttttgcccgtgttcaattcaaatggttcttatgctgttttcctatgatctttgttgcttaaagattcaaggtgtgaagacagtctctaaggtctccttggggagcaataattttgtaaaggaatttaacgaattgaaatcctatgagaaaatgtcctttgagccctgtggattttatgaatggatttcgaaatttggattgaacgcacacatgcataccatatctgtatgagcatctcagaaagacttgtccagtaagtcttgacattgatgaagtcatcatggatatctgccactaaaaaaaataattagccataaatacgggtacccgtgttaagtctagaacttgaatctatgtggacttatttcactataaagagcctaaccaattaaattaagttacattcactttgcttaaggacatataattacacatactgccctcttcccatcaaatattttaaaaacttctatttttataaagtagtaggtcatacttttatctttaaggacttacttcttccatttcatattataagactttctaatattgcccacattcatatatatgttaatgaatctagacatatatacgtgtatagattcattagcatccatatgaatatggataatgctagaaagtcttataatatgaaacagagggagtatatggtaaccaacgaaacatctccttaaattattttagaaagcaagttttagtaaaattggtttgtcttgaaacttataagctcaaaccaacaagttatagtatccgtaacaatgccttcggtagtgtacggtgatagcacctttaaaaaatcttagtgctagtattattattcttttccaattttggatttttggtttccgtttgcacgctccataagttcctaaatagtgtgtttcctaaaatacttattttaaagcaactttttaattttgtagtaatttatttatttgtttgtgtccttaaacatatactactcccgtctaaaaaaatccaatgattggattttttttttctttaccaagggggtagctatcaaaaatcagataattcatctgtccattaatttcagctatctcatagggttattatatatacttcttctatccataaattaaatataagcatttaaagtgttttaaaattatctataaatatacaacctgctatacgtacgactcacgtcctactgtctcacgtctaccaatcactgagcttgttatcgtgtgggccagacaagcaacacctacttcctccgtccctaaaaccaacctagtactaaatgtgaccctaggactatgaatctagatacacatatatccagatttatcatattagaatatgtcatatctgattctagattcgttttttctggatagagggagtatgcatttagtacatgcatacggaatactaggttgtaggagttgtacataaagattggacgcataggagtatatcatttctcattcttatttttttcattttaacccgatcactctttcaccccaaccattctcactaaagtttttcacctcatccttaatctctttaaaataaacccgaaactagaaatactcatatatatatatatatatatatatatatatatatatcgggtggagggaggagaaatagtattatcttatttataaatatatactagttttttaatgtcctgtcagttagggcctgtttggcacagctccaccccttctagagctggagctcagccaaacagtttcagtaccaccaaaactgagagtggagttgggtggagctatctcacatctcacaaaatgtcctagagttgtggagctgggtttaggcagctccacaactccactccagactcaattcctggagcaatatttaggagttagagctgtaccaaacagaccattagacaatcggtcttgctctatatgattcagctagtgaagtcttttataatttgttttctctcaggaatacttcgtctttgttaattagcgcagttagtgaattacacatcactcattttgcaaaagtaagaaaaaagaattacacagcatatatcactcgcaattttctccatcttagtcagtcattaatattttgacagaattattggtcgatgatatgacgcaagttggtactatactccggccggctgctagggttttccggttactggccaactccaagccgccatggcggcccccgccatgagagatcgacagtgacagctagctagctggagctagcacgccggcaacggtggcccccgccggcgacagatgcatccgccgttccaggacgccgtacgtctcgatcgatcgatctcactccggcggccggtgacgaagacgaagggccggttcaagttgaaccaaactgattactactattacactgaaaactgacgcacacgtgatatggatccggccacgaagaaattaatcgcgttacaaacggacaaattttcctacattgataattaagtactagtacgtacagggttgtttatttagttgcgctgttagtttaatttgctgcttaattattaattaatcgtcacacgtggctgttcctcttgtctcttgtgacgactgatctactactagcaacgtagctagcgaagccattcccaattcaaaatactagaacatagacggtgtttcctgaaattggagagaagtttagaaaaagttaatagtttagaaaaaaagttaggagtttatgtgagtagaaaagttttggatgtgatgtgatgtgatggaaagttggaagtttgggggaagtttggtgtgaactaacataccatagttttcataaactttacatcataaaaaaaaactatcactagatactactctttcaatgcaaacaccacttttttatatttaaatttaataatactacttatctcacatgatatgtagaaactatgtctcatacaagacctagttttcttctcttttctcatttattcatttgtcacatcatctttcatcggtagcagcttatttaatgctatggtcactattctagtcattgggttgggaatgagggtgtgttcagttcacgtcaaaattggaggtttgattgaaattgaagtaatgtgatggaaaagttagaagtttgtgtgtgtaagctgagtttccaaactttatcttccaacttttaactttttcaacttttccatcacatcgttctaatttcaacaaacttctaattttaacgtaaaactaaatatacctaaagttttgatgtgatagaaaagttaaaaattcaatgaaaaagttggaactaaaccaggcctgacctgatatgacttgatttgcaggcgctcctgacctgatgcaacgtacctgctccaattaaatgcaaacagtgttcgtacttcgtactactacgatcccatcagctggtaggagtaccggcccgttgtttgcaatactcccctccgaacaaaataacttatactatttttttcctcaaaatatagcaacttgaaattaaataggacaaatcctaatcaaataaatatggctaagagagtgtgtagattcgttaaactatcggccgtcatctttccgcttatgcttattaagtcaaaatttaaactttcgactttaaaattagagttgatgtaggggagttttcatcgaaatttatttttcagcatttacttttatgtcgctaaaaatacatatataaaatttttattcacaaattaattttttgtttgcaaatatatcgtttcgcttatttgctgaataagcgaaacgatggagccatatgatatatcccatccaatactagattgttatattttgggacgaaggtaataactttttttacagagagagtatgttattgtgtatttccctcgtttcataaaaacaaacctacataatgtaacacatcctttacatcatagtgctatgaatttagataataatttattcacatttataatattatgatgtgcgacatcttatatcatttattttttatgggacgaagggagtgtgctaaattaaatacaacatgtctcaaaacatatctatatagcgtttgatttatgcacggagtatataaagtgaagtggtggatggttgaaatttgttgagatgagaagttttttttttgtcgaccagacggtgtgataattcattgtatagagtaggaaaaaaattacagagcagacaagaaagaaagaaagaaatgataaagatagctgctacttctatagttctatgtactccccccgtcccataaaaaaaccaacctagtaccgaatgtgcacaatctagtcctacgaatctggacatacatctgtctaaatttataggatgtactaggacgtgtcacattcggtcttaaattcattttttatggaacgggggagtacctcggagcccgaaattaaatactgatttaaaaatgtttttactaatatttgtgtactaatttggaacttacgtttggaaaaataagcgataaatttgtccctcgatcgactctcaaggttattgctaaaaaaaaattttggtactagtaaacctatacaccaatattccagtacttcggaagctaatctttatattgctgacttggaaaatagtagtagtatgattcatcagaatctagctgcatccgactgcatgtagcagtaatatatattttcttcatgtaataatataatttttctcatggattatcttgaaatgggacaaaggaatgtttcctactgttcctttctaagttggcgcgttccatttgacttcacgctgcatatacgctctttctcgaggacaaccagttgaatagtagtaatactcctgtcatgaaattgtactcttgattaaactaatccagtatattaaccatgttaaccactgctagttaaataaatcaagagacgtcagacgaataacagtaacaagcagtacagacgcaagcaatctctctccccatttcaagttccaacgccagctagctgtagaaattctatgcatatgctgtgggcctatttggtttccatggacttatttcaagtccctaagttcctatcacatcggatgtttagacactaatttagattattaaatatatactaattacaaaacctatttcataaccttggactaattcgcgagacgaatcttttgagtctaattacgccatgattttgacaatgtgatgctacagtaaacttttgataattatagattaattaggtttaaaaaattcgtctcgcggattagctctcatttataaaattagtttttttactagtctatgtttaatactttaaattagcgtccaaacacccgatgtgacatgggctaaaaagttttaggcccatataaacaccccctgtattctctccagtggtaaaaagaaggggaacgagatatcgccgtccaaattaaattgcatttgttttggccatatatgcaaattaggccctgtttagatagaactagagtttttaagtccctatcacatcggatgtttgaaaattaattataaatattaaacgtagactattaataaaacccatccataatcttggactaattcgcgagacgaatctattgagcctaattaatctatgattagactatatgatgctacagtaaacattctctaattatggattaattaggcttaaaaaatttgtcttgcaaattagctttcatttatgtaattagttttgtaagtagtctatatttaatactctaaattaatgtctaaatatagagactaaaattaagtccctggatctaaacaccaccttatagttggaagtaacaaaaactacgagtaaaattcttacagtactataaacggacttaggttacgttggagagtgttggagaggaggagaaagaagctgattggaaaatacgaaatatgaggttagccactagtatataattaattgattatttaattatcttaaaggtaaaaatgattaatatgatttttaaaataactatttatagaaatatttttgaaaaaaaatatatggtttagcagtttaggatgtgaagtgcgcgaaaaacgaaggacatatttctcgccattgtgcttcaaatggacacgctcttagtgtagctcggcccgttactagtttccgcttgtggagaaacctgtcaatccgaatttaagttataggcttagtacatgtgcttgtatttatgattattttttttttctagacaacgaacatgttgataacaaggtaataattttgatgactcatcgaaaacaatatgttagcctagtcattaaagttgattgtgaaggtagttgtgaaggttttcaagtaccgagtttgatttgtgaagttgagaacctttccctcctagatgtaaaacgaaatagctctttagcacataattaattaaatattagctaaaaaacttgaaaactaaattagtatgattttttaaaaaaacaaaccatttaatagctcgaaaagcgtgcacgtaaaaagttgaaggtgaggttaggaaaagtcatccccgaactctacctaatttttttcttcagcaataataaaaattgcagattttagcaactaacaaataccactttattcataaggataacatcacagttcacatatcactttgtctcatactttgagacaatttccaggtaatttttcaaaaattttctgaccgattcggcttcctgacaatgggtagtggccttgttgtatctgtttcagttttcgacaaaaaaagtttcaaatttgttttcgcttccgaaaattttcaaacaatgctttccgtttcttacaagaaaacatagatatttttatagttccaaatttgtcttaccaccttcgtcccaaaataaattcatttttcacccattccacacgtagcaatacaaaatcaaaaaagactaaaatacccctactttatcaaatcacaatataattattcctcattttatcttctctcaatacaactaatccctactttcacaaattgcaatgcaatggttgctctaaaaatgaacttattttaagacaaacgaaaggagctaaaaattaatttaatatgagacggagaaagtatatatctatttctctacctacttactcacctcacccaattgtaattttccatcattcaattccatctcctttggctcccatcttttgccctccaactaataagccgttaacaaatttgatttttaaaacttgattttgatggtcttttttttaatcaaagtttatatttcccctttggcttttaaatcactaagaacacatataaagttttatccataaattactcttattgttaataaattgtacggcttataatcaatcttaggcgaatcgataacacaacccttcatcaatcctctaaaattatttatatttagagacaagtgagtactctttctttctgtttcataaaaaaaacaacttttagccgggaacccaaaaattagttttgcaggggacaaggggagtactccctttgtaaaaaaaaatatcaacctcgcactataatgtgatatattttactacaaagaatctgatatagtatgttgagattcattatattaggatatatcgtatcctagtgcgaggttggttttttaggaagcggtagattttaagatggcatgagtgccgcgtcttttctatcttgttcgttcaatagtctgacaactctactaaaacactgttctttctaagttcatggaggtatggaatattcgcattacacttataaaaaatgatttactaaaaaatttctataaattaataatgtaaaattatttagataacgtacttttcacctactatttgctaatattataatctataaattttaatcaatccagcacacaggctcaaaatcagtaaccaataaccattaacacgaatcacctcatcgcacgtttaacatcagatcgcattgaaaaattaccatttggaggaatacataatttcacaccagaattgcacatcaaccagccacgaaaaggactctttgtgagcttgaggaaagggaagtgtgccgactctttgggctccttggctccacacacccacgtgagatcgatggggacctttgcacagatttttcctcgccggagaggtagctatctcctcctcctgtttcttccaaattcatcttccacgacattgccaaccaaagttcaatgaacatgcatggacgatgtcaccgtgcagatacagtgctctccttttcgtggatgtatacaaaagcagatcaccgttatgatatatctgcgtcttcgtgtcgcgacgacacttcccaagacataatatctgagccttataaattttcggaggaaatagtttttgtcctcatggatagggaacatttcataggcatatcacatcggatcaaataattaggaggtgcatatagacatatggacaacatattcatttaattaaggaggaggatattttgtaggtcatggtatgaagtactcccccgtccctaaatataagagattttggttggatgcgacacattctagtacgatgtatttggacagtatatagctgtgttcggaactgttgcttcccagctccaccgtctcgtcttccgcgtacacgttttttaaactgctaaacagtgtgttctttgcaaaaagtttctatacgaaagttactttaaaaaatcatattgatccatttttgaaaaaaactaaacttaattaatcacgtgctaatgagccgcttcgttttctgtgcgcactgtgcttgttgggaacccatggttctaaacacagctatagaccttattatcacggtaatattcagggtttgccacctatggtggatttttagttttttttaaccttttggtttttaatttataaaatacactatcctgaaacttatttctaaatctgaactttttgtacacgccactccaccagatgtggcaaaacaacattgtcatgtcacgcacaatgcacatgctagtgttgttttgccacatcaacttaggctgtgttcggcatcactttttactaacccatctccctcgtttttcgcgtacacgcttttcaaactgctaaacggtaagtttttgcaaaaagtttctatacgaaagttgcttaaaaaaatcaaattaatccatttttgaaaaaaagctaatacttaattaatcacgtgctaatggattactccgtttttcgtgcatacttgtccggttgggaaactaatgccaaacacagccttagctggtgtaacgaagaataacgctatcacgctaaagaggtagctatggaaaaaaattgttccaccatgctagcaagaatgtcatgattaaaaggtttagatttaaaaataagtttttagaatatagttttaaaatgaaaaatgataaaaaaaagattaaaaaatttctcgtatggtggcgtttcatgattcttggttccacgtatctatggtatctatgacatatgggtactaatcccacaaggcataaacacattaattatagggttcggagctttatgtacaacctctaaatccacatctttaacttgtgaggaaggattaaaaagaagtataatcaggcactttatgtacaacctctaaatccacagctttaacttagtgatttcatcatctccgttactatgtctgggaaagacagacaacttataatcaggccaagaaaattaagaataaaaataaagagggttaagttggtacgagttgtaagatgaattatatttaaagaaacaaattcatataaattgtgcatattttgcaaagcgagtgtattcagttagattccttatggtgtaaccagctcacccaattttaagattttagatttgatatgggtgttcgcgtttatgattaattattcttttagtgatagacccatcgatgtaccgaactagtcagttttaagatataccgaactagtcttttggagtattttttttattttttagactttttattttttttaattttattaatagtcctttccaaaaagtatgacactggcgtggctaaaaggttcagtttttggaaatatttttttaaaccatctataaaaaaattttcaaaaaaaatctctttcagatgtgctcataggataggatagagtatgcatgtgtgcttgcattgtgtttttttttaaagaaaatattgtacgtatttttcattttaatgggaaccagaataggagtacgagtgtacaacctccactagacaagggaggaccgaagtacttaagccaagtgcatataggggttgagaaggaccaaaggctaggcgcttaggttgatggagaggcttcagagtgccacccgcgtgccattttgtcggtgaagcgtactatttgcgttgccagaaaatggtgaccacggtgccatgcaaaatcgtcaatctagtatatagatgtctcattctcacgcattcatcagacatgtgcgtggatgcatgttaagcttctcaatttgtcgtgtggaagactgaaaagaaattaaactcagcagattttatggcaattctgcttggagggcttttcttttttcttttttggctgcataagacaagacaaggaagatacaccaccgatatagtgaaaagtaattttaggataagacttttttacacttgtactcgtggcggttaaaaaatcaaggctgagtttcaaattcgacaaaggaaaccataattaattctaaagttcaaaattagcaatggcttttaagctcaaacaaacggggcaactctattacgatccttgattgggagtacttggtagatatatgcaaaaatgaaggaagaaggaaaaaaaacatggtggatgtttgcgggagcagagtagtacagtttctattttacagctcgagctcatcctaaaaacctctgtatagttgtagctgcagtttttctaaaatattttttactactatattcaataaaattgacatattttgtgttagttcgttaaaaaatgcatgtgcttgtacgatactgtgaaataggataaattaattcatgcaaaactgtatttgtgcaggtggtatagtttgcttacatacctagcttctctttgtttaacttggagtatttgttggaagtaggaactgcaaccggatctggggcaacaaatagtatagcagacctttgctctcatagattctgacaaagacatttacaagcatttccttccaatttacgatgccgcagcaggaatccacaacttctattccggtacaaaacaatttactttgatttcattttgtttctttcgagatggttggacacgtgttcatcctgtttatttctgcaaaataagggctcaacaggtactccataaaatatgaaaatagcaccaaccaagacccatatcatcaggacaatgacaacacaacagcatttcttaaattaattaacatcgcaattagttctttgttccatgtgcttgtgctctcgtgtgtcccagcactacgcccatgttctgatcgttcgaagaggacaaggataccactacaacggtagcttcaaaacgcatgagacaagatgaaaaagcgtttgattaagcatgttaacgtacgtgcgtgtgtgtgctgtgtgagcatggaatttgctcggttttagtgtaagctcctcggttattgcagcttaagagaaaaggactaatcagggtgttgttaaatgctgagatgagtacctgtgaatcgtgtgagatgctgaagccaacaaacaaaacgggacggacatgcaccggtcaagaatcttgaatttggggtttcaaaaattggcatcgaacagaacaattggagatggtgtgtggtgcatgtacgaagcagcagcattgaaaaacaccactggggagaagatgtgtttgctgggtgatattctcagttgaagtagtggccgttctacagcctgacatgaaagctgtaaatgttagtaggtcccaagcattattagatgacactaaaagtacgaactaaaatttgggaggcaagcagcacagcttaaaagccaaaagtacacacttttcttatctaaaaagtactaaatgtatggaacatttccagttatttgacagatgctgtaaaacagtggtcaaatttctaaaactttgaatgctctgttggaaaaacatatatatatatatctataaatgcattatgcaaatgataggatattagtgattgacttccatacttccatattgttactttgctcgtacagggaaaaaaactcaaacgtgtgtaccagcactaaatcaattgtcaatgtgtctaaaaagtcaacataagaaaaaaggaggtatagtggaagcatacagagcaaaacaaatatgtgtgctgactagtatctgctacatcactacgtatatgtatgagatcagattggtaggtagactgtttaaccttcctaaatatcctgttcattttcaggactggattagatgccgatttctcatgccaattccagatttatttggccattaaaaaatggcatcctcccttggatgtggagagtgagagaggaggcattgtaccttagttttgattaactaaagcaaaagaggttccatgatcaagtaggcagattccataaggacgttgtaattcataactcaccaacacagagtaattgttcagtaaatatacaaggaacttgcaagcagattgcaaactcaaggaaacttctaggaaaattgcagttaactttttgctggaacaactcactagaactagattttcagcatcgtcaggtttcatgtgacacattgctttgttagctgtctgtctcttgcatgctaaatttcagtttcaaaacattggatagaacatcttatcagtagctgcaaaattttccagatgtaagaacgatgtaaaacatgcaagaacagtgcacttatatagttgatgggctctcatattccatagcagaataggctcaagttatcgaccatggccctcatgaagacaggtttatcaagattgcaatgccaaggggtgatccaacacaattacacaagttgctatcgatagtacgacgccaatatgcaaagcaaaacagatgaagctgtagtcacaatcaattcctggcataagatagccaccaattagttttacttcacctgaaaacaacagcaacaatattcactagcattcttccattacatgttctccaccagaaaaagagattgcacttattgcttactccagtattcttattagagtttttaacttttagcctccagcgaaaaaatattattttcaggaggcttgtctgtctttttaaaaacactaacaactttccagtttctactttatgacagaagtgaaattttttaagtgtgtaacttagcaaatgggagaaaatttaagtgtggaacttatcagcttaatggcctcatcttttcgcttatgcttatgcttatcagtcaaaatttgaattttcaaacttaaatttggatttgattttggggtttttttaacgaagtttatttttcagcctttgcttttagatcgctaagaacacgtatataaaagttctattcacacattatttttcgtttgcaaatatgccgtttcgcttattccccgaataagcgaaacaatggggctgtaaatgtgatcttggtaacaagaatgaatataaaaatgtggcactctgatccaataaaataatcccaaacaacatcagatatgctcaagcataacatacctggaagttataaacaacagatggaatatactgcccaagaaactgagaaaaattggctagcccagtgtagccctgaaaaggataaaacattagggtgaggatacgaatactgagaaacagtagagaaaactggcagataaaccaatagtttagcatctagatagcactgtatccgaacaacccactaaccagggatacagcaagtattgatccaagtaccaaacccaaactacggagtactcgttttgccatgtgtatgccacgaccttcaacctcaccatactcctgccacaaacattttatttcaatattatatttaacaattaagactacaaataataaatgtagcgcaccagcacagatacaaggataaatggtttaatattccaaactttggacaatatctacttgttccgaacgatgcatcatttaatatattatttttgaacctaacagcaggagggctgccgctttgtattaattagcatgcaagaaacaaagagcaaatccttttaaagactttagaaaacaaacgcatactgactacctggtaaacaaaagctctaagcaggacgcagccacccaagagcaggcatgtacacccctgttctttaattttgtgagcaggggctgatagagtcaatcgacattttttttaaaaaaaaagttgatacaggcatcatttggttaaacttgttgtatatgtagttttgtgaatttttctctggaagcttcaccacttctgtattgctatcgttatttacatatagatgagtagatgggcctctagctaatgggccagcacacaaacacacacacactattctatttacagcccaacagtatacacatccatctttagagtaaaatgtgtatcttcatgactaaaagaaattgtagcaaactcaaaagaagggtaccctcatgcaatgctttccccaatcaaggggatgccacattatctatccggaacattagctagacttcttctgtgattctgtcaagctgaactgcaaagctaaaaactagtgaccaagtaatctaagatccttaatacaagacaagcatgcacttatgtaactttgtaactaaaaaaggagccacatatatcaaatatatgcattcccaactcatgaaaagtaagaattccatcccatctaatagctccatttccctagtgtaccttttgctcttatcatatctgaactacaatagagtaaagcaaactgaaccaatttgattatttgatatgtcattcctgtaagtgcagggattccatagaaaatgaaaagggaacagcaaataaaattatttagtaaaccgcctcacattgtatataggagtgctagctgactcggtagccttcagtttgtcaagtattcgatagaaataggcaaaacacaaaaactgcatgggcttccagtctgcatggcccatggtagatatatacatgatctgcaaaaaaaaaaggataaaaaaatgtccattaataaagtaccttttctccatacacaaaatgacttgcccaagataggaagtttggcaagctgatgattaaaaaaatcctatgtgaaataatgctgaaattcaaattattttctattgtgtaatttcaagtttaacaccaatgcatataacaaagttgagtacagaggaacaatccactgggattcataaaacattgtgtttgattaaaaacagtaattattaatatttcaatgtggtacttgggatgatacagaaaataattttcttacaaatgttgctgatattgccatattaatgcgcaggtccttcccagtggatcttgagtatctgcaagatgatcatgatgatgatcatgaaatggcaatagcatagcactaaagctaacaaagaagtggataggtgttaatgtgtgatgatatttccagtggcccagagttttaatatttggaactaacatgtgaataatcaacagttatgctagagaaaagttaaaatttaaaaacaataagggcatgggcattggatcatcaagttttgctagagaactgcattaagtaacaaggatgcccaattcatggatgcaggattgcagtcaagaattaagtctgttaagtctcctaagattcatagtgtatagatgcattggaaaacaaaatgtacacagtatatattgaagaagcacatgaagagattggttacaaaatgtgaactgtaaggtacctaggcccccaaggaaccactggttgattatcagcatatttaatgtcctttgacacctaatgttcagaaagagaactgaataatcagtgaaagaaaacatcagaatagagaattatcatgagactcatttcattattagccatatgttggaaggatcctcttaaacatggcaaccgacagaggtctcatgaagttcactccagtaaggagactagaagagtcgatgcaagataagtcatctaagatctccgtcaaattcaccatgctaaagtaaccatcaagcttaatagcaggcaatgcgttgcttggttagatatctctgcatctcaaactacgtcgctcaacagtaaatatcagtatgtgtttattttagcatgaaggaatttaaccaaggagtaccaaacgaatggtaacagtctgttaccatatacagaacaaatcagttttgcaattacaaatcaattttgtgaatatgaatcctcatatctaactctaattggatacatatgccaaattgccgactgcatgggattgaacagtgctaccgtaaacggtggagcacatacaaaaaaagggcagtaacgcgcaagtgcaaactttgttgctgtagaccatgcatcatcaatgtgacaaggaaataatagtagagagtaacctggattgatccatatgccaccccattcttccggttctgaagctgctccatcatgaccatatcgtatgccctctctaactgaaattcgacaaaactccatcactcatcaatacattaacaacacaacagtaaccaaattctgaacccccatgacccaaaaccaccttgaacaggtgctcggcatctttgttgctctcggcatcctttcgcctccgcttataggccatcttcacctggtcgaacccatcaagtggactgatccccaaaatctaacaaacagggaccaaccatcacaacaagaccaggagccacatccaatcactgaatcacctgatcaccaacgaaggctgatcctaaacatgaacatagccactcccaataacccaatcattctacctcgtatggattctcactgtccccggcgccaaactgcgcgctccccgccgccgccgatgcagccgcaacaacaccacctccaccgcgcttcgccggcaccgcagataacctgtttttttttcctcatcgtgatttaccgtgaattaacaactgcttgtaaaaaaaaaaaaaagcaaacccccaccgacaactaataaagtgtgcgaaaccgacgaactctaccaacgttgggctacgatttcacgaggcacggaaccaattattccaacaacgcgggcgtaatttacctagcggggcgcgcgacgacaatgggggcaacccaatgaggcaggaagacctggcgaggggaggaggaggaaagactccggcggaggaagaggctcgcagccgccgta

SEQ ID NO: 94014 - DNA, 1932 bp, Oryza sativa
  unsure (1)..(1932): unsure at all n locations
cctgataattcttctgatttggatgagatattggctgacgaagaaacagacgaggaaatgttttttcgtggtcccacacggatgccaccgcgacctacccgagatgaggacaaacctgtgctgactccaaaaagagataggtaaatagggtaattttggtatgtttcattagtcgaaatatgaaggcttgatctatttgttcattgatttgcacaggcaatggcaagctaatgattttgggggcaacattcgggtccccactggcatcctgaccgtgcttattaagcattttttccctggcattgtcaagtttaaaggaagagatgagccagcatggagttggaaacattacaggattgcaccggacgatccagaaagcgctgtactgaatcgcttgccaagccgtctccatcgtgttgaggaagatttctgggtttgttttagagcattaccttctccaatatgaagtacactatgcattttattgtgtcttcagttttcatagtttacggccaatttgtactgtacaatagtaaagtatcttaataccacacttttcaatgtcaaacaggctaactttttgtagttgcagctttacttcaggtgggcagagggaacggaacaagctgctagaaaggttgtccgcaattgtatcaagcgccttttttcgcacctgatttatgaaactcgtatcctggctgtgctcaattaccaaaggaacatcttaaaggtagaaacttctcgggatattgcttgcaggacatatctaacagaagaagagtacctacaggtgctatggttgttcattgataatttgttgtcatctactgatcatattagtaattaataaatctgtgcttctcctataggtagaaccatggtggttcctaaaggcaaaaaatgagtggcgggagttgatacgattgaagtggtgtaatcctgaatggcaggctagctcacatgctcataggatacggagggagaaaatgacatggccatctcaccgccaaggcagtgctaacttgagtcgtttccaaaaaaatttgttatgtgcatctatgttgaaacatgtagcagatcatgcacagcagatcatggtataatatatatgggtataatatatatggtacccatgttctgttttaggagaagaagaaaaggcggatagtgtctcaaatggaggcctacacagaaggaaggggggaatttggagaggatggaccattcagatgtaacacgcatgtaactgggaagcttgtaagtgctgaatatttagtggtagtttatcatttgtgcatgagtactaatacactatttgatctgactgtagnaggcctataatgaagcttatgttcagctgcatggagcagaaagtgattggcgcaattctcccattgatccaatggctgtgcacatggctggtggtggaaagaaacatggtcgattcatgatcggtgatgggctcattgactcatcagcaatctttggtgacagttcacttgatgatccacgtcctcgcagaagactgtgaacagatcctgacaacacaaaccaaattgaagaccttgagcggcaactacaagaggagcgcgaggcaagggaacgagagcgtgaagaaagggagcgtgagaaggagagggagcggcaggagcgggagcaggagaaggagcgtgagtgtgaagagagggcacgggagaaggagcaggatagaaaggagagggagctggagcgcaaggaaagggagttggaaaagatagcgtttgaacagaaatcatcgttctttgaagttgctttaagagtaagtggttatgggatccatctagtagtgttttcattatttgagggcttgaattctgtgatggtcgcactaactagtgtacatgtgaaatggattgcacgctatacaacttaagctgaacattgacttacctt

SEQ ID NO: 94015 - DNA, 531 bp, Oryza sativa
gctcggtacccatgtgaaacttccacaagtagttgctgacgctgtcaatagatatctcaaacaagagatattataatgaaacacctttgcaaatttggttggaggccagcatatactgtgtgggtgtatcatggtgagacatatcctgcacgtcaaagcgatatatgccaaagcactgaagatgaagatagggtggcagagattgatcggatggatgagatgatagatgatgtccatgatgcttatgtctcagttgaggaggaagatccagagcctacagcgcaagctttttttcaaatgctgtctgcagcaactcaacctcttcacgaacacacacaagtatcacaacttgatgctatcacaccactactagctgtcaagtctcaatatgctatatcaaatgctggatttgatgcccctttaaatgtgatatgtgctcttcttccacaaaggcacaaactaccagcaaacttgtatgaggcaaaaaaagatcttagtgcattgaacatgccatatgaaaaagatagatgc

SEQ ID NO: 94016 - DNA, 2168 bp, Oryza sativa
tgtttgccatctctataggatcaaactgttttgcgcaaagtttgcgataaaagaggctcacctctgctaacacttcccacacatgagttggcaagtattcacggaacatgactggaaagatacgttccatcattatgtggtaatcatgggctttataacccattgatccgcatggttttcaaattcactcctctccttaggttcgacccatagccatcagggaatttcaatgtttgaaaccattctaatacttccttcttctgagctctattcaagcaaaagtcagctcttggctttacccactgactagatgcatgtttttggaccaggttcaattcaggtctgttacaaagtgctgcttgatcaaggcgagccttgacattgtccttcgtttggtctggaatgtcaaagcaagtattgaaaattgcctcaacgacattcttttcattgtgcatgacatcgatgttatgaggaagtactagtttgtgaaagtacgggagtctccacaaactagatatatgtgtccaatggtgatccttgccatagcctacaaacttatctccattagcagcaaggacaaggttatctaaccgggcacggatctcttgacctgagagacgaagaggtggttcattgctaactgtagtgtttgatagaaaagaatttgaatcacttctaaagctatgatcaattgggaggaactggcgatgacaatcaaagaatgagtactttccaccaaacttcaacctttttccttggagtgcctccatacatgttgggcatggcatctttccatgcacacaccaaccggaaaatataccatatgctggaaggtcatggatagaataaagaaatgagactcgcatgatgaaattcgtcttggtggcacgatcatatgtcaacacaccttgctgccaagcatgtataagttcatcaactaagggttccatgaatacactaatgtgtttgccaggataatttggcctaggaattatcaaggtaaggaacatgttgtgctggcgcatgcaaacaccaggtggaaggtttaaaggaatgacaaacataggccagcaagtgtacgaagaagaacccataccaaatggacagaacccatctgttgctattgctattctaacattgcgggcttccattgaaagcctgtgaagtccctatcaaatttcttccaggcctcaccatcagctgggtgtacaatcttgtcagtatggtaccgatgaccattcttgtgccatgtcatttgcttggcctgcgattcagacatgtacagccgctgaattcttgggatgaatggaagataacgaagtaccttcttggcaacagttaattgtttcttgtgaccattactgtcttcaacctccacatacctactctctccacaattatcacagtgtgtcttctgcgtattctctttcctaaagagcatgcaatttttagggcatgcatctatcttctcatatggcatgttcaatgcactaagaactttctttgcctcatacaagtttgctggtagtttgtgcccttgtgggaggagagcacatatcacatttaaaagtgcatcaaatccagcaattgatatagcatattgagacttgacagctagtagtcgtgtgatagcatcaagttgtgatacctgtgtgtgttcgtggagaggttgagttgctgcagacagcatttgaaaaaaagcttgcgctgtaggctctggatcttcctcctcaactgagacataagcatcatggacatcatctatcatctcatccatccgatcaatctctgccaccctatcttcatcttcagtgctttggcatatatcgctttgacgtgcaggatatgtctcaccatgatacacccacacagtatatgctggcctgaaaccaaatttgcaaaggtgtttcattatcatatctcttgtttgaggacgtgtgttgttgcagtagttacatggacacaacacaccagcacgtcctgtctccctgctgaatgccttgtcaagaaattatgtagtcttcgatatccactcagcggtaacctcgccacgctttcgacggcccttgtacatccaactgcgatcagtttccattgtacctagttatgacaaagtgacagaataaatttatgttaggaaatgtccttctattcatgaaaggttcaag

SEQ ID NO: 94017 - DNA, 1115 bp, Oryza sativa
ccgctgtagctcaagtcggcaacaacagtatcatcatcagtagaaacactatttagtccccctttgattcaaaggaaattcataggaattttagagaatttcattcctataggaatttttcctatatagccctttgaattaaaggaatggatcttatgtaatcctatgaaattcctatggaatgtctaatgccatgtaagttttggaggaaatctagcatgaggtagaacctcatggaaacttccctttcagtctttatctctcctctaattcctgtatttttcctgtggtccaatcaaacggtctgtcagggttatggataccacatacctaatagtagttgactaaatctcggcaggacccaccacataccatgtcctatacggaaacaacctacggatataggaggtgttccggataaggaaagacaaccagagttctacatggaaacgacaaggactactcggattgtatccatattggttttcctagttctacttggacaaggggacacctatgggtataaatataagaccccctagaaggagacgaccacctcaatagacacctaccacaatcaacatacacggaacaatagaagccacaagccaatacaagccaacatacgccaagacaagacgccggaatatcgacttcagtaataagcacggctagtcccctacagtgtctccggatattgtcaggagagacgaaagcgttatctctgatctcgtcgggcacgaactcgaggaggaagactaccttgttgtcgactacaagtcagaccttcagaccgccatgtcgacaacagttagataggctaccccaaatattgtactggtgtgattatggtgaataagagcaataccggctttggccaacaggatgtagggttattacctgaaaattcaggggcccgaacctgtataaaaatcctcgtctccatctcttttacctcagtctcacgtataccctaataccaatgatccccataccatgcaaataccggaatcgcgacatcaaacgtcgacacggtcattcctatgtttttcttgtgttttacaatcctcagttttacacttacatttctatcaaaatcctacatttttcctatt

SEQ ID NO: 94018 - DNA, 727 bp, Oryza sativa
tctcctacctccagctccatccccaaccgccgccatggccaccaaatcctcccacgtcgctgcctctcccgcgcgactccctctcccgcgcgtgcgtggacgcggtcgtcgcccacgtccgcgccgtttccccccactctccccgcaaaatccggccacgtcgccgcctcccgcatctctctctcctcccacgtcgccagccggtttctacctctctcgggctcgatcccgcctcccctcccctataaaaacattccccgcacctccctctccattttcccctctctcccgagccctcccgtgcatgaaaaccaccccgccaccgtcgcacctcccgccgccgctcgccgacgaccctccagccggtcgccacagccgctcccaccaccgtcgttccgcgcgaccgccaccagcggcttcgccgcgtcgtgccacaccccggcgtccgctccatttcccctccccacctccgaagtaccgtcgccacgtgcaccacctccttccaccgaagccgccgactccgccggtcctagccaccccaagtcgcgctgtcgccgccgctcgcttcacagtgccgaggagcaccttggccgccgcttttcacggccgggatcccgccggaacacggttcccctcgcgccggtacttccggccgccgtctgccggttctcgctcacggaacgccgccggggccgcctttccgccttcatcccgaggagcgccgacg

SEQ ID NO: 94019 - DNA, 541 bp, Oryza sativa
tgacggagcgtggggctcctcactgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctatgttctggtggatctgtgtgtgaaggaatccagcgagccggagagcgagagagagttcaggctctagaacccctttttcttctcttctcttctccccttctaggcctgggcctcctttttatctggtcaggggtcaccacatgggcctctagctgcctaagaaaggaaacatgctttttacaatgagggctagtctacagccggaagtgacctctgacaagcagagcacacgcctcctgcccccctcgccagctttcccggtggacgcccatttcaaccttcattcaatggccagcgacttccttgccatgcttgcgctgaagcctggactggatctgaccgggactgacataccaactc

SEQ ID NO: 94020 - DNA, 2468 bp, Oryza sativa
agacaagttgcgaaggagaagacgtttggcttataccccagttgagctgcctgtgggagtggagccggagcttcgctagattttattttccgctgcagttttcttcttggtgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgagcgtgacaaccgagcagtccggaatacatcccacagcagaaatagataaagcagcggcatgccattgccacaggcaacgaccgtaactaagacctattgagcgccatcgtctgcatcaccctcctggtaataggcatagggatcctccgaagcttcatctccggcctctgattaagtttatatttgcaagggtgagtaccaaccgtactcagcaagccaccacatcaacaatgcacatgataggggtatttcaaaggatggctatggttcttttgcgcaaagcaagttttctaattcttttcacaagcctaagacctagcattgactgatcaaattttagtactagtgtttatatttaaacaacgatggttctgtccatcatccattgtgatcccaaggatagcttcccgccattgagtcgtcatagttttctgagaacgtccaccttcccccttctcaggaagtggctccaacagcataaaattcatcatgcaataacccttcccacacaagttaagaatttagagtctagccaagtataatacatgtcccggtgctcaataaccgcgagcacggctaatcgaatagatttgttttactcacactgcagtggatgtacactttacccacactccgcgactgcccaacacatgagcctcgtcccaacacatgagacgtatcacggcaaagcttttcgataacctcgcattggcagtacccgctccatgaacttttcatcctcatgcactctaggtgtacacagtttctagcagtgagaggagttctggcgcaccgggaagggaagactcacacacatgcattaagttataattatgtttaaattatcacatggcagtcctaccaatggtgacaccactgtagagcccctgccttacacatcaagaaaccactatgcatggatactgcctccgctcagctatttactctgctaggtctatccccatacgagaagtgtggttgtacggggtcgtttcatgcttaactttatggctcggtcctcaattgaccggggacggtactagcctttcccagataccacccaatcttaccgtcggccccagtctaaaacaagtgtttaatttcatttctattttcacaattcatgtcatcatatcatggcaatgtggcgctcatgtttccacatgccgcatctcaattaccttcccaaaggtaattgcccaagcatatagtatttgataaaatatgagcatgcatgaatctaaaatagcatttctaagcaattgtcatagttgactaggggctcgtacgtatctatggttacaaagatttaaaggtgaacaataatcaaggcatggcatatttcacaagtgggatgttcatcattgcatgcaatcttatttgtaaacaaaataaattttgcaatcgggatcgacatgctcaaagaatagtgatgacttgccttgctcaaagtcttgcgggtcttgaccttcgctcggatccgcaactccctcgggctctacaagtacgtgcgaagaattgatttgaattccattagaattcaaataaaatccaataaagaccaaattgaaaaacgagcgcgagaggcgaattctatatcaactatattattcgtgaaataggactattcctcaacctatgatattttgtgtctcctaagtaaattcctaagaattcaacgtatttatttagcgcttaaataaatctaatttcttacctaaaattaattactcatagagattaccaaaatataatttaattttgcaattttacgactataattaatctatacttaaataattaattattttaaattttctatttttattaacctccctatcctatttctctttttttttctttctttttctctcctctctttctttttctttctttttctctcctctctttttccttccccttttcttttctttcttcctcctctccctaccggcttctccctttctctctctctcggctttttgcccacccgggcggcggcggcattggacgcgaggggggggggggaaagacggctcaccggcggcggcggcgcaaggcggcaacgctcggcaccacacctggcgcggcgcggtggcttcgaggcgacggcgcggcgcatgaaggcggcggcgcggcggcaccactgcggcggcgcatggagaaggaggagagagggggaaaatggagaggatgggtgtggggtgga

SEQ ID NO: 94021 - DNA, 6341 bp, Oryza sativa
attcaattgttaccaatatggtcgcgataatattttatttatttccaaactcacctaatctttattttaattagttattttgccaatttaattttagtgtttattcctaaataattattccttattcgcgatcggtaaactttgaaaccaaattccaataaaataggcaaataaaatcggcatgatgcaatttattaaaaagtttttgaaggcccatatttctagtgttacaatcgggtggtgtgaacttattcctttgttatggtctgtttgcattgattactctattccttgataccttgggttattataatttgactagttgagctttatatatttgttcagctagatgttagacataattacttagccatgcttagaaacattagcacacaattgggataactaatgtttcactattacttaatgatggatatttaatgatagctcacgatgatcaatcgtgattggttaattaattaatgtgccaactaaaacttgataatggtgtgttgtgagcacatggttttgatggtcgtgctcatgacaattaaggaccggttcacgagtttcggttgtgaaacattaaccgtgccaaccacaagccagaatgggcaacagctggacactttgtataacaaggctcattgcggagcaccagactgagaagtggcggagataagcccacgggggtcgctggggagtccatgcctctggtttttgagggggtgactacaatccaggaacggtgcactgctttgggttaagttatgcgaggggtcttgtcacaactacacaaatggtgacatgttcagcatgggcacatgatgatatggtgacatattgtggagatgtgtcttgtgggtacagtagtacacctctggccagagtaaaactattcgaatagccgtgcccgcggttatgggcgggtcgaacaatgtctttcgtgattagtcccacactactcattaataataatgtggtaattgatggtaattaatttagctcctagtttggaatggtacattcctggtttggagatagatctgtgcagccgggtatggttgttcaggatggttgggcctgtgcagcatgggtgtgctgttcagtgttgattaatattgatgattaattactctattgttttacaattctcaaatgtttgctaaatgctgcttttgcaaatgagccctgtattatgccattctttggtatccttgtgcacttgcatatttgctgtgtggcttgctgagtatgtcatatgctcaccttgcaataatcaatcaaacctcagttgaagacaagttgcgaaggagaagacgtttggcttatacccagttgagctacctatgggagtggagctggagcttcgctagattttattttccgctgcagttttcttcatggtgaggactaagtgcctcttaagtaagtatttatcgttttagttaatttgatgaatctgtatattaaattgtcagtttgtgtaccttagctgatttctggacgaggattttatgcacaaatgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaacttttaatcatacaaagagcatttcagtaattacccacatattaaattaatcattaaatggtctgtttttaatattgttaaatactttgggtctccaagtatgttcaagatttttcttggaattatttgagcataggaattatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcctccctccacactgtttatcttctacctctagcagccgaactgagaccgatttggctcggtttttctcctccaaatctgacctttccccttgtgtttttctaaaattagttgaggggaaatattcctcttatcctcctctatctttatccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtagtcgccggccgagctccatccgcgtcgcgccgccgcctccgccgtcgccgccggtctccgtcaccaccgttaggtgcgcgggagggtggagaagcccggccgctatctccccgaagccgccgaccaccgcagccccgtcgccgccgtcgaccgaagccgcgccgccgctagacctcgtcgccggccgtcgtcgttcgtcgtttggttcgagggtgggtaccgttgggttcgtctcgtcgtcctctacgtgttcttgtcctccaaagtcgcagccgaccatccaatctccggcgaggtcgccatcttggttcggccattgatgaggtgacgtcatcatcgtttttttctttttcctgtttttctaatagattaaatcttcggaaattcataactaaatcatcgtaactcggttttgagtggttcaagttgctaaattcatctaaaatcaggatctacatgtttgtttactttatatgtactgtttatttggtttttattagtcttattcttcgttttgcgtgttagtttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggccaatttgcattgattactttattccttgataccttgggttattataacttgactagttgagctttatatattggttcagctagatattagatatgattgcttagccatgcttagaaacattagcacactattgggataacttatgactcattgtttaatgatggtttaatcgtagctcacgatggttaatcgtgttatgataattaattgataactaaaacttgacaatggtgggttgtgagcacatggttttgaaggtcgtgctcatgacaattaaggaccggttcacgagctactgttatgaaacattaaccgtaccaaccacaagccagcatgggcaacggctttaccttctgtatagcatgattcattgcggggcaccagactgagaagcggcgagaagtccgtgggggtcgctggggagtccatgcctctagttatatttatagagggggtgattatgatccaggaatggtgcactgtggtgagttgtgttgtgcaaagggtattgtcacagcctctattcgggtactttccagtatcgcgacgcatggtagacatgatgaggaggctgtgtcttgtgggtacagtggtacacctctggctagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgttgcagttttcttttcttttgaaagtatgtaacactattattgatgattctgtatattaaattgtcagtttgtgtacctcggctgattcctggacgaggattttatgcacaaataagttcggaaattactagtgaatttctgagcgtgacaacaaactagttcggaaattactagtaaatttctgggcgtgacactaactttgccctttcaaattatctctaatcttttgcagtggaggaggctcttcaaacctaacgatgagatcaagctagaagctatgacagaagaaataaaggtgatgacaggcctacggcatccgagattaggtgtgggttagttggttagcgttagctgttggtgtgttggctttagaggttgttgtcaagtgtttgttcagcttttggtctgctcctaagctccttgctgtggttaagcttactagtcttgttttgctcttgtatggttcgctggcatccccagctgttaaaagacaccgccgatgtggctttcaagtaaaagccaggtctctgaccttttctctaaaaattagcgagacgtagagccgccatgccgaagaagttgcgcacgatggttgtgccggtgtcggagccgatggaatccgcgctgatgagctccaacatcatggagccgaagccgatttccgttgggagttcgtcgtgacagaggcaagcatggataacagcatggagctgaagcccattcccactgcgtgctagccgttggtgaagagagaggggagagaaggcagaggaaggtgatatggcacttacatgtgggccggccccatatgttctttttaacttttttttccgatgactaagatgccacgtcatccaaaacaaatatccatactgccaagggacctcacttgaacggttttgtaaagttttattttttttttggggggaggtgaagatttatggtattgcagttttgggatgttaattaaactcgacataaagatgagggacggcaagtggacttattcattttcaaaaatagacaagcttctgggcttcgccgcaatataaattattttctgggctctcaagtttgaacattgagcgtccgatccaccccttcattatcattgcatttagggatggcaggcacgacgggcacgggtagtgactacccatgctcgtgcccgcgggcatgcccgttactacatgacgtggaaggaacattgtctatgcccatcgcccgcgggcgccatgtgctcgcgggcatatccgtttacccatcacaggcttacagttcaatccttcaaccacaaatctctacagcagagagatattatcacagtttaaagatagggtacagttgtaccaagttctacaatacaagcattacaagtttatcaatcctagacggtggcatttatactaatttgactgagagcccacatgtcagttggtttttgcgggtaaacgggcgaagcgggcatgggtcactacccatgctcgtgcccgtatgtcacaccctgaagttctcctcccaggcctaaaatttaatttataaacgaccccccaagaaaatgcaggtgcaaatcaagagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttccttcttctttttctttttcctccctttttttttcctccttttttcgaatgggccgccggcccattctctccttcctccccctcctccctgctgggccggccgcaggccgaggcccagccaggccgggcggcttccttcttttcccggggtcggcgacaggtgggggccacctatcgggccctttcccaaacttcgggcactcgcccacgttggccattccgccgcgaaaacggcggaacccggcttcttcggttcacgttgggcacgcccgtgcgtgggccgtgcct

SEQ ID NO: 94022 - DNA, 2235 bp, Oryza sativa
acattagcaacaaggcaaaagcatgtggacatcttagatgttgaggatcctatttctcagaaaactgaagtatcagcacagggcagtcttttgaaaccatcttcgtcacgagttaaggagtctttacctaataactccaactgcgctgctaaatttacctccgccgcaaaagacagcaatactgttgatgctacatctgacaaatcagctaaattgatgcccaaggtaatgtttggatggcacctttttcctcctagggtacataatattttatcaacatactgacattttctttattgtaggattggttggagatggataactgtaggggaagtacaaagttgtcactcaaccaaggaaatgataaaactgagagaaagcaatcaccaatcccagagaataatgatatgagttctggaataataaacaaggagaaacctccaacattgcctttgagaagtcatgctccttcaaatctagtattatccagtgaaattgaccgaaacaaaatcctagcatcatcaaatggcttttcattcccggttccggctgctctgactggccattctcaggcccctccaacacctactttggcatctccacctgtactatctgttgagaagcagcagctgtctgcatcatctagtgcaccagttacttcagtggaaagtattccaaggttagtttctgatcggttgtttgaactgatgtagttacagtcaaaagcatagttttaaatttgaagtacctttgcaatgaaaatgggcaatggttaccaagtaggttaacacataagtacttatgttatcattttatagtgttttttgacttgattgtcgttttatagttgagatatggtagtctgacacatgccaattatgcttcagtttccaatttatgaggatactcacttatttccagcacattaatctgacatgtctttttctccagggttttcaaaccagtttcagaagaagcctcagtttctaaccaacgtgatacaaagtcgaatacagataaaccaccaatttctcaaagctctgggcaaattgtttctttcactagtaatccagtatttaacgtcatctcctcaaaaccaacaaccttaagcaatggcctggcagatacaacaaaatctgcttctgctgctgtatttccttccaatggatcaaccaagtcagtttgttctacaaatgctggctcttcaacaccttcgttcccaaagttctcatttcagcctggattccgaacatcaacctcttcagtgcaatctagcggtattcaagagcctgctataacagctccattcagcactgtgagtagtttagctgggggcagttcatcgccatcctcaatgatatttgctggtgctacttctcaatctagttccatcaccaccagtggcagtgttcccttccaattctcttctcaatctagcagtgaaagttcattagctggccaagacaaatccaaggcagcaagcagcagtgccccttttagtttctctccacagtttggcagtacaagtccgtttgcaggccagggcaaatccaattcagtctcctctcagtctactttgctgtctggaagccaatttagcaattcactatctgcacagacttcaacaagcaattcaaacctattatcttcagaaaaagtaaatcctgggagctcgccaagctttgcatttggttcatcagcaccaggctcaagccctgtgttttcgttagcagttggttctggcactacttctgcaacacctgcttcagcatcttcaccaattttttgcaaccgtttaactagcacaaatgctccaccttttggctcccctgccacttcaccttttagctcaacctcgagccctgtattctcatttacctcagctacgcctacgataccaaatgcatcacctacaacaccactttttggtacaccgagcccgactgttggtttaagtacaggaactgatcagatgaatggaggtcagatggctggggacaagaacccgtttgctttttcagcagcttcaccctttggtcttccaagcagttcaccatccactccaactctgtttagtacgccagcaactcagtttgcttcagctacatccgcttcaccgggcatgttccaatttggccagcatagtcaatcatccccaggtggcttctcaataggcactactggtggcaacagtgaaaagtctgcaagaagaattctaaaagttaagcgaaagaa

SEQ ID NO: 94023 - DNA, 814 bp, Oryza sativa
gccaagtctggtttccaggcgtgctcctttctcgctttgttggaggtccgctcttgtgtgccacgcgtagtttggaaatcaaacttccagggaccagaagcccaaccgcccggtgtccgtccccgtggttccttgttgcccaacgctttcgtgaggaggtcgtcctcacgtctttgagagcaggcctcttgcgaggcttgttgctcggcaaccaactccatctgcattacaatttagtggggttaaataaactgcacgatgggaaacaatgcgaacatctagtttgactagacacttactatagcttcgtacactcgttgatcttctgcatttggcatgaagattgtgccatcatcattcttctggtacctggccctggcccagttcctagcccgagggtgtgggatatcgccaaacacgagcggtgtgcatgattcctccgcttcttcatcctcacgttgccattcctcttccttactggcatatccggcggtgcccagccggtgcggatgctggttcctggtctggagcaagagatatgcctcgcttctagctctggactcgggggtcgacttcttcgcatgtaattcctcccagacctgttccgtgatccaaggaaatttctctcttggatctagattcgccgggttgtagacgaactcgccgactagcttagtcttgaagttcttccaagcattgcccataaccttgaaagcagcccgcctgagacggtcctcatgctccacaggataatcaaagctctccttgaacattagccaagcaatgtccttctctgcggccggcatgagcttga

SEQ ID NO: 94024 - DNA, 1666 bp, Oryza sativa
actaccaatacgggactaaagatcgctatctttagtcccaggtgaaataaccgggactaaagatcgatctttagatcgagctgaccttttttttttgcatggccctgttgctgcatggtttatatatatataaaccatgcatatatatgtttcaatacatatatacatgattaatatatatgtatttatatatatatatgttatgcaaatgcatatgtgtgtatatatacatacacaacacacacacacacacacacacatatatatatatatatatatatatatatatatatatatatatatatatatatatatatatatatatatatatatatatatatatataaacaaaattttttttatctttaaagaaaatgtgctcacatgcattttgaaaaattaacttgatctatatacatatcattatgttgttctatatagatactattacgacgatatatttatatctatctaagaagctaaagacctatgtattgtttttccgccgtagtagaattcacccttggcatcaaggatttgttcgttgatgaatcccatgagttgttcttgaaccaccgtgataaattccttgtgtgtgatcaggttatccctcatacgaataaactatatgaatgtgtgaaattaattagtaattaaacaacaaatcgatacgtaatgaaattttgaatttatttgcacgtacatcgagctctcttgtggtgatgatttggtctgcaaggcagtggcaatactcgcacacgtagtagccgcacaagttagttccctacttttgctttgcgcactataaataaatgacaaatggcgagagatctaattaatatacacttgtatgtatttgaattggagattcaatataaatgtagagcatgtgtactcacaggaaaattgaacttccgcataagtctttctctcatttttccgcggaccaaatgatggaaccgataccaagccctacatggagtttaaagctatgattcgtagtagcaattaattataacaagattcttaattaacataggaatttatgacagtacctgtttataagttcgaaaaccttgtcaaacgtagactcttttttatccattgagtcatatacgttgacggtgcaggcctccaggtcgaagagtaaaagcacccagtggaatctgcaatgtgcgtgggatgcattatatatgaaacacttagcatgtttgtacgggaatgaaatttggtataggaagacagtaaaattaaactaactctgtgttgtacggcaacagtatgaacgtcttgtaatgctgcgccttcaggagatggacgagattgtcctctgtgtcttgcagataccggtcgagcactgtgacgtttactttccgagggtcgatgaatccagtatcgaaaaccccccaccgtcgggccctttgaatctccattctacaacgataaaaggaagtatatattatatatagtctacttatatacaaggacctaattatttaaaggaaacgtaataagaaatctaactgaacgatacttacaaaatgcagcaactcataatagaaacgtcgagggcgtccagctggtatagttcgtagatacccttgaaattgatccagagaatgtcatctccttgcaagaagtccgtgtccctgatcctcgctctgat

SEQ ID NO: 94025 - DNA, 775 bp, Oryza sativa
  unsure (1)..(775): unsure at all n locations
tgtaaataaatatatatatatataaaatatagatatatagatatatatatatatatatatatatatatatatatatatatatatatatatatatatatatatatatatatatatatatatatatatatatatatatatatatatatatatatatatatatatatatatatatatatatatatatatatatatatatatatatatataaccaaaatatatatttacattaaagaaaatgtgtacacatgcatatagaaaaatagacatgtactaattacaatccattatgatgtcctagctagctactatttcgacgtagtagtagtcgctatctcagaagctaaggacctatgaattgtatttccgtcgtagtagaattcacccttggcatcaaggatttgttcgttgatgaatcccatgagttgttcttgaaccaccgtgataaattccttgtgtgtgatcaggttatccctcatacgaataaactatatgaatgtgtgaaattaattagtaattaaacaacaaatcgatacgtaatgaaattttgaatttatttgcacgtacatcgagctctcttgtggtgatgatttggtctgcaaggcagtggcaatactcgcacacgtagtagccgcacaagttagttccctacttttgctttgcgcactataaataaatgacaaatggcgagagatctaattaatatacacttgtatgtattggaattggggtaccaagcgcgntgtcgcactgtgatcaagcaggtcacaagcgcggg

SEQ ID NO: 94026 - DNA, 1062 bp, Oryza sativa
ctggaccacgatcagtggagatagcactgctgccatcgagaggtatcctagttagagaagaatgagtgcaccaggttagctcacgtagaggaggggaatggcaagggacaggctgcgggttaagaaatcaacaggggcggtatctttagcgatcacagctaggttgcactgttgaatgaagaataaatgtcaaagcaagagaaagaaggaataccttataaggtcctcatgcagccagtgttacaacagttcactgctctaaattggataaagtgttcctctgattactgatctgggcattccgcatagtgcaataaataatgtttcttgttcaaatgctcgtaccacatacaactcttgttccaataaataagttgaacatggagcactactcatgataaattttcaacagagaatgtgaattaagcagatgaattgacaataaacgaatctgagaaggtccttcgattccgcaattgccattttgactggagaacagaatcagctagcttgtacttgccctccatattcagaccatggacaacagttctgaagttcactgcactggggatgataccactattcagcatgtcatgaataagctgcaacccatcctctgatctacctgccttacaaaggcatgacatgaacattgagtaggtctcaaagtctggcacaggtcccttcagtttcatgcgttggaagacatcccaagcctctgaaaccatacccattgccatgtgaccacggatcaatgcagagtaagtgacaacagtaggctcacatccattttctgtcatctccttaagtacatccatcgctttggaaacatcccttttccccaagtaatagatcatgaatgaggtatacatatgtgtgctttgagctatacctaaattcttcatttctgcaagcttagctgaagcatcttcaaagcgatccctcctcaacaacgcgtgaatgagactcccatacatgtatgcacttcttgaacatccataattcttaatattatcgaacaaactgagagcttcggccattctatcagacctgcacaatgat

SEQ ID NO: 94027 - DNA, 995 bp, Oryza sativa
ccatcaagtgagtaatattaatcattaattgagcaatttcatcacgtcttacttttgcaatactgatcttataatatgtgcctctaatttgttttttttattttgtagcaattgattgaagttggatgtatgcgaaaaatttgaaacgtcattctacggagtacagaaagggcgtaataaattttatgaacgccgcgaaggaggatcggatcagaagaaacagtgattacatgtgttgttcatgtgcagattgcaagaatgagaatatgtttgatagcggagaggacgtacatggtcatctgatacaacgaggattcatggagagctatacatgttgggtgaagcatggagagcaagaatcaggaagtggagtagcagcagacagaagtggtgcgcataatcaggaagatgaagatgagcatgacatgtttataccttctccattgggcggtgaaatggttgatgtggatcacgatctgctgcaagacatgttacgtgacgttgaggacccagcccagaatgagagagatggaatgaagttcagcaggttggtaagtgattccgagacgtctctgtatgctggatgcaaagcaaaacacactaagttgtcagttaccttggacctaatgaagctgaaggcaagtagcggatggacagacaagagtttcacagaacttttaggaattttgaaggctatgcttcctattgagaacacattgcccgagacgacatacgaagcaaagcaggttctgtgtccactagggttagaggtccgtagaattcacgcttgtcccaacaactgcatattgtaccacaaggaatatacggacttggatgcttgtcctgtctgcaaggcttctcgatacaagcgaaagaaaagtgctgacgaaagaaataagtcaaagaggggtggtccagcaaaggttgtgtggtatctacctatcattgatcgtttcaagagaatctttgccaacccgaacgaagcgaagttagta

SEQ ID NO: 94028 - DNA, 1665 bp, Oryza sativa
acgttgacggtgcaggcctccaggtcgaagagtaaaagcacccagtggaatctccaatgtgcgtgggatgcattatatatgaaacacttagcatgtttgtacgggaatgaaatttggtataggaagacagtaaaattaaactaactctgtgttgtacggcaacagtatgaacgtcttgtaatgctgcgccttcaggagatggacgagattgtcctctgtgtcttgcagataccggtcgagcactgtgacgtttactttccgagggtcgatgaatccagtatcgaaaaccccccaccgtcgggccctttgaatctccattctacaacgataaaaggaagtatatattatatatagtctacttatatacaaggacctaattatttaaaggaaacgtaataagaaatctaactgaacgatacttacaaaatgcagcaactcataatagaaacgtcgagggcgtccagctggtatagttcgtagatacccttgaaattgatccagagaatgtcatctccttgcaagaagtccgtgtccctgatcctcgctctgatcatctctctaccggtggcgctcatctccatgtacagttgatggaacttgtacatttgagtgggtaggaactgcagctgctcaggcttgataagcggtttatcgagttcgtacatgtatttcactttcgccttttcgattggtgcacctcatatcaattgatccgtagttagcccggtgtcatcaataaattcttgtattccaaaatcttcaccggtcaccaacggctcgatctcctggcttgcttgctctccaagctgagggactggtttggactttccagaagatgctttctcgagtgttcgctcatagtccgatagctttatggccttcttggcaggtgcagacatacccctgaagaagttcttaacactcgagtctataggaatcttcttttctggacttcgaggcttcaattgtctcctgacttctgatgccacataagcgtcaagctcctcttgcgtgcaatcgtaccctagatccttgttcttggcggtgtgaactttcgccttcttcgttgcccttgtgggggcaggcggtggagcttggggggcccttgacttggaaggtgctgaacgaggagcctgcggaggagtcggtgtaggagcctgaggaggagtcggtgcaggagcctgaggaggagttggtgcaggagcctgaggtggagacggtgctggagcatgaggagacggtgcaggagcctgaggaggagatggcggagccggaggagatggtgcacgagacgccgcttgtcgccctgggaggatgatgtatcgcttgcgccatagtataatggcgtggcttgtgtctcgtagatgcgtctcaccgtctcctccagggtaatccaactcgaggtcctcgtacgcgccttcgaccaactcaacttcgaccttggagtatcctgctggaatcgtcctacagtggtaagtacctaaagggtccgttgggatggccatgcccgacgccaccctcacgtggtgagaggttatttattagtaatcaacgtttataagcagcaacttggcgaatgtaccaaatctaaaattattaactacgagcctacccttattgataagtttttgagggaatattcagctcaaatggtgcccgtgagtg

SEQ ID NO: 94029 - DNA, 1085 bp, Oryza sativa
cgtgatatattgttgttagacaacgatgaacctactacctacgaggaagcaatggtgggaccagactctgagaaatggcctggagccatgaaatccgaaatagaatccatgcatgtcaatcaagtttggaacttggttgatccacctgatggtgtaaaagccattgagtgcaaatgggtctttaagaaaaagacatatgtagatggaaatgttcacatctacaaggcacgattggtggcgaaaggtttcagacaaattcaaggtgttgattatgatgaaactttttcgccagtcgccatgctaaaatctattcagattgttttagcgattgctgcctatttcgactatgagatatggcaaatggatgtcaaaacagctttcctcaacggaaatctcgatgaggatgtgtacatgacataacccaagggatttgttgatccacaatcagctaaaaagatatgcaaattgcagaaatccatttatgggttgaagcaagcatctcggagttggaatattcgttttgacgaagtagtcaaggcgttgggctttgtcaaaaatgaagaagagccttgtgtatacaagaagattagtgggagcgcactggtgtttctaatcctatatgtagatgacatattattgattgggaacgatattcctatgcttgaatccgttaagacatcgttgaaaaatagtttttcaatgaaggacttaggagaagcagcatatattatgggcataaggatctatagagatagatcaaagaggctaattggattaagccagagtacatacattgacaaggtgttgaagaggttcaacatgcaagattctaagaaaggcttcttaccgatgtcacatggcattaatcatggcaagaatcagtgtcctcaaacgactgatgagcgaaacaggatgagtgtgattccatatgcctgggcaatcggatccaatatgtatgctatgctatgtacacgtatagatggttcatatgcacttagtgcaacaagcccattaccaatcagaatccaggtgagagtcacctggatagctgtaaaagaattatcctaagtacttgagaaagacta

SEQ ID NO: 94030 - DNA, 660 bp, Oryza sativa
tacgtacttcctgtttcatccatacagtgagtgcaagccttgtcccccttgttggactgtccggatgggttgctaagtgcaggccaatcgttgatggttacgaacagtagcactcgtaggttaaactcctcctgtttgtcctcgtcctacacggggacaccttccttcttccacaacagtttaagatcttcgaccagcggtcttaggtacacatcgatgtcgttactaggttgcttggggccttgaataataatcggcatcattatgtacttcctcttcatgcatagccaagggaggaggttgtagatacacatcgtaatgggccaagtgctatggccgctgctcatctctctaaaaggattcatgccattcgtactcaaaccaaaccgtatgtttcgtgcgtcctttccaaagtctttaaattttctgtcgatgtttcgccactgcgaaccatcggcgaggtgtctcagcatcccgtcctgttgacgctcttcagtgtgccatcgcatcattctagcattccccttgttcctgaacaaatgccttagacgttgtattatagggaaataccacatcaccttagcaggaattccttttttgttagctgcccatcaacttctcctggattgtctcgtctaatcatgtatcatagcgctttgg

SEQ ID NO: 94031 - DNA, 1585 bp, Oryza sativa
atgtcactgtcaaggcggatgttgccgcgaccgttgacctcgccattacgcgccacggccgcctcgacgtcctctacagcaacgccggatcataggagcacaggctccggactcgctcggcgtgctcgacatcgacgagtacgaccgcgtcatggctgtcaatgccaggtccatgttcgtatgcgtcaagcacgcggtgcgtgtcatggcggcatggtggcgtggatgcagcctctgcacggttagcacggcggcatggcggccatgacgccggccggcaactccgacactccgcctcctcgacctgttggctctgccgtccgcgacgtcggcaagctgcttttcaaccactcggcgtccgtctccatcctcgccggccgtggccgcagccgctccccgcgctcgcgaagttctcgccggcggccgcctcgtcttcttgccctcgccgtgcctacgtgagattagaggatgacgacgtgagagagaacgacagaaatagtgacggagtggcatggtttcaattttaaaaatttgtagtggcacctagccaataaaacaaatagtagtggtatttttctaatttgccacatttacagtggcatggatccaattaaccctaaaaactataacaaaaatataccaaaaagctcatagctcgtgactaactcgactcggctcgtttgtatttattaacgggctaagccagggttagctcgtttgctataacgagcgagctcaagctggctcgcgagctaaatgagccatggaaaaacaaagcagcccaggagtgctgaggtggatcgcattgttatttgtaggcctaaggcccatcagatccactgatttccactaaaccctagttatatcaaatagatcgattgatttccccattccccaatctacagcgcacgctgtttctgtccagtatcacatcgccatagtgtcgcccaagccctcacgccggcatcgtcgacgacctggccgtcaccaccagcctctagggggcagcaacagcgtggtttgtgagctcacggtgccgcgcttcctctcgtcgccgctccagccggtcggccaactccgtggcaagcgtggccttgtctcagtctcgtcgtcgtgaggaagacgaacaagcagggtgaaggtcccctgctgcaggatgcaagagcatgcaactccatcgacagcgctacaagttataaatcaaggagcaaaagttcaatcttgccgtcctcgtcgccgtcggcagttcggcacttcggcaagtcaatctcccatgttaattttggttggtctaggattcactagggtgtttgcttggtgttttgtttggttccaatatgacgagactttcagatctgtttttatggatgcaatgtgtaaaaaaaaatttgtgccaagtctttgtgatttgtcggttgtttgatttcttaagcaattgcaaaaaaaattgttggcagccagaatctcgaagtgagagatttctattgagtcacggatgtattggctcgcgagctaaacaagctagctagagttgccagtcgagccgagttaggattaggctcgttatcctaacgagtagaccgag

SEQ ID NO: 94032 - DNA, 2530 bp, Oryza sativa
tcaaagctggtaggcagacttggttattatgccctacattgtcataattccagattaattgatcgatcatatataagtactaaaatatatttagtctatcacaattgagaccaccgacctcaaactcagccaaagtcttcaccttttctctatacagaaggcgcatgttgtggcacacatggaatctgcactggtcacctatttgttgcttcaccgggaagtcttttttgtggatgagggtgtcatgtcctgtcttcctgaggtctcctctttgcacatattgggcccacgcttcatctattgctagttgaattggggtccaattatatgcgttcttatcaattctggagttcaggtagtgacatgtactccacttaggtgttatgaccagaaggatccaatgggcactgcggcattaatatagtgaaagttaattaagtactcaaggaatgtgtgtcattttgttgtgtatatttagttaacacacttactattgattataggcgcacataatgtactccttgtctcggcaggaccacaaggtgtcgtagatgtagttgaccattccttgacggtcattctggagatttgtgacagtgaccacttgtggatcaaggaaggcaacttccggtgcatgcttctgacaccattgccaacttaacctacacacaggataaacgatcttgtaagcaagttaaaccgattgttattaccagaatgagttgggcgacaatacttacaaggagtagcacttaaggaggcttgtgtccaccgttcggagcctgtagaggtcgaaaagatccttgaagtcgaccacgacataatttgttggaccaaggaatggctttccatcgtgctctccaaggatatcggtagctttactcggcttcctggcgttagatttctccatgtagtataagtgaaggtccttccaagcggtgcccattgtggcaagcacgtcatctccaaccaatggcatgcctagtttgaactcctgtggagcaacgtatttcttcttgacctctttgcccttagtctcttcctggcccttgcccagatctagcttccttggagctagaagcgaggcctgcacctttcctccccttcctctcccctttgcttcgggtttattgagagtaattctctaaggggaagagtgtgccttcctgctcttcttcatcagtgggggttcatgaatcgccttgctgtcggcctccgttcggtcctccccaaaatccgtgtcgtactgcaactgcacatcgtaagattgtgcatgacaatcttgagcaggaggggctgaaggagcagaggcgggtctctttgctgaacgacagcctggtgcaagtggttagcctcactgtaaccctgatctcaatgaggtccttgggccattggatgaaggtaccacgagcatttcctagtgagaggacctcgtcgtttggtagatacttcaaagggaacagctcgtattcgggcttcaccgagtcgacttgaacttttgcacagtcggccctgagttgcgctccatgcacttttgtctatggggtcggcttgtacgcaagtccctcggctgctggaaccgtgaaggtcggcatcaccctaactatgagggtgcagctcgttggttcctgcgatagattaatcaatttttttagaatattatatatcatatggattcggtaagtctttcatgtattgagtaagttcatggttaccgttatatggtcagcggcgctgtcgaccgatgttggattttccgccaactcagttgatgcgcaactgctgcgtttttgggtgggacttcctaactcttcgtgcgcagaagcaacggcggcctgggggttctattgctcttctcggatctcttgcctaatcttggccctcatcgactcgagcttttcatcgaattcagatgtcagctcagctcttatcgacgcccagatcttggcttcaaggcgtgcatctttctccgccttgttggaagtccgcttcttgtactgccacgcgtagtctggaaatccatacttccagggaacagaagacccaacgccccgtgtccgtccacggtgttccttgttgcccaacgctttcgtgaggaggtcgtcctcacgtctttgagagcaggcctcttgcgaggcttgttgctcggcaaccaactccatctgcattacaatttagtggggttaaataaactgcacgatgggaaacaatgcgaacatctagtttgactagacacttactatagcttcgtacactcgttgatcttctgcatttggcatgaagattgtgccatcatcattcttctggtacctggccctggcccagttcctagcccgagggtgtgggatatcgccaaacacgagcggtgtgcatgattcctccgcttcttcatcctcacgttgccattcctcttccttactggcatatccggcggtgcccagccggtgcggatgctggttcctggtctggagcaagagatatgcctcgcttctagctctggactcgggggtcgacttcttcgcatgtaatt

SEQ ID NO: 94033 - DNA, 717 bp, Oryza sativa
aatggacttgttcatcatctgctggaagattttctgagcctcttctatttttcctgaaacacagaagctccgtagagcttccagataacaatactcctctggatacttcatgctcttaatcatatcatctctgacataaaaaacaccttcagcattatctgatcctgcgagacaacacaatagaagtcgaaaaatgtcagatccaacctccgtgttccttgccatatctttgtagaactcaagagcaagctcggactttgcagaattgcataaagcatgaagtatcgtcctataaactttactatctgctgccacatgtctcgatttccccatagcctgaaaggtagatagcatcttgccaatctgccttgccttcccataactggatatgacgattgtccatgtcttgatgtccttcaaacacatctccttatccatctcatccatcaacttctccatggccccaaagttcctctcctcacccgcaatgtacagcattgcgttgtacgtcttcgtggtgtgctggaatccaggaacttgcctaacccagtcaaagaatttgaaccccaaatgcctctttttgaagcacctgttgagcaccaagctcacaagcctctgggtatatgtaactcccaggttcttcaagcttttgttcacaaacaatccaagcacctttgcccccaaaacttttgtaccctatgacaaactcactgtaat

SEQ ID NO: 94034 - DNA, 1695 bp, Oryza sativa
cacagatgtcccaaatgagacagtacagttgttggggatgggaccgtcttggaccgtagacacatggcaaggatacgatataaatggatattttacaccgtcaaacaagatgacaaaagcacagtgcaaaacaacggcgtccgtatagatgcgttccaggatcaagttgggtcaaacacatactacggccgcattgaggagatctgcgagctaaactacgtcaagttcaaggttcgtttgttccgctgccattgggtgaatctaagcactggtgtcaaagccgacaaggaaggtttcactttagtagatctatctaaggtgggatacgtcgatgaaccatttgtacttgcgaaacaggtcgagcagatattctacataaaagacccttcaaacaggaagatgcacatcgtgagggatggaaagcgccgaattgtaggagttgacaacgtcgtcgatgaagaagaatacaaccataatcttcatgtaagacctcacattgaccttgacgatgatccccaagagcctgtggcatatgctcgttcagatcatacggaagtcataaccttgtgacatgcatttgtacttatctattgtaatgaatgaagtattttgttttattacaaatgaccaaaataaaagttgtagatcctgatgagaggatcaactttgtttttgaccatatttcaatttgaaatcatgtagtatttacaaatgctgttaattagatttgttatattgtcaaaatcaatttcaagttgttgggaaaaaaattatatagaaaaatgaccaaaataaaactagtagatcttgaaaggctctacaactttgttgttgaccatatttccatttgaaatcatttactatccaaaaatgtattatgactaataaaatgaattattacacagcagctatatattttgcacccacaacaaataaaagatggaaaatgagtcatcgtgacgggccttagttcaagcccgatagagattaatctatctctatcgggcattatcttagggcccgtcacagatgagtcatccgtgacgggcctaaatgtcatctcaatcgggcattattatggagcccgtcaccgatgagtcatgtgtgacgggccctacggcaaagcccgattgagatgactcatcactcttttgtaactagggtttctcagatcggattgaaaaattttctaagtcctgctatagtttcccgcctccttagaaccctagcgccgccgccaactcctacttcaccgccaccgccaccgagaccgtcaccgccgccaccgagcccgccgccgcctccaccgagcccgtcgcctccaccgaccggcgacgccctccaccgaacctggcgccaccgccaccgagcccgccaccaccgccctcgccaagcctgccgccgtcgccaccgacgttgagcccgcggctgccgccaccgagcctccttggcccttcattcggaccaccgccacttcttcactgacgacccccaccgagcccgcgccgccgccaccgagcctctacaccgactggaccggtgtcggccttcctcgtcgtcgccgcccgcgtcctcaccgacgcacgttgccaaccccccaccgagcccgacgccgcccgcccggcgccgacctacccgaccggcatctccactgaccggcgccgccctccaccgagcccagcgccgacccccagg

SEQ ID NO: 94035 - DNA, 1030 bp, Oryza sativa
tcagtttattagatttgtgagatgtgcaatttagtttatttatgtgaataagtgattttagaactttggattctaagccattgaagcactgaattgtgtattttcgttattttgaaaaaaagtagacgatgtctcagcaaggtgaaccaatgtcgacgacaactagtgggtcctcaagggcacgtactcctaggacagggaacaaaatccctaaggaacggttccgcataacagtggtggacgccgtagggttgccgacatctccaaggaaaatattgagccgatttaggtctatctgtggggtcatagggaggcagaaattcagtattctgcaagatgacatcaagctcatgccggccgcagagaaggacattgcttggctaatgttcaaggagagctttgattatcctgtggagcatgaggaccgtctcaggcgggctgctttcaaggttatgggcaatgcttggaagaacttcaagactaagctagtcggcgagttcgtctacaacccggcgaatctagatccaagagagaaatttccttggatcacggaacaggtctgggaggaattacatgcgaagaagtcgacccccgagtccagagctagaagcgaggcatatctcttgctccagaccaggaaccagcatccgcaccggctgggcaccgccggatatgccagtaaggaagaggaatggcaacgtgaggatgaagaagcggaggaatcatgcacaccgctcgtgtttggcgatatcccacaccctcgggctaggaactgggccagggccaggtaccagaagaatgatgatggcacaatcttcatgccaaatgcagaagatcaacgagtgtacgaagctatagtaagtgtctagtcaaactagatgttcgcattgtttcccatcgtgcagtttatttaaccccactaaattgtaatgcagatggagttggttgccgagcaacaagcctcgcaagaggcctgctctcaaagacgtgaggacgacctcctcacgaaagcgttgggcaacaaggaaca

SEQ ID NO: 94036 - DNA, 1207 bp, Oryza sativa
tataataccacgtctaaggcatttgttcaggaacaaggggaatgctagaatgatgcgatggcacactgaagagcgtcaacaggacgggatgctgagacacctcgccgatggttcgcagtggcgaaacatcgacagaaaatttaaagactttggaaaggacgcacgaaacatacggtttggtttgagtacgaatggcatgaatccttttagagagatgagcagcggccatagcacttggcccattacgatgtgtatctacaacctcctcccttggctatgcatgaagaggaagtacataatgatgccgattattattcaaggccccaagcaacctagtaacgacatcgatgtgtacctaagaccgctggtcgaagatcttaaactgttgtggaagaaggaaggtgtccccgtgtaggacgaggacaaacaggaggagtttaacctacgagtgctactgttcgtaaccatcaacgattggcctgcacttagcaacccatccggacagtccaacaagggggacaaggcttgcactcactgtatggatgaaacagaaagtacgtatcttaagcactgtaggaaggttgtgtacatggtcatcgtcgattccttgcagcaaaccacccggtacggaagaaaggcaagcacattgaacataaggcggaccaccgtacgaagcctaaacatcgcagcgggaaaacagtgtttgctgtggttaaagatcttaaagtagtgttcggaaaggggcctggaagccagcctatagagagcgaagatggtcacgcggcgatgtggaaaaagaactctatattttgggagttaccctatagggaattcttggacgtccgccacgcaatcgatgtgatgcacctcactaagaacctttgcgtaaaccttcttggcttcctaggtgtatatggaaagtcaaaagatacactggaagcacgtaatgatctgaagcgtatggaacaacgcggcgaccttcacccggaaccaaaggagaaaggaagccattacttgagtccagccagctacactcttagcaaggcagagaaggaaagtatgtttgaatgcttggagagcataaatgtaccgtctggatactccacgaatatcaatcgaataataagcacgaaggagaagaagttcacaaacctaaagtcttatgactgtcacgtgttgatgacacaactgctaccagttgtaataa

SEQ ID NO: 94037 - DNA, 2469 bp, Oryza sativa
tgcagaaatccatttatgggttgaagcaagcatctcggagttggaatattcgttttgacgaagtagtcaaggcgttgggctttgtcaaaaatgaagaagagccttgtgtatacaagaagattagtgggagcgcactggtgtttctaatcctatatgtagatgacatattattgattgggaacgatattcctatgcttgaatccgttaagacatcgttgaaaaatagtttttcaatgaaggacttaggagaagcagcatatattatgggcataaggatctatagagatagatcaaagaggctaattggattaagccagagtacatacattgacaaggtgttgaagaggttcaacatgcaagattctaagaaaggcttcttaccgatgtcacatggcattaatcatggcaagaatcagtgtcctcaaacgactgatgagcgaaacaagatgagtgtgattccatatgcctgggcaatcggatccattatgtatgctatgctatgtacacgtatagatgtttcatatgcacttagtgcaacaagccgataccaatcagatccaggtgagagtcactggatagctgtaaagaatatccttaagtacttgagaagaactaaggatatgttcctagtctatggaggacaggaagagctcgtggtaaatggttacattgacgcaagctttcaaaccgacaaagatgattttagattgcagtctggatttgtgttctgcctgaatggacgcgctgtgagttggaaaagtaagatacagtgtctgattctacaacagaagccgaatacattgccgcttctgaagcagcaaaggtttggataaagaaatttgtttctcaactaggtgtgatgactagtgcttctagccctatgaacctctattgcgataatagtggtgccattgtgcaagccaaggagcatagatcgcatcaaaagtccaaacacattttacggcggtatcacctcattcacgagatagtgggtagaggagatgtgaagatatgcaaaatacatacggatttgaatgttgcagatctattgacaaagccactccctcagcctaaacatgaggcacacactagggcaatgggtataagatacgttcatgattgactctagtgcaagtgggagactgttagtgatatgccctagaggctattatagagatgattgtatcacacactatgtttacatatttatctgactttgttccttgaaatagataaactcattattggttaatgaatatgtgattctttcatgagactctttatgttatatgttgctatttctaaaggatccctgatcaaatatcatatatggaacaaatatgtttagatgatcaacacatgtattaattgatgatcatgtctcatggatcatggtatagagataccaaattaataatgtggacacatgttagtgaacatgttgttgaatagacccaacatgagacactgcaagagccatatgtgttgtgtcatcagtgatctcatttagtgttggtgttgaatccatagacctgatattatcatggttcccaacatgtgtagtagcttacttagggacagctaaacgctactccgtaattgggtagttataaaagtagtttttgggtatgctatgaaacatgtagtgggatatgaataatcaagatgggatttgcccctcctatagagagatatctctgggcccctcgatgttgtagattatggaagtgcatgaccatgccaaaggtgattgagtagtcaatcacaagttatataatctatcaacaggttcaagtgaatgattgagctattagaggatggcacatatctagccttgagcttaatcgatatcgtgaggcaaaggggttcatacaagtatacagtagaggttcagccgatatgatctttatgtatgcccggtaggtcaatacgttctgctacgggccactgttgacgcgtggaccgaaaaggagttttcgggttacagccgagtatacatgaacctaaagggtcgcacacttaatgggccggaataaggggattggatggagatccaatatgagcttaattcggatagggatccgaataggagtcctacgggccatgtaggcccgagtgatggatcctatatattcgtgaggggtgtgaccggcggaggcattgcatcacgtgagaaaccctagccatcacttccctccccgagcaaaaaattagccgcacgcgggtgctagcacatctgcgcgtggcgttccgtccttgtacgtgtggataccggtagaggcgccgctggtttgtggtgctgatcggcgtgggagtacggtgaggagaacgcacgaagagcagaaggtcgagctgatgccgatcgactacttcctttacatcgacgcgcgctacttcgcgagagttccttcgacttctcagcgtcttcttccgctgcgcagcgcgtcgagtggtaacgatctatgatct

SEQ ID NO: 94038 - DNA, 773 bp, Oryza sativa
ctctcaaaaggcaatgtagaaggtttctcctgtttattatttcaagaactcatatcattattctctgggattggtgattgctttctctcagttttatcatttccttggttgagtgacaactttgtacttcccctacagttatccatctccaaccaatcctacaataaagaaaatgtcagtatgttgataaaatattatgtaccctagaaggaaaaaggtgccatccaaacattaccttgggcatcaatttagctgatttgtcagatgtagcatcaacagtattgctgtcttttgcggcgaaggtaaatttagcagcgcagttggagttattaggtaaagactccttaactcgtgacgaagatggtttcaaaagactgccctgtgctgatacttcagttttctgagaaataggatcctcaacatctaagatgtccacatgcttttgccttgttgctaatgtgccttccttctgtgaaggaattatcgtatcaagctgcttcaatatctttgcagccatttgaattgactgtgctggtgcctgaccaaaactgctatcatttgctctgtcatgtacaccacttcgagtaatatcaccaactttatccagacacctacgtttttgactttgtactgagtgttccaaaccttcatcaagtttgctagcatgactaccactatatccacggtggcctgaccgagtttgcaacagtggtgacactctgttgtacctctgatgcattttgcgtatgggaccaacagaggcactctcgtta

SEQ ID NO: 94039 - DNA, 1360 bp, Oryza sativa
cacccggtacggaagaaaggcaagcacattgaacataaggcggaccaccgtacgaagcctaaacatcgcagcgggaaaacagtgtttgctgtggttaaagatcttaaagtagtgttcggaaaggggcctggaagccagcctatagagagcgaagatggtcacgcggcgatgtggaaaaagaactctatattttgggagttaccctatagggaattcttggacgtccgccacgcaatcgatgtgatgcacctcactaagaacctttgcgtaaaccttcttggcttcctaggtgtatatggaaagtcaaaagatacactggaagcacgtaatgatctgaagcgtatggaacaacgcggcgaccttcacccggaaccaaaggagaaaggaagccattacttgagtccagccagctacactcttagcaaggcagagaaggaaagtatgtttgaatgcttggagagcataaatgtaccgtctggatactccacgaatatcaatcgaataataagcacgaaggagaagaagttcacaaacctaaagtcttatgactgtcacgtgttgatgacacaactgctaccagttgtaataaggggtatcctttccagacaatgttcgggcaacaataacaaagctatgtgcattcatgaacgcaatttcgcagaaggtcaccgatccggatagattagaagcccttctgaatgatgtggagttttgagttgatatttccaccttcatttttcaatataatgacgcatctgctttgtcaccttgtcaaagagatcagtattctcgggcctgtgtacctacacaacatgttttctttcgagaggtacatgggcgttctgaagaagtatgttcgtaaccatgctcgtccagaggcaagcattgccaaggggtatggaacagaggaggtcatcgaatttcgcgtagaatttattgaagaccttcgcccaatcggggtacctgaatcacgccatgaagggagactacggggaaagggaactcttggaaggaaagcaataatgacgatagacaacaatttattccgtaaagcccatttcacgtttctgcaacaatcttcattggtagctccttacatcaaggagcacttggctctagttcacgccagaaaacattggtaagtcccatgcatggattacacggcatcacattgatactttccgcgcgtggctatgacaacattttatgggggacgagacgatcaaaccacaactggcctttctggtgagggggaccatttggtcaatcgcgacattttcagggtattagaacaagggggcaccatactatacgagaggcccagaaatggagaggaccaaccaaaacagggttgttggat

SEQ ID NO: 94040 - DNA, 657 bp, Oryza sativa
attgccactgccttgcagaccaaatcatctccacaagagagctcgatgtacgtgcaaataaattcaaaatttcattacgtatcgatttgttgtttaattactaattaatttcacacattcatatagtttattcgtatgagggataacctgatcacacacaaggaatttatcacggtggttcaagaacaactcatgggattcatcaacgaacaaatccttgatgccaagggtgaattctactacgacggaaatacaattcataggtccttagcttctgagatagcgactactactacgtcgaaatagtagctagctaggacatcataatggattgtaattagtacatgtctatttttctatatgcatgtgtacacattttctttaatgtaaatatatattttgggtatatatatatatatatatatatatatatatatgtgtgtgtgtgtgtgtgtgtgttgtgtatgtatatatacacacatatgcatttgcataacatatatatatataaatacatatatattaatcatgtatatatgtatcgaaacatatatatgcatggtttatatatatataaacccatgcagtacagggtcatgcaaaaaaaaaaggtcaggtcgatctaaagatcgaacctttagtcccggtattttcccc

SEQ ID NO: 94041 - DNA, 737 bp, Oryza sativa
  unsure (1)..(737): unsure at all n locations
aacgacaactataaacgattcctagttgttaaacaacataatggttaaagaagccttgccgagcatatgtgctaccgtgggacaatttatacttgccaacagaaggaccagatttaatactgtaaagcggtcaattagcgcgacacgattgatcttgatctgcgcactgattaggtacaccaggatcatcactgtaagaaatccgttgggcttggggacataaatcctagcnnnnnacancntgncncnnnaaanaattatgagcttggtgacttcgggttagcaaggcttgttgagcatgggggagagccacaaacaacacaagttgtcgcagggacccctggatacattgacccagaattcatcaacaaccgctggcctcgcaccgaattggatgtgtacagcttcggtattgtcctcttagagatagcttgtggcaagcggccggcatcgaggcagctgccaaatggagcttcatcactgctagcctgggtgcgtgatttgtatgaccagggcaagattcttgacgcagcagatcagagactgaacggcgagttcaatcatcagcaaatggagcgtgtgatcgtcatgggtctctgctgttcacatcaagacccgatccagcgaccgtctatcgtgcaagctatggatgttctgtgatctgcatacacagagttgccggtacctcccgcagcacatgatacaggacacatgcggtccatgcaagaacaagcttt

SEQ ID NO: 94042 - DNA, 824 bp, Oryza sativa
atattttgggagttaccctatagggaattcttggacgtccgccacgcaatcgatgtgatgcacctcactaagaacctttgcgtaaaccttcttggcttcctaggtgtatatggaaagtcaaaagatacactggaagcacgtaatgatctgaagcgtatggaacaacgcggcgaccttcacccggaaccaaaggagaaaggaagccattacttgagtccagccagctacactcttagcaaggcagagaaggaaagtatgtttgaatgcttggagagcataaatgtaccgtctggatactccacgaatatcaatcgaataataagcacgaaggagaagaagttcacaaacctaaagtcttatgactgtcacgtgttgatgacacaactgctaccagttgtaataaggggtatccttccagacaatgtccgggcaacaataacaaagctatgtgcattcatgaacgcaatttcgcagaaggtcaccgatccggatagattagaagcccttctgaatgatgtggagttttgagttgatatttccaccttcatttttcaatataatgacgcatctgctttgtcaccttgtcaaagagatcagtattctcgggcctgtgtacctacacaacatgtttcctttcgagaggtacatgggcgttctgaagaagtatgttcgtaaccatgctcgtccagaggcaagcatcgccaaggggtatggaacagaggaggtcatcgaatttcgcgtagaatttattgaagaccttcgcccaatcggggtacctgaatcacgccatgaagggagactacggggaaagggaactctcggaa

SEQ ID NO: 94043 - DNA, 711 bp, Oryza sativa
acatgcatatagaaaaatagacatgtactaattacaatccattatgatgtcctagctagctactatttcgacgtagtagtagtcgctatctcagaagctaaggacctatgaattgtatttccgtcgtagtagaattcacccttggcatcaaggatttgttcgttgatgaatcccatgagttgttcttgaaccaccgtgataaattccttgtgtgtgatcaggttatccctcatacgaataaactatatgaatgtgtgaaattaattagtaattaaacaacaaatcgatacgtaatgaaattttgaatttatttgcacgtacatcgagctctcttgtggtgatgatttggtctgcaaggcagtggcaatactcgcacacgtagtagccgcacaagttagttccctacttttgctttgcgcactataaataaatgacaaatggcgagagatctaattaatatacacttgtatgtatttgaattggagattcaatataaatgtagagcatgtgtactcacaggaaaattgaacttccgcctaagtctttctctcatttttccgcggaccaaatgatggaaccgataccaagccctacatggagtttaaagctatgattcgtagtagcaattaattataacaagattcttaattaacataggaatttatgacagtacctgtttataaagtcgaaaaccctgcaaacggagactct

SEQ ID NO: 94044 - DNA, 719 bp, Oryza sativa
agcaattattaacccttattatgcattggtgatgatgaaactctgaggtttagatttaaggaaaaatttcctaggtttatgttaaaacttgcttaaataaatatttgatccaattaactcggttttgcaggtgaaatatgataaatatttgaataattgtgaaatatgtgaatgaatgtaaaatatgagatgcctgtgaatgtgtggttgtgtaaaatatgttaatgtgtgtgtatgtgaatgcatatatatatgaatgggtaatgctggggagctggggatattggatatctgtgtttgtttctgttatttatgcagcgggcatggctagcaaaggcctgaggctagccaaaaaacaaatttttttgtgaattatagccatttgtgacgggccataactaaatgcccgattgagatgaggtgtcacgcccagaaattcccgaatagaattccaagcagaatgtgcattaaaacccccgtccaggaccggtcggggtacacaaacgacaaatttgacatacagatccacgtcttacaaacattataaaagtattacataaatgcagcggaaaataaaaagataactggagctaagccttgacttgcaccgcagcgggaacaccactccacaagtatcctcgacggcacggacgaagcctactcctcggagaagccaccatctgacgcatactcaaactctggggtttggggaaaatata

SEQ ID NO: 94045 - DNA, 2988 bp, Oryza sativa
atgtataccacaaagacaacatcgaaccggatgatctagcacggcgtgcgtccagacgagagccacagccaattgaacctggcacctttcctgaccaggccatcagtgaaagaggcaagcggcgaagatagcccggtcacccctaacatcagctcgggggctacagaggcagagcgcgccgttgccgatatcgagagcacagatgactggcacaccccactcattaaattcataggcagtgaagagttgcccgaggacgacacagaagccaagaaaatatcccgtaaagcaaaagtctactgtatgatcggcaacgatctatacaagaaggcaccaaacggggtacttctaaaatgcgtctcgtccgacgacgacagacacctcctccttgacatacatgaaggaatccgtggatcacatgccgccggtcggacattagtcggaaaagcttttcgacaagggttcttctggccaaccgcccttaaagacgcctgcgacatgattcagcggtgtgaagcctatcaattctacagtaaacacacaaggctaccagcgcaagcacttcagactatccctctcacttggccgttctcgtgctgggggctagatattctcgggctattcccacgaggatagggcggctgcaggttcctattcgtggcgatcgacaaattcactaagtggattgaagcgacacccacgagggaaatcaaggccgacaacgccatcaaattcatcaaagggatattctgcagattcggattgccccaccgtatcataacggacaacggctcccagttcatcagtgccgattttcaggattactgcatcaggctgggagtcaagatctgcttcgccgacgatgaggaggaattttgaacggagggtaatttggtcaaatttatggttgtaatggtgtggaatcaatggtgcgttgatggcgatggcatttctggaagaaaaagacttgtacgatggcattttatggattttctctaatttaaaattttaagtaatactctctccgtcccaaaatataagcattgttggacttcgacaatgtcttcgagatgctacattgatcaacaatatctataaaagtaagatgttttaaataaaaaaagttacacattatgataatttgcttaataacaaatctagtaacatcaaatttacatgattgatctgtttttgttcgtttgctattaatagtcaaaatttaaaagtttgatttgccactattctaagaatgcttatattgggatggatggagaattttttttcttgtatactaaggatgtatgtgaggtgatatttataagtggacgtgccgattggatgggctaggctgcgttattctagagcacagattgttaaaaattgtaaagtaaaattacttgaatcacgtcgtcttaaatttatgagaaaaaaaatgctgcaacaatagatgttgactttcgcccagggatcaaactgccggggagcaacgaactacctttggcgtaaactcacgcgagcacacaacacacgcgatggttcagatgaacacagggaacacaagcaagctttgcggcaacaaatgcccttttctctgtttatctgtgactcacacacttaactgaaaatggatcagagcacggcttaaatagccttacatgcacgaactgttgccggtcttcatgcgcacgcacgcactacctgaatacatgagccactaactccatgcattacgagacccactcgtccaactaaccatgcatgcaactaactatctgctaacttgccgcactcaactaactacacaagctaattactcggtcaactaatcaccaagtacatggctgtgacagatctaatctcctatatgcatgcatcatatatgcaatactccactacgtgcatgacacacatacacgactaactactgcagatatttaaaatatgtaagtcaggattaatgctaacaatagagctggttcatatgaaactatcatttatactacatgtgtagatggataatagatagatagatagcacaaaactatgaacaaaatagatgtgtgcctatcagcaatcttgttgacaaaacaatctaaacaggcgcatgtaaacataactaatattgctattcaaaagagagaattcgttatccttcagcaagtagataaactgaatccttggaagtaaaatacgtacttcgggtgacagtatgcacagaatgatcctcaactggcaggtcggcataagcctgttcttgcatggaccggatgtgtcctgtatcatgtgctgcggaaggtaccggcaactctgcgtctgcagatcacagaacatccatagcttgcacgatagacggtcgctggatcgggtcttgatgtgaacagcagagacccatgacgatcacacgctccatttgctgctgattgaactcgccgttcagtctctgatctgctgcgtcaagaatcttgccctggtcatacaaatcacgcacccaggctagcagtgatgaagctccatttggcagctgcctcgatgccggccgcttgccacaagctatctctaagaggacaataccgaagctgtacacatccaattcggtgcgaggccagcggttgttgatgaattctgggtcaatgtatccaggggtccctgcgacaacttgtgttgtttgtggctctcccccatgctcaacaagccttgctaacccgaagtcaccaagcttagcattgtgtgacacatcaagcattacatttgcaggcttgatgtctccatgcacaatgcatttctcgcagtcatggtggaggtagagcaaagcagagcccagatcaagtacaatcttgtcagttgaattaaacaggttagcaaatttaatttggtacctttgttgccaagttaaaattttctcagggtcgtagagatgcttgtcaaggcttccttgagccataagttcataaacgagaaggagctgtttcttgctgtcgctccagccca

SEQ ID NO: 94046 - DNA, 2628 bp, Oryza sativa
aatgagcataccatgtttataccttctccattggccgttgaaatggtgaatgtggatcacgatctgcttgcaagacatgttacgtgacgttgaggacccagcccagaatgagagagatggaatgaagttcagcaggttggtaagtgattccgagacgtctctgtatgctggatgcaaagcaaaacacactaagttgtcagttaccttggacctaatgaagctgaaggcaagtagcggatggacagacaagagtttcacagaacttttaggaattttgaaggctatgcttcctattgagaacacattgcccgagacgacatacgaagcaaagcaggttctgtgtccactagggttagaggtccgtagaattcacgcttgtcccaacaactgcatattgtaccacaaggaatatacggacttggatgcttgtcctgtctgcaaggcttctcgatacaagcgaaagaaaagtgctgacgaaagaaataagtcaaagaggggtggtccagcaaaggttgtgtggtatctacctatcattgatcgtttcaagagaatctttgccaacccgaacgaagcgaagttagtacgttggcacgccacggagagaaggaatgacggtatgcttagacacccagcggattcgattgaatggaggaatatcgatcgaaaacacaaagactttgatgccgaccctagaaacatgaggatatgtctatgtacggatggtatgaatccttttggtgacatgagtagtactcacagcacttggccagttcttattgcgaactataacctcccgccatggttatgctttaaacggaaatatattatgttgtgcttgttaatccaaggtccaaggcaactcggcaatggtatcgatgtattcctggagcctgttatcgacgatctggagattctttggaaagaaggtgtggaaacttgggatgcatatggtcaggagaacttcaagctaagagttctattgttctgcacaattaatgactaccctgcactcggtaatctttccggacaaactataaaaggaaagaaggcatgctccgattgcaaggaatatacacaaagccggtggctgaagaaatcacgaaagatggtatacatgggtcaccggaggtggctcccgctacgtcacgcatttagaagaaagaataaaatttttaatggtaagagagaacttcagcctgctcctaaagatttgtccggagatgaggtccacaatatggtcaaggacataagcaatgagtttggtaagaaaagaaaacgtagcaagacaaaggagaagggtatgtggaagaaaaaatccatattttggcggctaccttactggaaagatcttgatatccatcattgcattgatctcatgcatgtagaaaagaatgtgtgtgagagtttggttggcctgatgttgaatattcccgggaagacaaaggatgggttgaacgcgcgccttgatctacaggacatgaatattcgcagtgaactccagcccatacgagatgcagagacaggtaaagtgtacctccttccagcctgccacacactgttgaaggatgagaagatcgcaatgttatcatgcttgaaggatattaaagttccatcgggctattcagcgaggataagtaagtatgttaaattggacgatctaaaacttgttggaatgaagtctcacgattgccatgtgctaatcacacaaatcttgccagttgctatcagaggcattctagcaccgaaagtgcgtcacacgatccaacgtctgtgcgccttcttcaatgcaattggacagaaggttatagatccagaagatctagatgggctgcagaccgatattgtgaatacgctctgtcacctggagatgtttttcccactgtctttctttgatataatggttcatctccctgttgatatggtgaagcaaacaaaactatgtgacccggcttttctaagggaaatgtggccgtttgaaaggtacatgggagttctgaagtcgtacgtttgtaacagagctaaacccgaggggagcatcattgaaggttacataaccgaggaggctattgagttctgtgtcaattacatgtccgatgctgatcctatcggagttcctgcgtctcgtcacgagggaaggttgtcacgtgttggcacaattggaaggaaaagaatcaggcctgatcaagcatcgtacgcgtaggctcattacgctgtgctccaacatatggcagaagttggcccatactttgaggagcacttagcgaaaatctgagatgagaacttggggcgatctgatgcatggattaacagagaacataattctcggttcaacgaatggttcaagaatcgtgtgataatgtccacagatgtcccaaatgagacagtacagttgttggggatgggaccgtcttggaccgtagacacatggcaaggatacgatataaatggatattttacaccgtcaaacaagatgacaaaagcacagtgcaaaacaacggcgtccgtatagatgcgttccaggatcaagttgggtcaaacacatactacggccgcattgaggagatcttggagcttaactacgttaagttcaaggtttcgttggttcggttccaattggtgaaattaaat

SEQ ID NO: 94047 - DNA, 728 bp, Oryza sativa
tacacagtattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcctcacgcgtaaccacgtgccacataccaccacggcatatggacggaagacatgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttggttataaccagactgagccacaaactaagccttacccactagacatgtgaaagtaccgtagtgctttgcaacagaagccccgaagaccggtccttatattggcgaagtgctactattcaaaccatgcaccccgagcccagactaaaaccattttggggggtttggaataaggggg

SEQ ID NO: 94048 - DNA, 690 bp, Oryza sativa
ctaactctaaatacaaacatgtaatggtgtcaagtcacgcaattgcaaagggaatttctcattatttgaaaagaatgttaagtaggataggtttcacattactaatcgaagaccatgcaaattactgtttttctagtacattatacttcgcaccaggtaaattacatcgtgtttcactttataccgggatgatctaaggtgagttgcactttactctagcatcatatttcaattggatacatacctgtcagtagtattctcaccagataacatatataccagtaccaaattgaacaagaaataggaatgtgttcacttagaaagagaataaaaatgccatcatcaatggggttgcctgtaggctaggactgttaatatggtctgaacaatggtacagagtaggacgaccactgcagccaacacacctaatgctaaccatggattgctgaagtgattacgccagagccaagccatccatctgttcagcctgctttggtaatggtcctccaaaacataggataaagtttgaaggtagtggtaggtatcagaaccaaatatcaaatgtgtgctgagcctggtgaacatagctgacacttcatcgtcattatccagcatatgaacaattatccctctctcagtaagtagagtggcatcctcagaagtgcttacaagctgagacataaaagcgat

SEQ ID NO: 94049 - DNA, 905 bp, Oryza sativa
tgaagtttatatgctctttaattgaatatttgcgaatttcttcatttaaattttaatttaaaatcggaattattgcgtcagccgaggggagagggcgcgcggaccgggtccacgggagtggggcccacgcggcagcctcacggtccacggtggaccgggtgcacccggctcacaccggccggcgccgtgggtcccacgcgtcagccgcacccgagggcgcgggcggcttacggccgggccccacacggcagccactcgacgcgcccgagggcggccaagccagcgcggccggcgggaggcggcgtgtcacgcccagaaattcacgaaccagaatttctaagctgattgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaaaacagtagttgaaagcagtaaaacagttgtagtaattaatccatattaaccaatcactgtccaacgttacaccacgaaacaaaaggcacaaaccaccacctaaactaatcagttccaaaagctaactagggtgaaactaatcacggggtaccgagctcgtattaggcgaatagcaattgatctcacccctt

SEQ ID NO: 94050 - DNA, 1187 bp, Oryza sativa
atgtgtttgcatggggtacctaagaagattgtatctgatcgagggagtcagttcacttcaaaattttggcagaaactgcaagaagaattggggactcgtttgaatttcagcacggcctatcacccgcaaactgatggtcagaccgaaagggtcaatcagatcttggaagatatgctgcgagcgtgtgcgctcgattttggtggagcatgggataaaagtctaccttatgcggaattctcttacaacaacagttatcaagccagtttgcaaatggcaccgtttgaagcgttgtacggacggaaatgccgcactccgctcttctgggatcaaactggagaacgccaattgtttgggacggaagtattaactgaagcagaggagaaagtcagaaccgtcagagaaaggctaagaattgcccagtctcggcagaagagttatgctgataaccgccgaagagagcttactttcgaagcaggggattatgtgtaccttcgtgtcactccgctcaggggagtacaccggttccaaacgaaaggcaaattggcaccacgctttgtgggaccatacaggattttggaacgccgaggtgaagtcgcttaccagcttgagctcccatctaatatggttggaatccacgatgtgtttcatgtatctcaattgaagaagtgtttgagggtacctgaggaacaagctagcttagagcacattgacatccaggaagatctgacttatgtggagaagccgattcgtatccttgagaccagtgagagaaagaccagaagcaaggtgatcaggttttgcaaagttcagtggagccaccactcagaagaagaggccacctgggaaagagaagatgaattgaaggccgcccatccgcacctcttcgccagctcttccgaatctcggggtcgagattccgtttaaggggggtaggtttgtcacgccctgaagttcccttcccttgctctaaattcataaaataaatcgtccgaagaaattgtttaatttaacctagagagaaaccctaaattaataaatgcaaatattaatcggaatcggcatgtggaatttttcttggattctacatgtcaaaatacgctaacaggatttttagtggaattttcagagcattggaaataattttaaccaattaaaattgagcttgtgcaatatataaatccctggaa

SEQ ID NO: 94051 - DNA, 740 bp, Oryza sativa
tgaaacacatcgtggattccaaccatattagatgggagctcaagctggtaagcgacttcacctcggcgttccaaaatcctgtatggtcccacaaagcgtggtgccaatttgcctttcgtttggaaccggtgtactcccctgagcggagtgacacgaaggtacacataatcccctgcttcgaaagtaagctctcttcggcggttatcagcataactcttctgccgagactgggcaattcttagcctttctctgacggttctgactttctcctctgcttcagttaatacttccgtcccaaacaattggcgttctccagtttgatcccagaagagcggagtgcggcatttccgtccgtacaacgcttcaaacggtgccatttgcaaactggcttgataactgttgttgtaagagaattccgcataaggtagacttttatcccatgctccaccaaaatcgagcgcacacgctcgcagcatatcttccaagatctgattgaccctttcggtctgaccatcagtttgcgggtgataggccgtgctgaaattcaaacgagtccccaattcttcttgcagtttctgccaaaattttgaagtgaactgacttcctcgatcagatacaatcttcttaggtaccccatgcaaacacatgattcttgaaaggtaaagctctgccaacctttctcagtataggtagtgtgtacttggaataaaatgagcaacatttggtgagtcgaatcacga

SEQ ID NO: 94052 - DNA, 717 bp, Oryza sativa
tctggttagcattgtactgaaacaaacctgtgaactgctttaacaagcaagatcagagatctgacgagatcgctcactgtcacagttactgtacatggcttacttcggcggattaacataagccagtatgccaaaaacggtttgcacaattgtgcagatgaggacaatgacagtcgcactcgcagccaaagccagccatggattgctgaagtggtttagccagagccatgccatccaccgattgatgagactttgatagtgagcttccatagtctggcacagagttttaagtagtagttaccattgaaatcaaaaaccacgtctttgctgagcatggtgaagagatcagacaccctttcatcgctatcaagctggtgcacaatgatttttctctgaataagcagcgtaacgtcctctggcatgcttataagttgagacaagaaaacaatataagcagtgaagtcatctccaaattgagggcaggtttgttcaaacgcaataaggttcctgaaaagactccctgtgtactcatcaacaacaatacacggaatgtccatggaaccattgctaaaccaaatgtctagcagagaatggggttttaatttatcatattcccgtttcttaaactttattccggcttctagatattgtgcagctcgtcgccaacgattaagctgatcccctccttgtgccagatccacttcgttctggaatgat

SEQ ID NO: 94053 - DNA, 1286 bp, Oryza sativa
atctgacggcactatttattggcaaccgctgtgaagtttacactgatcataagagcctaaagtacatcttcacccagcccgacttaattctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcacggcctacgctcgtggatcaagtcagagcagctcaagtaaatgatcctgaaatagctgagctgaaaaagaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggccagcatgagaagagagatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccaggacatcatcgggtcacgattcaatctgggtggtcgtggatcgactcaccaaagttgctcattttattccagtacacactacctatactgggaaaaggttggcagagctttacctttcaagaatcatgtgtttgcatggggtacctaagaagattgtatctgatcgagggagtcagttcacttcaaaattttggcagaaactgcaagaagaattggggactcgtttgaatttcagcacggcctatcacccgcaaactgatggtcagaccgaaagggtcaatcagatcttggaagatatgctgcgagcgtgtgcgctcgattttggtggagcatgggataaaagtctaccttatgcggaattctcttacaacaacagttatcaagccagtttgcaaatggcaccgtttgaagcgttgtacggacggaaatgccgcactccgctcttctgggatcaaactggagaacgccaattgtttgggacggaagtattaactgaagcagaggagaaagtcagaaccgtcagagaaaggctaagaattgcccagtctcggcagaagagttat

SEQ ID NO: 94054 - DNA, 1607 bp, Oryza sativa
attatactaatgtatataccttgcggcctgcaagcgtgggccaaacccaccgactaattatgctgtagatggcttcattatgcttgctggtgacacattgcactgggagtgagacatactcggagtgatttacccaacagatgctattggagagaatactgattctgggcccgattcacgttgaagctgctcagctgcagcaatggatgggttgtttgcaccatggtggagggatgatgcaagaggcatatgtataggaatcacacggttcactaacaaggggcacattgctcgagcagtgctcgagagtatgtgctttcaggtgaatgatgtcctcagctccatgcacaaggatgctggggaggcaggagaagtgaagagtgcagaaggggagttcctgctgcgcgttgatggtggtgctactgtcaacaatcttctcatgcagatccaggtaataatccttctcacgagatttaaaaagaataataaatactctgctagcttttccattggaacagtggaacatttactatcacgcagatgcgaaatttctgggttgatgagcaactacgtttaagagtaaaataattcaaataggttatcaacgttgatgttaccaccacctgaaatgttcatgcttatagttgtgcttttgacttggtgaaaatgaatgaaatgcaagatgttggctctttgtgtccctctttctatttaagggtaaccaaagcaccaattgttaccttttgcacataatgacctcttacttctgtgagtcatacttgacatgattgcagccacatctgtacagcactatgctatcaatctcaaacaggaaaaaaatatataagtactgtcttcatctgtaaacaaaacagtagtgctatgaactgttatttcaaaattcactatcttattgataactgatctttggctaatttacttatatcctcctacagtacagcttactgaaattagaagcttgagctaattagttaaatcctcttatagtattgcttactgaaattgtcttgaaaaacaatctttttaaatgcactgggtgtaattgtagctgtagcttagtgaaacgtttctctttgcaattgtaaaatctctccaaattcccataagatcactgattttgcatgcacacctgcaggctgatttattgggtagccctgttgtcagacctgctgacatcgagacaactgcccttggagctgcgtatgcagctggattagctgttggagtctggtcgaaggaacaaattttcgctggtttgcacaaggagaacaccagagtcttccgcccgaaattggatgaggcccacaggaggaagagagcagactcctggtacaaggccgtttcaagatcatttgatttggctgacctttctctttagaatgacgagggatttgtgaattacttctggattgtataaggtgcttagcacttgttatgtccatgaataagttggtcaatggaacatccttcaaaagaattagttgattccccacgctttgctgctggaattattaagtaattttcaatatacttttttaacaattgagataggagtaaaaagaaaaaataatgaaatgtcagtgttt

SEQ ID NO: 94055 - DNA, 739 bp, Oryza sativa
tgccatttgcaaactggcttgataactgttgttgtaagagaattccgcataaggtagacttttatcccatgctccaccaaaatcgagcgcacacgctcgcagcatatcttccaagatctgattgaccctttcggtctgaccatcagtttgcgggtgataggccgtgctgaaattcaaacgagtccccaattcttcttgcagtttctgccaaaattttgaagtgaactgactccctcgatcagatacaatcttcttaggtaccccatgcaaacacatgattcttgaaaggtaaagctctgccaaccttttcccagtataggtagtgtgtactggaataaaatgagcaactttggtgagtcgatccacgaccacccagattgaatcgtgacccgatgatgtcctgggcaaacctgttatgaaatccattccgatttcttcccatttccattccgggatctgaaggggttgtagcagtcctgcgggcctctgatgttctgctttgactcgctgacaaacatcgcagagtgcgacgaattcggctatctctcttctcatgctggcccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccatgctcatcctcatggaaatctcgggctttt

SEQ ID NO: 94056 - DNA, 712 bp, Oryza sativa
ttcggtccattacatggatcatccaggaggcatcgttgggttataactagttttatcatccatcgcaataccacatttaattaaacggaaacatagtaaacgagtggtgataagatcgtaaaacaagaattttgtgtctctctcactcttcctttgctttttatttaagcgttccgaccatagttcatcagcagttcgacaatacagagaaaatggcagatatagaaagatattttgatcatctcagcgacgtcgcatgcagcaaaagctgtggttgatttagcaggttcgtgagctgcacggtgcaaggcgcgtcggccagacaaaattattgggcccagtcatgactattttctcttcggaactgaatccgggaccttgagctgtcaagaaaaagagagtccagcgtcaggtatgaggtgtgcaaatactctaacatttaagcgagtcgaaagaatcagaaaaaaaaagattaagcgattgtaatagaacaatgaaatgctaaccagtcgtgggcttgtattcggtcatcttctgcacagttgacgctgagtagacgtgacccgtttcttcaggaaaagagttaggagggtattcggagaccgtgtggaacagaaacgagcatattggttgtgagcaaaacatggcaactgcgaacgctgctttgacaaccattttttgttgcaaggagttgaaaccagatgatgaatat

SEQ ID NO: 94057 - DNA, 715 bp, Oryza sativa
tactgagagagggataattgttcatatgctggataatgacgatgaagtgtcagctatgttcaccaggctcagcacacatttgatatttggttctgatacctaccactaccttcaaactttatcctatgttttggaggaccattaccaaagcaggctgaacagatggatggcttggctctggcgtaatcacttcagcaatccatggttagcattaggtgtgttggctgcagtggtcgtcctactctgtaccattgttcagaccatattaacagtcctagcctacaggcaaccccattgatgatggcatttttattctctttctaagtgaacacattcctatttcttgttcaatttggtactggtatatatgttatctggtgagaatactactgacaggtatgtatccaattgaaatatgatgctagagtaaagtgcaactcaccttagatcatcccggtataaagtgaaacacgatgtaatttacctggtgcgaagtataatgtactagaaaaacagtaatttgcatggtcttcgattagtaatgtgaaacctatcctacttaacattcttttcaaataatgagaattccctttgcaattgcgtgacttgacaccattacatgtttgtatttagagttagaattataatgtgtgcaatactgtgtttgttggttaaaataaaattgtacttctctcaacatttgttggataaatat

SEQ ID NO: 94058 - DNA, 712 bp, Oryza sativa
atctgaagtggctcagtgcgctgtctttggttaccacatgaagatactgggatgctgacaatcctcctcttacagttcttcatccgattatgctcactttcgagttgtatggctttgtccacaagtttctcaaaatcttcatattcctctaggagtagttgcactgcgatctcatcttttaacgcctggagaaacttctcttggatgtcttcatcattttccacatcttccggtgcatagtgagccaaacgatggaactcgtgcaggtactctgtgacggtcaaatcttcttgattcaggtagcggaactctcgttttctcagtgtgatcattcctgcgggaacatgtgatatcttgaatacagatgaaaactcgtcctaggtgatggtatgtccttctggccgtgatgcttcgtagctatcccaccattctgaagccagtccaaccaactgatgagttgcgaagacaacccgctcctggtttgtgcactgaaccaaccccagcttcttctcgactgtgcgcaaccaatcactgccttccataagatcgacggcaatggcaaaggttggagtcttagtttttagaaattctgataactggcactgttgctgcactggaggttcttgaacgtcggttgccctgcttgggtggttcaattctgaatagttgaaagggtttgccaacttttggtttgttaaccacaatttgaata

SEQ ID NO: 94059 - DNA, 705 bp, Oryza sativa
  unsure (1)..(705): unsure at all n locations
cttctgagtggtggctccactgaactttgcaaaacctgatcaccttgcttctggtctttctctcactggtctcaaggatacgaatcggcttctccacataagtcagatcttcctggatgtcaatgtgctctgagctagcttgttcctcaggtaccctcaaacacttcttcaattgagatacatgaaacacatcgtggattccaaccatattagatgggagctcaagctggtaagcgacttcacctcggcgttccaaaatcctgtatggtcccacaaagcgtggtgccaatttgcctttcgtttggaaccggtgtactcccctgagcggagtgacacgaaggtacacataatcccctgcttcgaaagtaagctctcttcggcggttatcagcataactcttctgccgagactgggcaattcttagcctttctctgacggttctgactttctcctctgcttcagttaatacttccgtcccaaacaattggcgttctccagtttgatcccagaagagcggagtgcggcattttcgtccgtacaacgcttaaacggtgccatttgcaaactggcttgataactggttgttgtaagagaattccccataagggagacttttattccatgctncaccaaaaatcaaccgcccacgcctcgcagcataatcttccaagatctgattgaccttttcggtctgcacatcaattg

SEQ ID NO: 94060 - DNA, 682 bp, Oryza sativa
tataggtgtactcatctcatcataataatccttcctaaagatggttagcgctagaaaagacaaggtcatcatccttgtagtaatataaagctcgtaaagactccaatagatattttgatcagcataataccacccaatatgtcttgcttctctaccaattccctcttcctagatgcgaaattatccataactacagacgtatgatctacttcacctttactgccgagctctgggcagagactttgacctaaagaacttaaagaatctgggagtagcttcaatgaatcacgaaacaccatcctcctgagtagtccctttggcgactaaacgcgctttgtaccgctcaatcgtacagtcggacttgcgtttggttttgtaaacccacaacctaccaattatattgtagttaggactaggtggtaccagtacccaagtgccattatttgcaagagctgaaatctctgaagccatagcagagcgccactgtggatgtttaacagcccctgaataacatgttggtttagtctcttgattggaaggaggcaatggatgcagggtagatgagtaggcaatgaaatcagggaatttctgaggtttcatagtgcgatctgtggttcgagtggtcataaagtgtgtcggttggtgagagtgttaacgacatggggaaggaggaggtggacct

SEQ ID NO: 94061 - DNA, 511 bp, Oryza sativa
gaacattgctctgaaagcgggaacgctttctcataaagagtaacagaacgaccgtgtagtgcgactgaagctcgcaataccataagtcgtttttgctcacgaatatcagaccagtcaaaaagtacaatggggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatca

SEQ ID NO: 94062 - DNA, 694 bp, Oryza sativa
tgcaagtagttcatcattggcttagttcttgtgtttcgatccaacaagtggtatcagagcattgttttcttctttggattttaactgatctagagttgttttgccatggctaataaatttacaactacgccccatgtcttcgatggaacggatttttcttcttggtgtagtaagatgcaatcttacattatggctgaggatcttgatatttggagaaaagtttctaatccttatgtgattcctgatcaaattaataatgctgctttaaaaattgaatttgaaaataattgcaaagctcgcaatattcttttgagtgggatttctcgttcggattatgatcgtgtttctcatcttcaaaccgctaatgagatttggattgttttgagtaattttcatcaaggaattaccaatattaaagaacttcatcgggatcttttaaaaaaggagtatataaaatttgagatgaaacctggagaagctttggatgactatctttctaggtttaacaaaattttgagttatcttagatctattgattgttcttatgatgttaattacacacaatctgaggtttctcgtcactttttgaatggtcttgacatgtctatttgggagatgaaacttacatcaattcaggagtatgttgtcacgcccgaaatttctatccaaaattccaaacgcttacatgtgtgtg
